United States Patent 11,410,750 (METHYLATION MARKERS AND TARGETED METHYLATION PROBE PANEL) - sequence listing, part 6

SEQ ID NO: 78651 - DNA, 120 bp, Homo sapiens
  chr16:230196-230316
  hyper
ggaatggcgccactgcactcaccgcacccggccaatttttgtgtttttagtagagactaaataccatatagtgaacacctaagacggggggccttggatccagggcgattcagagggccc

SEQ ID NO: 78652 - DNA, 556 bp, Homo sapiens; identical to SEQ ID NO: 35996
  chr16:230496-231052
  hyper

SEQ ID NO: 78653 - DNA, 30 bp, Homo sapiens; identical to SEQ ID NO: 44636
  chr16:23093885-23093915
  hypo

SEQ ID NO: 78654 - DNA, 41 bp, Homo sapiens
  chr16:2310480-2310521
  hypo
tttgtaacagaacacaaataaaaaaccggcctcctattttg

SEQ ID NO: 78655 - DNA, 37 bp, Homo sapiens
  chr16:23194399-23194436
  hyper
ctggcctcttttctccgcccagcgcctgttcagcccc

SEQ ID NO: 78656 - DNA, 59 bp, Homo sapiens
  chr16:2324166-2324225
  hypo
tgcacctgcccctcccggtccccacgcagcagcctcctgagctgcggatcattttccta

SEQ ID NO: 78657 - DNA, 66 bp, Homo sapiens
  chr16:2327703-2327769
  hypo
gccgggctggaggatcggggagggtgcctgggtgctcagcactggagtcctcgtcccagggattgg

SEQ ID NO: 78658 - DNA, 213 bp, Homo sapiens
  chr16:23303285-23303498
  hypo
atgttatattgtagccgttgttctgcaacttgtttttttctctcacgccccacatccaattcttcagcaaattacgtcaactcttcctgggcactgtatccagaatctgggcacctccacggctttcaccctgccccctgctctgcccttggcacccttagttcatcttagttcattctcagcaatcccttttatttaattttattttttatt

SEQ ID NO: 78659 - DNA, 350 bp, Homo sapiens
  chr16:23313389-23313739
  hyper
ggcgcatgtgggtatcgctggtgtcccgaggtggggagggagaatgcggagcgcgtgcgtgcggggggcgtccagtgtccctgaacctggcgtgtgggggctggagcttattgggaggcgagggaggtggccaggggagccgggaccgtgcgtgtggccaggccggtagcgcccagtaagctccacccgcgggcgctccccgtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccc

SEQ ID NO: 78660 - DNA, 231 bp, Homo sapiens
  chr16:23313779-23314010
  hyper
cgcacccggtctcccgcgcgctgcccggagtccctgcgcgcgcgccttctcctgcccaaccccggcccgcgagctcctgtcccggcctcagtttcccacgggagggcgcttgggtgcctgtctgaggcgcctgggacccggcctggggactgaacgggttgggggcggaggggagagctggaggctgggaaaagcccccagggtgcagaaggcagacggggccagggtccc

SEQ ID NO: 78661 - DNA, 166 bp, Homo sapiens
  chr16:2334314-2334480
  hypo
gaggtgcagtacctccgcgtctcgtagttctcgtagaaactgctgactgccatccccagacagtggttgggcagcaccaggaacacgtgatccagggttttggaaagttcttccagttttacagctgcgttggggaggtaagatcagtctgcgctggagggcacac

SEQ ID NO: 78662 - DNA, 99 bp, Homo sapiens
  chr16:233798-233897
  hypo
aacaatgtagatacacgtcgtgccactgaactgtacactgaaaaactgttataacggcacgttttgtgtgcactttactataataaaaaatgttccatc

SEQ ID NO: 78663 - DNA, 151 bp, Homo sapiens
  chr16:23444796-23444947
  hypo
cccgaggcagtcacccgttcccttgtcaccacagactctgttctccctagaacaaaaatgagctgttacctgtgtagcccactggatttgtgtgtgccaagcaccaagcaaggcatcatagagtccggtaagctgccggtccagggatagg

SEQ ID NO: 78664 - DNA, 47 bp, Homo sapiens
  chr16:23511691-23511738
  hypo
agccccaggtagggtcggcccaggggggtctgcggagctgtactgtg

SEQ ID NO: 78665 - DNA, 29 bp, Homo sapiens
  chr16:23551968-23551997
  hypo
aaggtttgggctgagcgcagtggctcatg

SEQ ID NO: 78666 - DNA, 30 bp, Homo sapiens
  chr16:23595732-23595762
  hypo
ttctttcactcggcacgttctcaaggttcg

SEQ ID NO: 78667 - DNA, 38 bp, Homo sapiens
  chr16:23606618-23606656
  hypo
tgcctcccggcgtttcagcctcacgcagatttcatcag

SEQ ID NO: 78668 - DNA, 19 bp, Homo sapiens
  chr16:23651266-23651285
  hypo
atctcggcagctccctgca

SEQ ID NO: 78669 - DNA, 61 bp, Homo sapiens
  chr16:23706226-23706287
  hyper
cctggcttcaggtcccggtgcactgtgggagaggggcagaaagaaagctggttgctgaggg

SEQ ID NO: 78670 - DNA, 204 bp, Homo sapiens
  chr16:23706411-23706615
  hyper
cgcgatccaggtccgggttttctacgtactgagcagcagcaagggccaaagcatcactctccagcccggaccttcccactcaccctccctgaaccgcaatgcaactcacctcctgcaaggaggcccggcagagctccagggcaatgtagtggaactggggtccccgctcggtgcagaagtagcggagcacgttggggtgcctgt

SEQ ID NO: 78671 - DNA, 96 bp, Homo sapiens
  chr16:23716327-23716423
  hypo
gcagctggcgcaggccgtcctggtgccaggtgtagacgcccatcacaggcacgcccaggtcctgtgtccacagcaccgtcccgcttcctgggtcca

SEQ ID NO: 78672 - DNA, 104 bp, Homo sapiens; identical to SEQ ID NO: 36097
  chr16:23765896-23766000
  hyper

SEQ ID NO: 78673 - DNA, 337 bp, Homo sapiens
  chr16:23766233-23766570
  hyper
gttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggctgtgagtgcgcccgcgtcggcggctgcggaggggacggggcgaacccaggcgtctggggctagggaaggggttgggttgaaggatggacgaacttacaagtctggggtccggggctccccggagctggaagacc

SEQ ID NO: 78674 - DNA, 102 bp, Homo sapiens
  chr16:23782435-23782537
  hypo
aaaaaaattcttaaacagttttgcacaattgatcaaatctaagtatttttatagcttccaggtcctctgcaatgcagatgacgtatgcggtctttccagttt

SEQ ID NO: 78675 - DNA, 30 bp, Homo sapiens
  chr16:23829399-23829429
  hypo
aacagttttgagcatcgtcagattctggta

SEQ ID NO: 78676 - DNA, 262 bp, Homo sapiens; identical to SEQ ID NO: 36099
  chr16:23846792-23847054
  hyper

SEQ ID NO: 78677 - DNA, 15 bp, Homo sapiens
  chr16:23847310-23847325
  hyper
cggcagcagctgggc

SEQ ID NO: 78678 - DNA, 186 bp, Homo sapiens; identical to SEQ ID NO: 1261
  chr16:23847326-23847512
  hyper

SEQ ID NO: 78679 - DNA, 28 bp, Homo sapiens
  chr16:23847788-23847816
  hyper
ggactcccggctccggaccctgctgccc

SEQ ID NO: 78680 - DNA, 58 bp, Homo sapiens; identical to SEQ ID NO: 1263
  chr16:23847817-23847875
  hyper

SEQ ID NO: 78681 - DNA, 70 bp, Homo sapiens; identical to SEQ ID NO: 1264
  chr16:23847933-23848003
  hyper

SEQ ID NO: 78682 - DNA, 561 bp, Homo sapiens; identical to SEQ ID NO: 36105
  chr16:23848004-23848565
  hyper

SEQ ID NO: 78683 - DNA, 30 bp, Homo sapiens
  chr16:23939787-23939817
  hypo
tggtatgcatgcagtcggggaccctctgat

SEQ ID NO: 78684 - DNA, 30 bp, Homo sapiens
  chr16:23966825-23966855
  hypo
cagctgagtgttctgcgtttggggacttgt

SEQ ID NO: 78685 - DNA, 105 bp, Homo sapiens
  chr16:23967391-23967496
  hypo
tataagactttattacgaataaacaaaaaaagagatcatatcctatatactttttttataattttttttgagagagggccttgctgtgtcatctaggctgaagtg

SEQ ID NO: 78686 - DNA, 231 bp, Homo sapiens
  chr16:23990945-23991176
  hypo
caactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggca

SEQ ID NO: 78687 - DNA, 33 bp, Homo sapiens; identical to SEQ ID NO: 44642
  chr16:24013932-24013965
  hypo

SEQ ID NO: 78688 - DNA, 30 bp, Homo sapiens
  chr16:24118868-24118898
  hypo
agcccatcttcctcacgttggttctgtgca

SEQ ID NO: 78689 - DNA, 241 bp, Homo sapiens
  chr16:24266904-24267145
  hyper
cgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcag

SEQ ID NO: 78690 - DNA, 374 bp, Homo sapiens
  chr16:24267220-24267594
  hyper
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatcc

SEQ ID NO: 78691 - DNA, 99 bp, Homo sapiens
  chr16:24267654-24267753
  hyper
cacactcacacagagacctctctgggtttctttgccttgagtctcccggggctgtgagaagccaggcgcatctcaaaccgagctggcagctccaggctc

SEQ ID NO: 78692 - DNA, 15 bp, Homo sapiens
  chr16:24267789-24267804
  hyper
cgctcctgaggaatg

SEQ ID NO: 78693 - DNA, 30 bp, Homo sapiens; identical to SEQ ID NO: 44542
  chr16:2436229-2436259
  hypo

SEQ ID NO: 78694 - DNA, 30 bp, Homo sapiens
  chr16:24366205-24366235
  hypo
cttcggcgggctctgcgtggcagccagtga

SEQ ID NO: 78695 - DNA, 100 bp, Homo sapiens
  chr16:24373008-24373108
  hypo
cttccactgacatctcgatgttcaccctctcccgggacccctcaaagatcaccatggggaccctcctcaactccgaccgggaccacgcttttctacagtt

SEQ ID NO: 78696 - DNA, 37 bp, Homo sapiens
  chr16:24383172-24383209
  hypo
gaataaaattaccatcggggaccggcaccagtggttc

SEQ ID NO: 78697 - DNA, 30 bp, Homo sapiens
  chr16:24549351-24549381
  hypo
aaaattttattgccacgacatctctatgga

SEQ ID NO: 78698 - DNA, 212 bp, Homo sapiens
  chr16:24621853-24622065
  hyper
tgcctcattagcatgcgcagggcaccctcgctgggcccgttggaagggaagtgcctgccggctctggggagctgcggctctcgggccctgccaaacagacgcagccttcctaaggagcagcgctgcgctggctctgctggggtggaaggagcttctccttcgctgtcctccctctcccttcccagcccatcttattccgagcctctcctctc

SEQ ID NO: 78699 - DNA, 24 bp, Homo sapiens
  chr16:2466346-2466370
  hypo
gcgagactccgcctcaaaaaaaaa

SEQ ID NO: 78700 - DNA, 62 bp, Homo sapiens
  chr16:2474253-2474315
  hypo
gaccccgtggcccggcgcctgttctggaatgctgtggcacacgcccacgagtctggcaaggc

SEQ ID NO: 78701 - DNA, 23 bp, Homo sapiens
  chr16:24880199-24880222
  hypo
tttttttttttgagacggagtct

SEQ ID NO: 78702 - DNA, 112 bp, Homo sapiens
  chr16:2493315-2493427
  hypo
ttggcagaagcctttcggagagcactggggcgtatggccagagacttaacacagcttccccaggcattagccatgtaagaaactgagacctgagccacggtggaaaggccac

SEQ ID NO: 78703 - DNA, 30 bp, Homo sapiens
  chr16:2493886-2493916
  hypo
ttacctgtgacagggcggcatagagttccc

SEQ ID NO: 78704 - DNA, 174 bp, Homo sapiens; identical to SEQ ID NO: 44545
  chr16:2497879-2498053
  hypo

SEQ ID NO: 78705 - DNA, 23 bp, Homo sapiens
  chr16:25071412-25071435
  hypo
aaacttgttaatcaccgggcgcg

SEQ ID NO: 78706 - DNA, 31 bp, Homo sapiens
  chr16:25077193-25077224
  hypo
agctggttttataaggcggccaggactattg

SEQ ID NO: 78707 - DNA, 30 bp, Homo sapiens
  chr16:25078633-25078663
  hyper
agtggtgattggcttcggttgtcatctgtg

SEQ ID NO: 78708 - DNA, 16 bp, Homo sapiens
  chr16:2508540-2508556
  hypo
gcgcctggcccccaaa

SEQ ID NO: 78709 - DNA, 115 bp, Homo sapiens
  chr16:2510869-2510984
  hypo
ctggagaaggctgtacgagttcgaagaggcatcactaaggccggagagagagacaaggcccccagcctgaaatctaggtccattgtcacctcttctggcacgacagcctccgccc

SEQ ID NO: 78710 - DNA, 78 bp, Homo sapiens
  chr16:25111119-25111197
  hypo
cagagaaggagagaccgagtcaaaagataaccaaggaggtagcacggccagatcacagtaatagccagggtatagaag

SEQ ID NO: 78711 - DNA, 30 bp, Homo sapiens
  chr16:2516812-2516842
  hypo
ctgtgtggacagtgccggagctccaccaag

SEQ ID NO: 78712 - DNA, 130 bp, Homo sapiens
  chr16:2521727-2521857
  hyper
tgctgacggcaggcacgctcttcgccgccctgagtcctgggccgccggcgcccgccgacccctgccacgatgaggggggtgcgccccgcggctgcgtgccaggactggtgaacgccgccctgggccgcga

SEQ ID NO: 78713 - DNA, 36 bp, Homo sapiens
  chr16:25266537-25266573
  hypo
aagggccgacgttctcgctttcggttcagctgttcc

SEQ ID NO: 78714 - DNA, 30 bp, Homo sapiens
  chr16:2531210-2531240
  hypo
tggcacactggcattcgggaagcatgtctt

SEQ ID NO: 78715 - DNA, 149 bp, Homo sapiens
  chr16:2531804-2531953
  hypo
agccacagttaggcacgtttgcacttccaaccatcacaggcaggcgggccaaccggcccatggtgtggtgactaacacctcattaatggtcataccccttctgtacctggcatgtgccctccattgtgtgcctccggcaaagagcccac

SEQ ID NO: 78716 - DNA, 44 bp, Homo sapiens
  chr16:2539796-2539840
  hypo
cctcaggcagctgagcggtcctggccggccgggctgggctgagt

SEQ ID NO: 78717 - DNA, 105 bp, Homo sapiens
  chr16:2540828-2540933
  hypo
ctctcactccctccccggccaccgcctccggctctgcacctttgtcaggggttgggggactgcagggaacagaggaggccttgtttgctgcgtaggagcaggtgc

SEQ ID NO: 78718 - DNA, 101 bp, Homo sapiens
  chr16:2546405-2546506
  hypo
gcagcagctgcctgccgctgcccgagttcgtggacaacacgcaggtgcccagctactgcctgaatgcacgcggcgagggggccgtgcgcaagatcctcctg

SEQ ID NO: 78719 - DNA, 30 bp, Homo sapiens
  chr16:2548427-2548457
  hypo
agagccgcccagccacgtgtcctgcccaca

SEQ ID NO: 78720 - DNA, 30 bp, Homo sapiens
  chr16:25535143-25535173
  hypo
aatatgccaagtacacgaacactccttcct

SEQ ID NO: 78721 - DNA, 19 bp, Homo sapiens
  chr16:25551069-25551088
  hypo
ggtgctggccaggcacggt

SEQ ID NO: 78722 - DNA, 28 bp, Homo sapiens
  chr16:25692519-25692547
  hypo
ttaagatatgtaggccgggtgcggtggc

SEQ ID NO: 78723 - DNA, 1328 bp, Homo sapiens; identical to SEQ ID NO: 36109
  chr16:25702795-25704123
  hyper

SEQ ID NO: 78724 - DNA, 255 bp, Homo sapiens; identical to SEQ ID NO: 4339
  chr16:25704389-25704644
  hyper

SEQ ID NO: 78725 - DNA, 151 bp, Homo sapiens
  chr16:25808282-25808433
  hypo
tttctgggcctccttcgggtttcagccagtcttaattccggtccagagagaagtcctcctgcccttgtccctcactaccattttctgtcctcactgtagccctataaaacgagaattattgtcttcattctataaacgaagtaactggttt

SEQ ID NO: 78726 - DNA, 30 bp, Homo sapiens
  chr16:25859755-25859785
  hypo
cagcctaattttaaacgaaaaaataatttt

SEQ ID NO: 78727 - DNA, 87 bp, Homo sapiens
  chr16:2589044-2589131
  hypo
aaatttaattgatcccgtgtcttccaggatgcggcttttttttttttttttttttgatggagtctccctctcgacgcgcaggctgga

SEQ ID NO: 78728 - DNA, 18 bp, Homo sapiens
  chr16:26044215-26044233
  hypo
tctcgcctcttcttcaca

SEQ ID NO: 78729 - DNA, 32 bp, Homo sapiens
  chr16:26383401-26383433
  hypo
agctgtaggtagggccgggcgcggtggctcac

SEQ ID NO: 78730 - DNA, 88 bp, Homo sapiens
  chr16:26388441-26388529
  hypo
ctcaaaaaaaaaaaaaaaaaaaaagaatcacttaccacagtctggaatttactggagacatgcaatggcttagcggcaatccaagaga

SEQ ID NO: 78731 - DNA, 214 bp, Homo sapiens
  chr16:26501488-26501702
  hypo
gccctcagatgaagacgaaaatctttctttggaaagggctgtttactgattcagaagacaggactgaggcatcagaagcaccgagcctattccattctctcccatactactcagagaaaaccaccaagggttcttgtagagtgccataaggagttaagcacagtcgccatcagaaacacctattgtggaccaggttgtgcgtacatgcacatac

SEQ ID NO: 78732 - DNA, 134 bp, Homo sapiens
  chr16:26616439-26616573
  hypo
gctcaaggatttcttcggagctgttctgactaaagatgaaattgggaagaggcacacgaggaagaaaatcactcactgcttgaggctgccaggttcagctgacattttctgtctcatcgcgtctacctagaaat

SEQ ID NO: 78733 - DNA, 42 bp, Homo sapiens; identical to SEQ ID NO: 44646
  chr16:26664733-26664775
  hypo

SEQ ID NO: 78734 - DNA, 30 bp, Homo sapiens; identical to SEQ ID NO: 44647
  chr16:26732577-26732607
  hypo

SEQ ID NO: 78735 - DNA, 30 bp, Homo sapiens
  chr16:26830222-26830252
  hypo
ataatagagatatggcgcacataatgggga

SEQ ID NO: 78736 - DNA, 30 bp, Homo sapiens
  chr16:27006797-27006827
  hypo
cgtaattgattggcacgtgtaactttcaag

SEQ ID NO: 78737 - DNA, 32 bp, Homo sapiens; identical to SEQ ID NO: 44648
  chr16:27038943-27038975
  hypo

SEQ ID NO: 78738 - DNA, 70 bp, Homo sapiens
  chr16:27052238-27052308
  hypo
ctggtaatgggttcccggacgctgacaaataggattctcggaggcagccacgccacgttagcagattaaa

SEQ ID NO: 78739 - DNA, 30 bp, Homo sapiens
  chr16:2712995-2713025
  hypo
ctccaggagacagaccgaattagaagggga

SEQ ID NO: 78740 - DNA, 57 bp, Homo sapiens
  chr16:27166676-27166733
  hyper
cagcaagtcccccatcgctccaaaaaaaaattaaaaattagccgggcaaaccattca

SEQ ID NO: 78741 - DNA, 36 bp, Homo sapiens; identical to SEQ ID NO: 44649
  chr16:27279055-27279091
  hypo

SEQ ID NO: 78742 - DNA, 120 bp, Homo sapiens
  chr16:2731636-2731756
  hypo
attgaattcatgttcggggccacgttgttatatgtattgatatacagccttgaatgtgaataattactatatattttacaacttttttctggctttattacaaaaactttcttttttttt

SEQ ID NO: 78743 - DNA, 30 bp, Homo sapiens
  chr16:27460076-27460106
  hypo
agtgaggagagggatcggccatacggcctg

SEQ ID NO: 78744 - DNA, 94 bp, Homo sapiens
  chr16:2762746-2762840
  hypo
ccagctgatcacccccgcctgcagccacgactgacccacgaggcacaccagggggccgcccgagtcgccctgcgggggacgcagagtcaccgtc

SEQ ID NO: 78745 - DNA, 613 bp, Homo sapiens
  chr16:2764096-2764709
  hypo
ccagcagttcatgcccgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctcgtgtggggacaggcccgggaggggctggggctcctctggccaccaccgtgccccacacctctctctgcacaatgtcttcgagagtcatctctaggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 78746 - DNA, 86 bp, Homo sapiens
  chr16:2765717-2765803
  hyper
cttgcggaagcagtgcgcagccgtcaggacccactgctccgcgatgaggctgcccccgcagaagtggcttccgttgcgctggatgc

SEQ ID NO: 78747 - DNA, 30 bp, Homo sapiens
  chr16:27661959-27661989
  hypo
caggaaatgttcctccgattttgctttcat

SEQ ID NO: 78748 - DNA, 444 bp, Homo sapiens
  chr16:2770092-2770536
  hypo
gaccctgcaccttcacgactcaccaaaacacagcagcagcaggagcggcaccgccgccggccgcctcatgtcctcaggcctggctggggcgcagggccgtggtcggcggtggcagaagcgttggagcacgagcgaggtgcaggctccatgaagtggagttttatgctggagatgagcacaggcccggctatgcggcccaacccgtcggcccggcctgcccagctcctctcctcaggaaggaagcgcccagagccgactcctccgtgacctagccctgaaccccgagaccccagggcagacccctcaccccagcgcagcacggggtgccgttggcctcggttcctggaccctgagctgacccagaccccccagcagaccccgagctgaccgcggtgcacgcgaagtccgtccagcttcattcattattattattattattttttt

SEQ ID NO: 78749 - DNA, 110 bp, Homo sapiens
  chr16:27853439-27853549
  hypo
ttcacatcagtagcacgatgtcgcgcgtgccgaatttcacaccagtagcacgatgtcgcgcgtgccgaatttcacatcagtagcacgttgttgcgcgtgttaaatttcat

SEQ ID NO: 78750 - DNA, 32 bp, Homo sapiens
  chr16:280197-280229
  hypo
tatttatttttgagacggagtttcgcccaggc

SEQ ID NO: 78751 - DNA, 56 bp, Homo sapiens
  chr16:28057979-28058035
  hypo
tccagtcttcgtggccgtctctgcttccactcccgcatcaccgctccctggctccc

SEQ ID NO: 78752 - DNA, 210 bp, Homo sapiens
  chr16:2806195-2806405
  hypo
tggagcattatacagcgaagacttagtgtgaagatcaatgttgaattagggatgaaggagagcagggacttgggtgtggggcggtaagtggttagtttggggccaggggcctgacccgtgtctccccgctccccctcaggagcggtggtgccccccccgggcacggggccatgtacaacgggatcgggctgccgacgccccggggcagcg

SEQ ID NO: 78753 - DNA, 43 bp, Homo sapiens; identical to SEQ ID NO: 36111
  chr16:28073999-28074042
  hyper

SEQ ID NO: 78754 - DNA, 179 bp, Homo sapiens; identical to SEQ ID NO: 36112
  chr16:28074076-28074255
  hyper

SEQ ID NO: 78755 - DNA, 520 bp, Homo sapiens; identical to SEQ ID NO: 36113
  chr16:28074417-28074937
  hyper

SEQ ID NO: 78756 - DNA, 432 bp, Homo sapiens; identical to SEQ ID NO: 36114
  chr16:28074955-28075387
  hyper

SEQ ID NO: 78757 - DNA, 221 bp, Homo sapiens
  chr16:28104147-28104368
  hypo
ccaaccaaaacctgagtgtctttaaaaaaaaaatctacctgttgccaaaatgcctgccgcctacgtcaggtctgtggatctctgggacgtttcattgaaatacttaactttccaacccaccccttggtacctgactgacccagggaaagcttctgccacccttcagaggcccctgggggctctgagtcaggctctgaccagcaccacggagctctctctgc

SEQ ID NO: 78758 - DNA, 39 bp, Homo sapiens
  chr16:2818117-2818156
  hypo
ggcggagttcctcctcgtcgtcgtcgtcctctagctcct

SEQ ID NO: 78759 - DNA, 39 bp, Homo sapiens
  chr16:2819758-2819797
  hypo
aaagccccacctctgcgggagtggcgtgtgaggctcttc

SEQ ID NO: 78760 - DNA, 220 bp, Homo sapiens
  chr16:28304439-28304659
  hyper
accagcaagaagcctcggggatcccccccctaaagctccaggacttgggcgactgagcccctggcggcaccgcttgcaccccggtccatggtcgtggcgccctgagcccccggggccgggcagacgaagaccgcgacggcgcccaggccccctgccgcggcgtccccgcggccccagcccaggtaagccgggcccaggtgaggggcggcaggtgagtggc

SEQ ID NO: 78761 - DNA, 267 bp, Homo sapiens
  chr16:2849356-2849623
  hypo
cgggcctacagcagtcgttacaaagtgcaggacatcattgtgaaccctgacgcacttggggttttacgcaatgacattgccctgctgagactggcctcttctgtcacctacaatgcgtacatccagcccatttgcatcgagtcttccaccttcaacttcgtgcaccggccggactgctgggtgaccggctgggggttaatcagccccagtggcagtgaggctggggatagaccgggtggggtgatgggggtgcggggtgagcattac

SEQ ID NO: 78762 - DNA, 104 bp, Homo sapiens
  chr16:28560175-28560279
  hypo
ccatgtagaatgaagcgagcccagacatcattgtcgccctccgcaacggtgcatctgtgctcccatttttgcaagaaaaattattttctttttctttttctttt

SEQ ID NO: 78763 - DNA, 30 bp, Homo sapiens
  chr16:2868686-2868716
  hypo
ccttagtgatccctccgggtggatggtcca

SEQ ID NO: 78764 - DNA, 52 bp, Homo sapiens
  chr16:2877484-2877536
  hypo
tccccaggtcaggcacgcaggtgaggaggagtgtcctcgtgtgtgcatgccc

SEQ ID NO: 78765 - DNA, 30 bp, Homo sapiens
  chr16:2879766-2879796
  hypo
gcctggtgcacctgccgcacagggcacagg

SEQ ID NO: 78766 - DNA, 165 bp, Homo sapiens
  chr16:28878680-28878845
  hypo
ctcttctatcacagacgtccggacaaccacagccctggagatgcctgaccgggagaacacgtttgtggttaaggtaggaattcaacttcccagccgccggcagtgcttgtgttaaggagaaagccctcagcgcatttaagcaagtggcgtcgccgaaaggaggta

SEQ ID NO: 78767 - DNA, 149 bp, Homo sapiens
  chr16:28887653-28887802
  hypo
tctgtctcaggctctcgactccctcgaagctgcccatctctccgtctgcccctctccatgtttgggcattcccactgctgtaagacagtagcccctgtcactcctccaggtgccggtggggagacgccggccagcgccaaaagccttgg

SEQ ID NO: 78768 - DNA, 523 bp, Homo sapiens
  chr16:28891515-28892038
  hyper
ctctgcctcctctcccgccctgggggctactccccatcccgcggtccatctgcatgtcgcgggttcttccgcagcatgtgagcctcgctggggactctggaggcaacgaaagcctccctgtgccttggtctccgaacgcaggccccgtcgcgttaagcacaagctggcagggcctctcctctcccttctcagatttgctccttgacatttgcctgctgcctggcggtggcaacagctggggcggggcgcgcgcaggaggccccgtaaccctatccccgctccggctccctcgtgaaaccggagcttccctgccttggccgagggggagggctgcgggggccagaccgcctgcgaagaccacagggtttttcctctcgggttttggctcccgtgggatggatgtggctgtgcggggggttggcctgagcttcgcttctaagccagcagcttggtcagggaaacctgaaagcattcccagctaatcccccaagtggtgcaagtctgtgcgcgcccatcccgctga

SEQ ID NO: 78769 - DNA, 116 bp, Homo sapiens
  chr16:2892487-2892603
  hyper
gaagttggcctgacccgagaagcccaggatcgctgaggaagctccccactgttgtcgcctctcagccccacgcccactcatccacaggcagccgggatgctcacgcagccacgtca

SEQ ID NO: 78770 - DNA, 103 bp, Homo sapiens
  chr16:2892626-2892729
  hyper
cgactctgccaacagggggcgctgcaggaggctacgcggtcgcagggactcctttctgtccgtttccgacaaacttcccgcgctcttccggaggttgagggtg

SEQ ID NO: 78771 - DNA, 26 bp, Homo sapiens
  chr16:28947344-28947370
  hypo
cccgtccgcctcgcaatttgaactcc

SEQ ID NO: 78772 - DNA, 70 bp, Homo sapiens
  chr16:28947831-28947901
  hyper
gattcttcaaagtgacgcctcccccaggaagcgggccccagaaccagtacgggaacgtgctgtctctccc

SEQ ID NO: 78773 - DNA, 38 bp, Homo sapiens
  chr16:28986682-28986720
  hyper
ctgaactacatggaccgcttcaccgtggctggtaggga

SEQ ID NO: 78774 - DNA, 90 bp, Homo sapiens
  chr16:29009366-29009456
  hypo
agcagggactacaggcgtgcaacatcatgcccacttaattgtttgtattttctgtacaaacagttttctgtgacaccccgtctctactaa

SEQ ID NO: 78775 - DNA, 30 bp, Homo sapiens
  chr16:29083064-29083094
  hypo
gtcctagttaatgttcggcttcttaaattg

SEQ ID NO: 78776 - DNA, 30 bp, Homo sapiens
  chr16:29119028-29119058
  hypo
taagggaagaaaaggcgctcttttgatgtt

SEQ ID NO: 78777 - DNA, 85 bp, Homo sapiens
  chr16:29139086-29139171
  hypo
gcagggagggcatttcggcccattttacagaccaggaaaacgggcggagaggctgagtgactgcccgaggcgacacacagctctc

SEQ ID NO: 78778 - DNA, 97 bp, Homo sapiens
  chr16:29153157-29153254
  hypo
ggtgggataatcctccgtggcacgaggaagcagtggaataatcctccatggcacaagggagcggtggaataatcctctgtggcacgcgggggggggt

SEQ ID NO: 78779 - DNA, 217 bp, Homo sapiens
  chr16:29153374-29153591
  hypo
gtggtataatcctctgtggcacgaggggtcggcggtataatcctccgtggcacgaggatggtcaccgcattcgtcactcttagctgcagtgcgtgtgacagtcgccagggctgctgtttgaggaatgggagttgcctgcgtctgctctgccccaggtggtttgtagggtggtttttactccttgccaaagcccacacagccccgcaaggcaaacagt

SEQ ID NO: 78780 - DNA, 159 bp, Homo sapiens
  chr16:29169937-29170096
  hypo
agggctgggaaacagcggagatggcgcgccccacctgggagaacacaggcagctggaggacgtcggcggtgttactgtcacggtcacctggactgggcggttgcaggcggccggatgctggacccgcagcgtgagctccacggccgcagcagggaggcg

SEQ ID NO: 78781 - DNA, 30 bp, Homo sapiens
  chr16:29179232-29179262
  hypo
gcatcggggtgcgtgcgcaggaaacgggag

SEQ ID NO: 78782 - DNA, 181 bp, Homo sapiens
  chr16:29187850-29188031
  hypo
tctgtttactgagcacgcgtgatgtgccaggtgtggccctggggctcgaactctattgcccggtctataaagcacatgttgtcaccaccccgttttacagaggaggaaactgaggcttggggaggctcatcagctcaccctgcggggagtcggccggcagcagctgcgtcactgtggatcc

SEQ ID NO: 78783 - DNA, 55 bp, Homo sapiens
  chr16:29191424-29191479
  hypo
gcatccatgcaccagcggcaccacgacccacccgggcccgcgtgactagactcag

SEQ ID NO: 78784 - DNA, 146 bp, Homo sapiens
  chr16:29230150-29230296
  hypo
tgcgagaggcatttacgacctcagcgacacattccctcaacctcatcacgctgcaagtgctgccagggtgtgttcaggggacactccctctcgggctggcttgtgcggggacacgtgcgtgcacacagacacggactcacataaat

SEQ ID NO: 78785 - DNA, 344 bp, Homo sapiens
  chr16:29244717-29245061
  hypo
ggaagggccctgagccgggtgccacggccgacgccctgtcctttgccgtgacagtctctgtgcagtgcaggcagcccccaccgaatccaggtacagtgctcagtgacaagcgtagggagagtggtcaaatcggagcaggggcaggggacgtgagtcaggctgaaaagaagaagctcagagcaggaagggcagaggggccgggaagggcaggtctgaagctcggagtgggaagggcagacgggctgggaagagcaggtctgaagctcggagtgggaggggcagaggcggtgaagggtgagtccggagcagcctctagttgcccaggtgctcggagagtgaggaac

SEQ ID NO: 78786 - DNA, 125 bp, Homo sapiens
  chr16:29248426-29248551
  hypo
tctgcctgggtctggcgggcgcttcctggtgagagatcccacttggtatctctgtgggaacggaagggaggtgaggccgcgggaacggaagggaggagaggccgcgggaacggcggggaggcgag

SEQ ID NO: 78787 - DNA, 30 bp, Homo sapiens; identical to SEQ ID NO: 44659
  chr16:29262965-29262995
  hypo

SEQ ID NO: 78788 - DNA, 80 bp, Homo sapiens
  chr16:29266368-29266448
  hypo
ttaaaacaacagaaacgtatcccccacagccctgaaagcagagggctggcatcaaggagcctgcccgggggtgccagcca

SEQ ID NO: 78789 - DNA, 30 bp, Homo sapiens
  chr16:29324346-29324376
  hypo
atgccagggcctcagcgctgacctggctgt

SEQ ID NO: 78790 - DNA, 34 bp, Homo sapiens; identical to SEQ ID NO: 44661
  chr16:29324812-29324846
  hypo

SEQ ID NO: 78791 - DNA, 63 bp, Homo sapiens
  chr16:29353324-29353387
  hypo
actttaccccctcatcgtcataccatattcagttttctgtatatcccacgatgtagcatgctt

SEQ ID NO: 78792 - DNA, 27 bp, Homo sapiens
  chr16:29660744-29660771
  hypo
ggcgtgagcgatcgcacccagcctctt

SEQ ID NO: 78793 - DNA, 37 bp, Homo sapiens
  chr16:29682566-29682603
  hypo
cccaaagtgctgggattacaggcgtgagccacagtgc

SEQ ID NO: 78794 - DNA, 73 bp, Homo sapiens; identical to SEQ ID NO: 44662
  chr16:29691644-29691717
  hypo

SEQ ID NO: 78795 - DNA, 30 bp, Homo sapiens
  chr16:29703508-29703538
  hypo
atgcagggcccatcacgggctatgcctacc

SEQ ID NO: 78796 - DNA, 30 bp, Homo sapiens
  chr16:29711222-29711252
  hypo
atgctgttgtgagtacgggatgtgccagca

SEQ ID NO: 78797 - DNA, 171 bp, Homo sapiens
  chr16:2975829-2976000
  hypo
cctctgcgttgtctccggagccgaccaggccttcgggagtggaatgtggggccccaggccagggaactttggatcaaagtgggagaccagtgggaactggagctgcagcatgtgaggtgggggtgaggacgctgaaaatgtcagggactgcagtctcgattccaggctgag

SEQ ID NO: 78798 - DNA, 252 bp, Homo sapiens
  chr16:29830871-29831123
  hypo
ccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagc

SEQ ID NO: 78799 - DNA, 35 bp, Homo sapiens
  chr16:29884723-29884758
  hypo
ccccgggttcaggcacggctcgtacttcactgcgg

SEQ ID NO: 78800 - DNA, 148 bp, Homo sapiens
  chr16:29888624-29888772
  hyper
ctggatttgggggcccgggcggtgcctgaaactgcagtgtgaggtcgggcccagaggagagaaggcggcggcgcggctgaggtccccgcagctgggccaagactcgggcgctgggaccgtccccgtcgaacagcgtcagcatgtcccc

SEQ ID NO: 78801 - DNA, 30 bp, Homo sapiens
  chr16:29913174-29913204
  hypo
ctcctgcctggggcccggctcgagggccgc

SEQ ID NO: 78802 - DNA, 141 bp, Homo sapiens
  chr16:29936349-29936490
  hypo
tttgatacttgaaggcagatctccgcctctcaaatttttattctcctgctctcacagtcctcgttaacccctcccttaagactctcccactcccaaactccaaaacttcaaagtctcacttgggcacgaagggtccatact

SEQ ID NO: 78803 - DNA, 35 bp, Homo sapiens
  chr16:29972439-29972474
  hypo
ctggcgacagactgagaccccgtctcaaaaaaaaa

SEQ ID NO: 78804 - DNA, 34 bp, Homo sapiens
  chr16:299951-299985
  hypo
atttttctttttagacggagtctcgctctgtcgc

SEQ ID NO: 78805 - DNA, 112 bp, Homo sapiens
  chr16:30015457-30015569
  hypo
gactggacactgccccgcaggacccagcaggcctaagcctcaggacctccatgtccacaccaggttcagcctcctctgctggcacgtgacttctccccgtttcccgcccccc

SEQ ID NO: 78806 - DNA, 630 bp, Homo sapiens
  chr16:30017228-30017858
  hypo
gcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgt

SEQ ID NO: 78807 - DNA, 44 bp, Homo sapiens
  chr16:30018478-30018522
  hypo
agcccccacacagaccgggacctggcgctcgaggcagatgttaa

SEQ ID NO: 78808 - DNA, 38 bp, Homo sapiens
  chr16:30020315-30020353
  hypo
cctgagcaccttgtgcgtgatgtcgtcatctgtgatcc

SEQ ID NO: 78809 - DNA, 154 bp, Homo sapiens
  chr16:300225-300379
  hypo
ggccaggaatctatgttttaaacatttcacacatcccttccttggggacatggtggctagatttgctgaattaatggccgtctcctcttcttccagccctggccccagcccctcaggccctggcaatgaggcactcctacgttctgttgctggc

SEQ ID NO: 78810 - DNA, 114 bp, Homo sapiens
  chr16:30022990-30023104
  hyper
gatctcggggtctcccgagccaggctggggagcctcacgatctgagggaggaggcagaggtctgatgctgcggcttcccccacgccccctccctttggccgttcaggcctctct

SEQ ID NO: 78811 - DNA, 38 bp, Homo sapiens
  chr16:30032589-30032627
  hyper
agagtccgctgagcacgcaccttcgttgtgaaactaag

SEQ ID NO: 78812 - DNA, 129 bp, Homo sapiens
  chr16:30042292-30042421
  hyper
aaggaaggaggtgggcgggagggagcggaggagcagccgggcaagcggtcagcggtcaccaccgctctcctggctccactgcctcctctcgctgccgccccagtccctgccgcccggcacagacaccgc

SEQ ID NO: 78813 - DNA, 26 bp, Homo sapiens
  chr16:30065618-30065644
  hypo
cagtgatactccgtctcaataagaat

SEQ ID NO: 78814 - DNA, 30 bp, Homo sapiens
  chr16:30085375-30085405
  hypo
ctaagaagccaggcacggtggctcaagctg

SEQ ID NO: 78815 - DNA, 107 bp, Homo sapiens
  chr16:30100357-30100464
  hypo
gggtgaatgtagacacggtcaggcaggcggggctctgccttgccgctgggctcccagcgccggccctgccagcggtagcgagccccatccaccggaatcacatccag

SEQ ID NO: 78816 - DNA, 30 bp, Homo sapiens
  chr16:30103941-30103971
  hyper
gtccagagctcccttcgggtggcgggaagc

SEQ ID NO: 78817 - DNA, 196 bp, Homo sapiens
  chr16:30116119-30116315
  hypo
gcacaacgatgtgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaag

SEQ ID NO: 78818 - DNA, 34 bp, Homo sapiens
  chr16:30124080-30124114
  hypo
gagctccaggaggtccgagcgctgggccatggag

SEQ ID NO: 78819 - DNA, 364 bp, Homo sapiens
  chr16:30124497-30124861
  hypo
agccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 78820 - DNA, 23 bp, Homo sapiens
  chr16:30135083-30135106
  hypo
agggtctctctctgtcgtccagg

SEQ ID NO: 78821 - DNA, 57 bp, Homo sapiens; identical to SEQ ID NO: 36030
  chr16:3016793-3016850
  hyper

SEQ ID NO: 78822 - DNA, 275 bp, Homo sapiens; identical to SEQ ID NO: 4311
  chr16:3017156-3017431
  hyper

SEQ ID NO: 78823 - DNA, 34 bp, Homo sapiens; identical to SEQ ID NO: 44559
  chr16:3021547-3021581
  hypo

SEQ ID NO: 78824 - DNA, 45 bp, Homo sapiens
  chr16:3026818-3026863
  hypo
tgccagcctggggtccgaggagggaagaggcggctgatgggaatg

SEQ ID NO: 78825 - DNA, 30 bp, Homo sapiens; identical to SEQ ID NO: 44667
  chr16:30354712-30354742
  hypo

SEQ ID NO: 78826 - DNA, 181 bp, Homo sapiens
  chr16:30365186-30365367
  hypo
cccaggccccagccacgccagcccctgggccgcacccagtcaatgttgtccagccagctgtctcggatctgagcatcccggttcaggaagtagttgccatcggcatcaaagtggccttcctccatctcctcctgcaggttaaagggtgtgatccgaacacccccctcgctggggagtgtgg

SEQ ID NO: 78827 - DNA, 20 bp, Homo sapiens
  chr16:30401737-30401757
  hypo
ttattttttttgagtcggag

SEQ ID NO: 78828 - DNA, 153 bp, Homo sapiens
  chr16:30430020-30430173
  hypo
cctaaaaggggttcccggcacctcggtttgtgttggttggaggtgatcgcacacttggcccttggttacgtcctcataaccttagacctgaaagggcccataaatatactatgttcacgatcagacacgcactgcattcggcagagctccagt

SEQ ID NO: 78829 - DNA, 19 bp, Homo sapiens
  chr16:30541444-30541463
  hypo
cggccgagaatagctacat

SEQ ID NO: 78830 - DNA, 63 bp, Homo sapiens
  chr16:30567446-30567509
  hypo
gggagagttcaggctcggctcatcctggtccttgaatcccacagcccgcgtggacagggacag

SEQ ID NO: 78831 - DNA, 34 bp, Homo sapiens
  chr16:30573625-30573659
  hypo
ccggtccaagattctcgaccgagggcctgacgtc

SEQ ID NO: 78832 - DNA, 31 bp, Homo sapiens
  chr16:30584531-30584562
  hypo
catttctacttatttacgttgttccaaatta

SEQ ID NO: 78833 - DNA, 47 bp, Homo sapiens
  chr16:30644928-30644975
  hypo
tgagatgggaggctccgttgagtcctggagttcgaaaccccgtcact

SEQ ID NO: 78834 - DNA, 280 bp, Homo sapiens
  chr16:3068171-3068451
  hyper
tcctaggccgagtgtcgggacaggggcggaggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaagcagcgcggtgacatggggaa

SEQ ID NO: 78835 - DNA, 69 bp, Homo sapiens
  chr16:30761038-30761107
  hypo
aaccccattttttcacggattcattcatttatgccttcaacacaaagctcaacacggggagggcagaaa

SEQ ID NO: 78836 - DNA, 30 bp, Homo sapiens
  chr16:3078354-3078384
  hyper
ggcctccagctcctgcgtgagcgccacctt

SEQ ID NO: 78837 - DNA, 48 bp, Homo sapiens
  chr16:30790427-30790475
  hypo
accctacgaactgtgcgctcacatcatccatcccgtacaagagccaag

SEQ ID NO: 78838 - DNA, 104 bp, Homo sapiens
  chr16:30803850-30803954
  hypo
gtgaaccaccatgcccggcccaatgctcttcttagttatgggccttatgccccgaggggctgcaataacagtgagttcctggccaggtgcggtggctcacacct

SEQ ID NO: 78839 - DNA, 26 bp, Homo sapiens
  chr16:30804455-30804481
  hypo
tgcggacttcccgattaaaaagcact

SEQ ID NO: 78840 - DNA, 34 bp, Homo sapiens
  chr16:30817004-30817038
  hyper
gcgtccgggcccaggcgaccggggcctccgagct

SEQ ID NO: 78841 - DNA, 145 bp, Homo sapiens
  chr16:30826330-30826475
  hypo
cccaaagtgctgggattaccggcgggagccaccgctcccgtccaggacagggattttggttggttggttggatggagccttacagtttggatgtggtgagcatgaaatgcatacgttcaagaagctgagccgacaaagggcttac

SEQ ID NO: 78842 - DNA, 30 bp, Homo sapiens
  chr16:30832615-30832645
  hypo
cagggacaggaacaacgctgaggagcttga

SEQ ID NO: 78843 - DNA, 30 bp, Homo sapiens
  chr16:30832846-30832876
  hypo
cgagaaaatgtgggtcgtgaccaactcagt

SEQ ID NO: 78844 - DNA, 30 bp, Homo sapiens
  chr16:30833324-30833354
  hypo
ctctgggcttgttgccgttgttggctgcag

SEQ ID NO: 78845 - DNA, 76 bp, Homo sapiens; identical to SEQ ID NO: 44672
  chr16:30906986-30907062
  hypo

SEQ ID NO: 78846 - DNA, 196 bp, Homo sapiens; identical to SEQ ID NO: 44673
  chr16:30907122-30907318
  hypo

SEQ ID NO: 78847 - DNA, 99 bp, Homo sapiens
  chr16:3096690-3096789
  hyper
gcccacccgacccagcggcgcgaccctggccctccgggaccctccgctgactccaccgcgcacttcccgggacccccacacacatcccagccctccggc

SEQ ID NO: 78848 - DNA, 188 bp, Homo sapiens
  chr16:3096821-3097009
  hyper
cgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcc

SEQ ID NO: 78849 - DNA, 30 bp, Homo sapiens
  chr16:30979173-30979203
  hypo
gaattccgagttaaacgaggcatctcccca

SEQ ID NO: 78850 - DNA, 30 bp, Homo sapiens
  chr16:31001301-31001331
  hypo
gacaacatgccaggacgcacacagacagca

SEQ ID NO: 78851 - DNA, 30 bp, Homo sapiens; identical to SEQ ID NO: 44674
  chr16:31018076-31018106
  hypo

SEQ ID NO: 78852 - DNA, 30 bp, Homo sapiens; identical to SEQ ID NO: 36119
  chr16:31022167-31022197
  hyper

SEQ ID NO: 78853 - DNA, 198 bp, Homo sapiens
  chr16:31138607-31138805
  hypo
caagctctggctctgcgagtactgcctcaagtacatgaaatatgagaagagctaccgcttccacttggtgaggctgggccggccgggccgagctgggcaggggcccggtgagaggcagaggcaggcatggagactgagggcggctgcgccggcagctccagggaggagacaggcccaaaggagcgagtacagggaaga

SEQ ID NO: 78854 - DNA, 39 bp, Homo sapiens; identical to SEQ ID NO: 44676
  chr16:31149942-31149981
  hypo

SEQ ID NO: 78855 - DNA, 81 bp, Homo sapiens
  chr16:31173147-31173228
  hypo
caagagtgaaactcaatctcaaaaaaagaaaaaaaagtgtttgtccctgcttaaaagtctctgtggcggctctaggctctt

SEQ ID NO: 78856 - DNA, 196 bp, Homo sapiens
  chr16:31213944-31214140
  hyper
acttcttgagctcctcggcggtcaggttctccagcgcatccaggatggcgtcgcgcgcgcgccccatggctccaggatccccggccgctgccgccgctcaccccgctgcagccgccgaccaggaggaagtcggctccggggcggaacctggactccccgccttcctcccactctggtctcccgactccccgccccg

SEQ ID NO: 78857 - DNA, 138 bp, Homo sapiens; identical to SEQ ID NO: 36120
  chr16:31226609-31226747
  hyper

SEQ ID NO: 78858 - DNA, 68 bp, Homo sapiens
  chr16:31227017-31227085
  hyper
taagggctaggcagccgggatctgcacttatgtgtgcgggcccagggtggcaccgagagccccgtcca

SEQ ID NO: 78859 - DNA, 43 bp, Homo sapiens
  chr16:31227355-31227398
  hyper
ctggaggcacggaggcgtccttggtccccgaggtggagacact

SEQ ID NO: 78860 - DNA, 39 bp, Homo sapiens
  chr16:31227770-31227809
  hyper
aaaaaaacccaacctcgcccaaccttgcccgtctttatc

SEQ ID NO: 78861 - DNA, 4 bp, Homo sapiens
  chr16:31228309-31228313
  hyper
tctc

SEQ ID NO: 78862 - DNA, 152 bp, Homo sapiens
  chr16:31373926-31374078
  hypo
ctcaggttactccaccgagctggccctctggaaaggggtgcagagcctggtcctgggggccccccgctaccagcacaccgggaaggctgtcatcttcacccaggtgtccaggcaatggaggatgaaggccgaagtcacggggactcaggttg

SEQ ID NO: 78863 - DNA, 40 bp, Homo sapiens
  chr16:31384803-31384843
  hypo
gtgccatctggggcacgcctctgctcgtgtgggtgttcaa

SEQ ID NO: 78864 - DNA, 65 bp, Homo sapiens
  chr16:31388356-31388421
  hypo
gctgtcctgggagaccggctgcttctgacagccaatgtgagcaggtgagccgggccaggccaggg

SEQ ID NO: 78865 - DNA, 282 bp, Homo sapiens
  chr16:3139085-3139367
  hypo
gccaagctagtacagcgtctcgcgggcgtgggtgcgcaggtggcgcagcaggtgggagttgcggctgaagctgcggccacactgcgtgcaggagtagggcctggcgcccgtgtgcaccagcaggtgtcgcagcagattgcagctgcggctgaagctcttcccgcactccacgcactcctgcgggggctcggcctgctcctgcccgggctccgcatgggtagccaggtgccgccgcagatgcgcgttgcgccggaagctgcgaccgcacgtctgacagctgta

SEQ ID NO: 78866 - DNA, 30 bp, Homo sapiens
  chr16:3142360-3142390
  hypo
cctgtgtcctgactccgaggggacatggga

SEQ ID NO: 78867 - DNA, 30 bp, Homo sapiens; identical to SEQ ID NO: 44561
  chr16:3142599-3142629
  hypo

SEQ ID NO: 78868 - DNA, 445 bp, Homo sapiens
  chr16:31446903-31447348
  hypo
cgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattccacccagggctgcagcacgctggttcttcagtgtcgggccaggttggacctccggctggaggccttccacaccggaaacactggtagggctcctctccagtgtgggttcgagggcggtggaggagctcggcactgtcgctgaagcctggccctggcctcgccgagcggtccggccgctctgtgctgcgaggccttccgggctggctcagggtagcctggggcctgaaccgcctcccgcgagtcccgtcccgc

SEQ ID NO: 78869 - DNA, 141 bp, Homo sapiens
  chr16:31483518-31483659
  hyper
ctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaac

SEQ ID NO: 78870 - DNA, 30 bp, Homo sapiens
  chr16:31496344-31496374
  hypo
gggacttcccaactgcggggtgtgactggg

SEQ ID NO: 78871 - DNA, 42 bp, Homo sapiens
  chr16:31498048-31498090
  hypo
aatcatcctctcctacgatgacgcagaaaaaactggggccgg

SEQ ID NO: 78872 - DNA, 261 bp, Homo sapiens
  chr16:31498557-31498818
  hyper
aaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcatgggttacggtaggggctcgcctaccagggaggggcgcggagggcatggtcgcggagctctcggcctgcgcgcggggccgttgcgcgtctccggtctgagggtcct

SEQ ID NO: 78873 - DNA, 182 bp, Homo sapiens
  chr16:31499022-31499204
  hyper
gcccgcgctgctcctcggactcacaatcgtctcgggctggtactggtgcagcgaccaggtgcgggtatagggctgcgcctgcagtgaggccggggcggagccgagacgggcggagcctgagtccctccccgccttccccacaacggtctaaggcgcagtctgaggggcgggaacccctcggg

SEQ ID NO: 78874 - DNA, 413 bp, Homo sapiens
  chr16:31499494-31499907
  hyper
gtaacatccctgccccgcccctttcctgtgccagcaaccgggcgcccgtcgcccagttccgtcaccctcctaagactcggcagtttgggcccggagtcccgcctccctccgggggtcgcacgcctcctctgctaggattcccagtccccacctcctgggattcccagaccaggccccgtcctaacggcgcggtggcctctctctggcagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggaccccca

SEQ ID NO: 78875 - DNA, 151 bp, Homo sapiens
  chr16:31500522-31500673
  hypo
gctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacgtgagtggccaggt

SEQ ID NO: 78876 - DNA, 144 bp, Homo sapiens
  chr16:3151042-3151186
  hypo
gaggtctgaggccaccgaggaagcctcagggactggcctccgtgtagagctgctctcactgccctgggcattggggacaaggccaggacaagcaggaccccgtgcgtgtttcctcgaatggcttatggtcgcttcagaaagaca

SEQ ID NO: 78877 - DNA, 41 bp, Homo sapiens
  chr16:31524056-31524097
  hypo
ttgagaccttcactacgacagttactactgactacttgaga

SEQ ID NO: 78878 - DNA, 40 bp, Homo sapiens
  chr16:31526376-31526416
  hypo
tagagatggggaggccgggtatggtggctcatgtctgtaa

SEQ ID NO: 78879 - DNA, 249 bp, Homo sapiens; identical to SEQ ID NO: 36126
  chr16:31540812-31541061
  hyper

SEQ ID NO: 78880 - DNA, 15 bp, Homo sapiens
  chr16:31549080-31549095
  hyper
ccgctcctccattgc

SEQ ID NO: 78881 - DNA, 30 bp, Homo sapiens
  chr16:31558059-31558089
  hypo
gagtttatgtttccacgcagggttctctca

SEQ ID NO: 78882 - DNA, 30 bp, Homo sapiens
  chr16:31560507-31560537
  hypo
ccaaagaaccctgtccgagtccaaaggcat

SEQ ID NO: 78883 - DNA, 259 bp, Homo sapiens; identical to SEQ ID NO: 4341
  chr16:31580480-31580739
  hyper

SEQ ID NO: 78884 - DNA, 22 bp, Homo sapiens
  chr16:3158301-3158323
  hypo
ccgcgcccggcctatagtcagt

SEQ ID NO: 78885 - DNA, 21 bp, Homo sapiens
  chr16:31658246-31658267
  hypo
aatggaaggactgggcgcggt

SEQ ID NO: 78886 - DNA, 60 bp, Homo sapiens
  chr16:3177923-3177983
  hypo
tcaagaagagattaacgtttgaattggctgagtgagtaaagcagacggccctcaccacgg

SEQ ID NO: 78887 - DNA, 197 bp, Homo sapiens
  chr16:318060-318257
  hypo
atcacacatgctatgcgtacacacacttgtgcctcagtgctacacatgcctcatacacacgacacgtgcacacacacaccacatatgcatgcctcagtacacctgcacacgtgcactacacacaatcacacacgctatacatacacaccacacgtgtgcctcagtgctacacatgcctcatacgcacacacacccat

SEQ ID NO: 78888 - DNA, 29 bp, Homo sapiens
  chr16:3183420-3183449
  hypo
aaaatatgaaaattccgccaggcacggtg

SEQ ID NO: 78889 - DNA, 38 bp, Homo sapiens; identical to SEQ ID NO: 44391
  chr16:319924-319962
  hypo

SEQ ID NO: 78890 - DNA, 275 bp, Homo sapiens
  chr16:3209099-3209374
  hyper
gcgccggggccgatccgacttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctttgagtgggt

SEQ ID NO: 78891 - DNA, 99 bp, Homo sapiens
  chr16:3211643-3211742
  hypo
gatggtcaggaccgccgggagcccatgcccacctccctcagctcccgtggtgcgcccgggggaaatgtggttggaaatcgcggcggccgggcatggtgg

SEQ ID NO: 78892 - DNA, 180 bp, Homo sapiens
  chr16:3211802-3211982
  hypo
gttcaagcccagcctggacaacgtagtgaaaccccacctctgcaaaacaattttaaaagttagcagggcgtggtggtgcgcgcctgtgatccaagctactcctgtgtctgaggcaggaggatcgcttgagcctgtctcaaataaacaaagggcggggcgcggtggctcactcctgtaatc

SEQ ID NO: 78893 - DNA, 150 bp, Homo sapiens
  chr16:32127040-32127190
  hyper
tttttgccccccaagcgccaaggctttttgaccaccgcggctttttgaccttcgcctctgcgaattttgccgccgtggctttttgcccgccgcggctttttcccccaactggtgcagcggctgtttgccccctgccgctttttgcccccc

SEQ ID NO: 78894 - DNA, 119 bp, Homo sapiens; identical to SEQ ID NO: 36035
  chr16:3220438-3220557
  hyper

SEQ ID NO: 78895 - DNA, 303 bp, Homo sapiens; identical to SEQ ID NO: 36036
  chr16:3220590-3220893
  hyper

SEQ ID NO: 78896 - DNA, 560 bp, Homo sapiens; identical to SEQ ID NO: 1248
  chr16:3221141-3221701
  hyper

SEQ ID NO: 78897 - DNA, 18 bp, Homo sapiens
  chr16:322126-322144
  hypo
gcccggcctaatatgtca

SEQ ID NO: 78898 - DNA, 453 bp, Homo sapiens; identical to SEQ ID NO: 36038
  chr16:3221786-3222239
  hyper

SEQ ID NO: 78899 - DNA, 254 bp, Homo sapiens
  chr16:3224942-3225196
  hyper
gaattcttcttcagccgaacagcagcggcaaaggctaagggtcctagaaaggaacgggaaaccgtcacctgcccaggtgggacgcgaggcaaggaacccagcgcaggaggccgctgggtcacggaggtttcctgtctgcttcccgccgtcactgccggccgcctcccaccttctcccggccccctgcaacccagcccaccccagcccacctccccctggtggggacacggttttctttccggggtgcctcgcag

SEQ ID NO: 78900 - DNA, 177 bp, Homo sapiens
  chr16:3225459-3225636
  hyper
acactcaggaggtgccggcctgtggggcgtccgcgggtgggcctctgacgcagagaaagacccagatccagctacctcgggggcctcctgctgcgcctcgcctttggggcaggcctgagggcaacgcttactgcggagcaactgtgttctacagtgtagtcccgacactgaagactc

SEQ ID NO: 78901 - DNA, 488 bp, Homo sapiens
  chr16:3232529-3233017
  hyper
taacttcgaaggactcgggctgcgctgacctgtcagagctgtctggatctctgatcttcatctaaagtaggaaagggtagaaaccgatattttggaccaaaaaccgggctcgtccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccgg

SEQ ID NO: 78902 - DNA, 133 bp, Homo sapiens; identical to SEQ ID NO: 1252
  chr16:3233198-3233331
  hyper

SEQ ID NO: 78903 - DNA, 670 bp, Homo sapiens; identical to SEQ ID NO: 1253
  chr16:3233434-3234104
  hyper

SEQ ID NO: 78904 - DNA, 271 bp, Homo sapiens
  chr16:3234181-3234452
  hyper
tcatacccctagaccaacgagccgccgcttcccctctgttttgttgttgttgttgttgttttttgacacgtccttccgcccctgacgcagagcgagactctctccatcgccccaatagctcagtccttagcgcgcgcacctgcgaatctgggcttttgggttcgcggccaccctcagatttgcgaggcaggctttactgctgctggataaaccaaccaggttatccgttgaggttatgagctggtggtttcaatgtcgtcctgatatgaaa

SEQ ID NO: 78905 - DNA, 181 bp, Homo sapiens
  chr16:323418-323599
  hypo
gcacgctgacccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacgccctgcacacagc

SEQ ID NO: 78906 - DNA, 335 bp, Homo sapiens
  chr16:3237708-3238043
  hyper
tggattatcatttgccgttttaaaaccttggataaaatctgtgtatttcctttatgatttctgacatctctatcctgcctggaaatccttttaccttagtaataggcaaatgcacctatatatcataccagcacgacattgaaaccaccagctcataacctcagcgggtaaccttgttggtttacccagcaggagtaaagcctgcctcggaaatctgagggtggccgcgaacccacaagtcaagattcgcaggtgcgcgcgctaaggactgagctattggggcgatggagagagtctcgctctgcgtcagggacggaaggacgtgtcccccacca

SEQ ID NO: 78907 - DNA, 1775 bp, Homo sapiens
  chr16:3238163-3239938
  hyper
ccccttttccttctcttttttcccatttcgcattttcagcaaggacaggagactaggaaggcggagggaggctgctattggcagggcctcagtggagacctcccggggtcccgggacgcagacggacgggcctgaatcgctcgccttggtgaaatgggatccagcgctgccaactgcggcaactgcggttaaaggagacgaccccgtgcagcaggaggaggttatttagaataaggaagaatgcgccgggctcattggtcgctacaggggcataaattttttctaggattccagagtatggctgctccagtcccaggtgagccctcctccgcttaaaattccagtttattcggagaaggggagaataccggaagcgggggagaagggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcacttgaggccaggcaggcgctgcggggctggttcagtcgatggagaaaagagactctcagcgtcagcctttagggttcgaggcccacgtgggaaactcgctttctgggttttggcttccctggggagaagggaggaccggagccggagaagcgtgaggtgcggcgaggtagggtgcctggtagctggtgtctcgtgcactccgtcaggcctttattgaacacccattggtgccacgctgagggactgcagcgtttccaaggcgagcttgcagtgatcgaggctcgcagaccctcagcgcagccgctgcctgctattgggaggttcccatgtcctgcggaagctggagctcctcactgcgcgcctcggagacgccgaatccccaactcaaggccgagtggcggtggcgggcgaggacccagggcccttctggattgtggtagcgccagggctgctccccattttgtgcgtcgcggaggaggggccggggctctgggcttccgccacacccatcctcacttgaaattgccccttccaggcgggtctgaaataagattctactcactgggtcctgctgggtccgccccagccgcccccaggatgctaggacgcccacaaagataaccttaatgcgtaaatcgtgtggctcgttggtctaggggtatgattctcgcttagggtgcgagaggtcccgggttcaaatcccggacgagcccggcttttggtgcagggtaaaagtcgtttcctgctcttttttagattcggctcgacttacagacctcagcgcaggacgtggacgccctgcaaaggtaatttgtacaaaggtctcaagctatgttgacgccgcctactatcccactacctcttcttaaaattcatctagagtcctgtcaccagtgttgccagagcccttttgacaagctattttttttgtcgtttgtttggtttt

SEQ ID NO: 78908 - DNA, 30 bp, Homo sapiens
  chr16:323853-323883
  hypo
tccagtgggtcaccccggcccctgccccca

SEQ ID NO: 78909 - DNA, 35 bp, Homo sapiens; identical to SEQ ID NO: 36049
  chr16:3241024-3241059
  hyper

SEQ ID NO: 78910 - DNA, 519 bp, Homo sapiens
  chr16:3241472-3241991
  hyper
ttactagacataaaacgttcccagggaagcccggctagctcagtcggtagagcatgggactcttaatctcagggtcgtgggttcgagccccacgttgggcgacttgttttcttccttgctaccttggagttctggaaacagccagcatttaatgaacactaccaggtgccacatcgcgctctgtgatggtatcccctcaatgattgaattttggtctccgcgcgctcccagcagcaaggattgtcagtgaaatgaccaaaggcagcaccgggacgggctggttgccagccaggggcagaggggcgggggcgggtgagaactgaggggccacaggatgggtgtgaggggtgcaggggcctctccccactttgtgcggtgcggagaggggccggggcgctggcccacccactgagtctgcaatcccagtctcctgtcactttgctttcgcaggcttgagctttatcgctccaagtactccacggctgccacaaagaaaagtaaagggcctgctgctgtggc

SEQ ID NO: 78911 - DNA, 57 bp, Homo sapiens
  chr16:324217-324274
  hypo
gtccagctctgcagccggcctcagggtacttgtccagaagtacggggtctggcgtgg

SEQ ID NO: 78912 - DNA, 179 bp, Homo sapiens
  chr16:32485443-32485622
  hypo
tgagggctgagggcccgggaaaggcacacggtggcggtggggtctctctcaggaaggcgctggctctgcagacagctccgcctggtgacccctctttggcactgagctgggaacatggtgtccgcactcccggctagcaagcagaggcccgtgtggtcaggtggcggctggcagtgtag

SEQ ID NO: 78913 - DNA, 48 bp, Homo sapiens
  chr16:325498-325546
  hyper
ctgggcggagggagtcgtcagggggtgtctggccgccccgcaaccctg

SEQ ID NO: 78914 - DNA, 31 bp, Homo sapiens
  chr16:3269398-3269429
  hypo
caggcgtgagccaccacgcctggctaacatt

SEQ ID NO: 78915 - DNA, 46 bp, Homo sapiens
  chr16:3286277-3286323
  hypo
ttcgttccccagtgacgcactgatcagggttcggacaacttgtggg

SEQ ID NO: 78916 - DNA, 285 bp, Homo sapiens
  chr16:330222-330507
  hyper
ggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggct

SEQ ID NO: 78917 - DNA, 57 bp, Homo sapiens
  chr16:330921-330978
  hyper
ggaagggaccaggtgcggacgggtcggcttgggaagcggcggcgctgggaccctctc

SEQ ID NO: 78918 - DNA, 153 bp, Homo sapiens
  chr16:332609-332762
  hypo
cctagtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgca

SEQ ID NO: 78919 - DNA, 20 bp, Homo sapiens
  chr16:33396766-33396786
  hypo
tatgagatggattttcgccc

SEQ ID NO: 78920 - DNA, 129 bp, Homo sapiens
  chr16:3355105-3355234
  hyper
tcttcctcgaggaggcggcgacgagcccagcaacagctcgagcacggccggccgggccgcgggaagcccgagaacgcggcgcgcgcagctgggaggcgacccttacccggcgaggctcccgggaccaaa

SEQ ID NO: 78921 - DNA, 646 bp, Homo sapiens
  chr16:3355250-3355896
  hyper
cgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcg

SEQ ID NO: 78922 - DNA, 30 bp, Homo sapiens
  chr16:33619032-33619062
  hypo
aggcaaactcgggagcgcaggagatgctca

SEQ ID NO: 78923 - DNA, 256 bp, Homo sapiens
  chr16:337560-337816
  hypo
atgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatcccagagggaaagtagatcccagcacacgtgcccaagggagg

SEQ ID NO: 78924 - DNA, 30 bp, Homo sapiens
  chr16:33784579-33784609
  hypo
ctgggggaggtggggcggggtggggggggc

SEQ ID NO: 78925 - DNA, 120 bp, Homo sapiens
  chr16:33893476-33893596
  hypo
attcgatgattcaattggatgtcattcgatgattccataagattccctttgatgatgattctattccgtcctttcaatgatgataccaatcgattccattcgatgattattccatccgat

SEQ ID NO: 78926 - DNA, 97 bp, Homo sapiens
  chr16:33897828-33897925
  hypo
tttcgatgattccatttgcttccatttagttccatttgaagattacattggatgccatttgatgattccataagattccattcgatgatgattctat

SEQ ID NO: 78927 - DNA, 162 bp, Homo sapiens
  chr16:34264932-34265094
  hypo
ggctggccctgccagcgtgcctttcctgggaagaggtggaagtgctgagctctgcagacttggaagcaagggaaggcccaagctgctggagaggagccgggctaccccatggggatagcccacgctgagctattgcttgggcaccaacgccagcctcaagcg

SEQ ID NO: 78928 - DNA, 83 bp, Homo sapiens
  chr16:34407744-34407827
  hypo
tccacacctgtattccgtttcccaccgagcacgtgaggaccaacgagcgctcgcccccgccgggcacccggcatgggggcctg

SEQ ID NO: 78929 - DNA, 30 bp, Homo sapiens
  chr16:34788530-34788560
  hypo
aatgagtgtaatgtgcgatagtattttttt

SEQ ID NO: 78930 - DNA, 86 bp, Homo sapiens
  chr16:3492682-3492768
  hypo
aaaaaaaagaacttttaaaagtagccagacactgtggtatgcgcgcctctcagatactcgagaggctgaggcgtaaggattccctg

SEQ ID NO: 78931 - DNA, 213 bp, Homo sapiens
  chr16:34983934-34984147
  hypo
atagcagcctgagaacgccacagcccggaagctaggcagggtcgagcctggctggggcctggatggaggaccgcctgaggagacccaggctgaaggcttttggcttcctgctcccttcccgcttttccccgctgatcacaatgcatgccaaccgcatcctgagtatttggcccccaatttcccgaccgactctgccctcgctgtgacccggga

SEQ ID NO: 78932 - DNA, 30 bp, Homo sapiens
  chr16:351930-351960
  hypo
gctgacgtcacagcccgtgggcccggatgt

SEQ ID NO: 78933 - DNA, 202 bp, Homo sapiens
  chr16:3551302-3551504
  hyper
ctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggcc

SEQ ID NO: 78934 - DNA, 30 bp, Homo sapiens
  chr16:356089-356119
  hypo
ttatcatccccttaccggcaggcacatgcg

SEQ ID NO: 78935 - DNA, 33 bp, Homo sapiens; identical to SEQ ID NO: 16015
  chr16:3598920-3598953
  hypo

SEQ ID NO: 78936 - DNA, 30 bp, Homo sapiens
  chr16:3611471-3611501
  hypo
agcggtgtctagtcccgccaggtcacctcc

SEQ ID NO: 78937 - DNA, 108 bp, Homo sapiens; identical to SEQ ID NO: 44568
  chr16:3696694-3696802
  hypo

SEQ ID NO: 78938 - DNA, 61 bp, Homo sapiens
  chr16:3740595-3740656
  hyper
cggacggcaaactcacgggtggccaccagagggggcaagacacacccgacactggcagaag

SEQ ID NO: 78939 - DNA, 118 bp, Homo sapiens
  chr16:3773018-3773136
  hypo
cacataaaatccatacgtccatgaggctgcgatgtcttcatggtctgagatgaagttattctcctgcctacatgcccctgcccgtctgttacggcgctgtgggcgcagcctctgcttc

SEQ ID NO: 78940 - DNA, 47 bp, Homo sapiens
  chr16:3803027-3803074
  hypo
atgagtgtcaggtagcgacggcagcacgaatgcggtttagtgctcaa

SEQ ID NO: 78941 - DNA, 30 bp, Homo sapiens; identical to SEQ ID NO: 44569
  chr16:3925449-3925479
  hypo

SEQ ID NO: 78942 - DNA, 78 bp, Homo sapiens
  chr16:3931903-3931981
  hypo
ccagagttaacatcccgaaaagagagggagaaaatctgtttaaaacaactccctggccaggcgcggtggcagatcacc

SEQ ID NO: 78943 - DNA, 17 bp, Homo sapiens
  chr16:3951115-3951132
  hypo
gttaaaaaaatttaccg

SEQ ID NO: 78944 - DNA, 37 bp, Homo sapiens; identical to SEQ ID NO: 16016
  chr16:3957870-3957907
  hypo

SEQ ID NO: 78945 - DNA, 161 bp, Homo sapiens
  chr16:3998590-3998751
  hypo
taattcccagaagggcgcatgttttttacattttgacagttcttgctaaatggccctttatagaggttacaccagttttaattcccatcagaatttatttccaaacctatcatgagatacgccagcactgacaagaatcctcactgcggcattgttcatcg

SEQ ID NO: 78946 - DNA, 519 bp, Homo sapiens
  chr16:410195-410714
  hypo
cccacctgtgccctccgccgcctccctctgcttggctgtcccaagatgtctctctccactgcctaggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 78947 - DNA, 611 bp, Homo sapiens
  chr16:410995-411606
  hypo
tttttttctttatatcgcttctgtttcttttttttttttctcctcgaaaaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagccactctgggaagcaggtccctgctcttggccactgtgtggctgggaggcagaagcgtgactctgggctgcagctcgggctcctgccgccgattggctgaggca

SEQ ID NO: 78948 - DNA, 309 bp, Homo sapiens; identical to SEQ ID NO: 44397
  chr16:412764-413073
  hypo

SEQ ID NO: 78949 - DNA, 30 bp, Homo sapiens
  chr16:4135781-4135811
  hypo
agggtggggcccagacgtctgtgttttgac

SEQ ID NO: 78950 - DNA, 36 bp, Homo sapiens
  chr16:4165816-4165852
  hyper
cgcctcctccagctgcggctccggagggaagttcag

SEQ ID NO: 78951 - DNA, 79 bp, Homo sapiens
  chr16:4203488-4203567
  hypo
aaaaaacagccaaatcgtggcattttcatgcagctcgacctagtagacatctagtggctgcaagcgcctgtgtgcagcg

SEQ ID NO: 78952 - DNA, 84 bp, Homo sapiens
  chr16:4203911-4203995
  hypo
agactccgtctcaaaaaaaaaaaaaaaaaaagaactgatcaatgagccgccagatgccgagcaccacaccggcaagggctgcgg

SEQ ID NO: 78953 - DNA, 165 bp, Homo sapiens
  chr16:4264529-4264694
  hypo
ccaccccccgccccacgttttggctctcattggctgtatattaagtgcagcagggagcaattcagaaaacagagttcatgccgcagagcaggcagcctgcccccttccttgttctagatcttgtctctgaacactcgtggaccgggcaaacgtgggccagcagcc

SEQ ID NO: 78954 - DNA, 143 bp, Homo sapiens
  chr16:428930-429073
  hypo
gctcatggccccaggcgaggactcaggctctcacccccagccccccgtgccagctccagcctcgtgcccttgcgaccttgggcatccttccctccctgggtcccagccttctcctgggtaggtcagggcggagggcacatccc

SEQ ID NO: 78955 - DNA, 40 bp, Homo sapiens
  chr16:4308064-4308104
  hypo
ctccccgtcccccgacggctcctcccggctctggtccatg

SEQ ID NO: 78956 - DNA, 160 bp, Homo sapiens; identical to SEQ ID NO: 36054
  chr16:4363920-4364080
  hyper

SEQ ID NO: 78957 - DNA, 532 bp, Homo sapiens
  chr16:4377893-4378425
  hyper
gacaaccccagccctcgccccaacccctgggcccttgcgtgtgggggcgctgccctgggcgcatcccaggctgagtgctcgagagacgcggccctgggctctgtgcaccctccacgctgcgctgtcccaccggggggaaactgaggaacggaaggctccaccaggaggcgcagaggggcgtggggccggcgggccttgcgctgcgcccggggagcatccacggggtgcccccacctgaccgagagccggctcctgccctcgggaccccgcagtaattagcacccaggcctctggctgagcttgtccagagccaggctgtcggccttacgctggggagagccacggccacccgctcatgggcactcactcagggttccctggttgcaggcccgctgctccccgctctgggcctccgaggctttcaggagagcaggaacctagctctcgcctgcccccttcacccagccgggaacaaaagcacagagcagagcccagaactggctgctgccggtcggggcgggggtggaagggg

SEQ ID NO: 78958 - DNA, 112 bp, Homo sapiens
  chr16:4385316-4385428
  hypo
agccacaccgctgtccgacctgcagcaagagcttctcccgcctggagaacctgaagatccacaaccggtcgcacacaggtaagaggccggggccgggcggcttggcccatga

SEQ ID NO: 78959 - DNA, 184 bp, Homo sapiens
  chr16:4395357-4395541
  hypo
taacagcaggtgcctcggaggcagatcggaaacccaaggctggtgctatctgtcacagcagtcactacgcagggtcccggggtctgaaggtagggcacctgggcaagccgacaagtatcaagaacccaaccccgaggccagaggggcttgctccagattccagtggattcgactccagagctgg

SEQ ID NO: 78960 - DNA, 28 bp, Homo sapiens
  chr16:4402011-4402039
  hypo
tggattcacaggttccggacatttcata

SEQ ID NO: 78961 - DNA, 23 bp, Homo sapiens
  chr16:440317-440340
  hypo
aatggggtccagggccgagggct

SEQ ID NO: 78962 - DNA, 66 bp, Homo sapiens; identical to SEQ ID NO: 44575
  chr16:4410920-4410986
  hypo

SEQ ID NO: 78963 - DNA, 131 bp, Homo sapiens
  chr16:4422122-4422253
  hyper
cacggtcacctgggccgcccggcgggcaggccctgtacgctccctcccccgccgtcctggggcgccgacagccccgcggccggccagggtgcgcgcctgagtgtgcggtgagcccgcgaggctgcaagcag

SEQ ID NO: 78964 - DNA, 53 bp, Homo sapiens
  chr16:4431066-4431119
  hypo
catcaccatgctcgacgcaggcagctttgccggcctgccgggcctgcagctcc

SEQ ID NO: 78965 - DNA, 30 bp, Homo sapiens
  chr16:4442476-4442506
  hypo
cctgctcaaagctcacgcctgaggcagggc

SEQ ID NO: 78966 - DNA, 98 bp, Homo sapiens
  chr16:4443075-4443173
  hypo
gctggaaagagggggcggaggaggggagaataggaagaatcacgtgggcccagtgagctggctcagagccatgcccggtaggtcgggggcagaagcat

SEQ ID NO: 78967 - DNA, 30 bp, Homo sapiens; identical to SEQ ID NO: 44576
  chr16:4474675-4474705
  hypo

SEQ ID NO: 78968 - DNA, 186 bp, Homo sapiens; identical to SEQ ID NO: 36056
  chr16:4587903-4588089
  hyper

SEQ ID NO: 78969 - DNA, 515 bp, Homo sapiens
  chr16:4588308-4588823
  hyper
cgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgt

SEQ ID NO: 78970 - DNA, 33 bp, Homo sapiens
  chr16:4644769-4644802
  hypo
ggctcagcccttggccgtcgcaaaggagctggc

SEQ ID NO: 78971 - DNA, 30 bp, Homo sapiens
  chr16:4645003-4645033
  hypo
aggatctgctgttcccgagatcaacagctg

SEQ ID NO: 78972 - DNA, 30 bp, Homo sapiens; identical to SEQ ID NO: 44577
  chr16:4655417-4655447
  hypo

SEQ ID NO: 78973 - DNA, 115 bp, Homo sapiens
  chr16:4665621-4665736
  hypo
taagtgcctactgtgcgcagctgtccagaccgtgaccagagccaggcacgtccatgtcgccctcattgctctcggtggcacccgtgcccctgctctggcacgaattggggtccca

SEQ ID NO: 78974 - DNA, 116 bp, Homo sapiens
  chr16:46721647-46721763
  hypo
aagggccaaaggggccgccaacacttgctttcggatgcaaaagtgcgacaccaagaagactaagcgagctgcctaaattatagacagtgactgtgaaagaacgaatactcaagttt

SEQ ID NO: 78975 - DNA, 30 bp, Homo sapiens
  chr16:46763064-46763094
  hypo
agaaggatttccaagcgaatgagtcaagaa

SEQ ID NO: 78976 - DNA, 30 bp, Homo sapiens
  chr16:46785401-46785431
  hypo
ctaagaaggtggctgcggctggaagctccc

SEQ ID NO: 78977 - DNA, 44 bp, Homo sapiens
  chr16:46803052-46803096
  hypo
caattaagtattggtcgggcggtggctaacgcctgtaatcccag

SEQ ID NO: 78978 - DNA, 30 bp, Homo sapiens
  chr16:468101-468131
  hypo
agtcacctgtgatgtcgtgtgtgtcagtag

SEQ ID NO: 78979 - DNA, 85 bp, Homo sapiens
  chr16:47053768-47053853
  hypo
gaatgacaagagctgcggaaggagccttggaaaatcagaatgcattccaggcactaaatgcagaggaaatgcctccaagggtatt

SEQ ID NO: 78980 - DNA, 987 bp, Homo sapiens
  chr16:47176772-47177759
  hyper
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgttcccgagctgcccggcgcttcgcgaagggctgaggtagcggcggcggtggctcggcgctcacggctcggcgcggcggcgacggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccc

SEQ ID NO: 78981 - DNA, 626 bp, Homo sapiens
  chr16:47177819-47178445
  hyper
gctccgcccgcggccccggcgcgggatccactgaagtggcgggcgcggggcgcccaggctcatttaaggagggagcgcgagcgccgcgtgccggctgcgccgcctgtgcgcatgtgcccgccccgccccgccccgcgccgcgcctcgcgcgcccgccgcggcctcgcgccgtgggacggcgtcgctccccgccggctgccgttagggctgggagccggctgggcgcgggggtagtgagggtgcctctcgccgtggctgcgcggcggcctcgtccgagaggccggcgccggggcagtgaccggcccgtgcccagccgccgcgcagggcgcccggggcagctggccgagccctcgatgcctcccgtctgacggaggcgcccgggaagcgccgcccacctcggccccgcaccctcgccggcctgccgggtctccgccagccctagcagacagagaggggcgccggtccctagtcccccagacctccattcaaggtcaaaactttgcccagctcagccttgctcgaccctgggcagggaagcgcggacatcggcagagggagcccgaggctctccgtgcccttcgcgccggtgagttcccgacccgcggcgctgccggcgtttccctagc

SEQ ID NO: 78982 - DNA, 137 bp, Homo sapiens
  chr16:4723596-4723733
  hypo
ctgtacctcctgcgccgacacgctgcgctaccaggccaacaactgccccatctgccggctgcgtgagttccccggccggctgttctgtggaaggttctggaaattagggactggccacaccacggtggtcctgggat

SEQ ID NO: 78983 - DNA, 43 bp, Homo sapiens
  chr16:4840446-4840489
  hypo
cttctggggaactcccgctccttcctggaggcttaaccttaaa

SEQ ID NO: 78984 - DNA, 84 bp, Homo sapiens; identical to SEQ ID NO: 44579
  chr16:4841600-4841684
  hypo

SEQ ID NO: 78985 - DNA, 91 bp, Homo sapiens
  chr16:4844989-4845080
  hypo
ggtgctggaaccaatcgttgaggattccaaggacaactctatgatgcaggcacacctgtcctagctgctcaagggtcgtgggatgcaggta

SEQ ID NO: 78986 - DNA, 284 bp, Homo sapiens
  chr16:4846136-4846420
  hypo
ccccctagggaacaacgagcgaacctgcttggtcccgctgtgcttctcgtgcaggaaagacccaagggagtggataacttggccctggaaccctgaccctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctggg

SEQ ID NO: 78987 - DNA, 104 bp, Homo sapiens
  chr16:4846720-4846824
  hypo
aaaaaaaaaaaagactcggtggcccaaagtcccaggtagagctcttgtcgccaccccatgggcttcttggcagcccgagggtcccctctcgacagtaggttctg

SEQ ID NO: 78988 - DNA, 120 bp, Homo sapiens
  chr16:48642018-48642138
  hypo
taggtaaataaacatacatcctttctttctgacattctccgagcgttttattactattaatggtttttttccgattctcaagaacacggttttcaccgtgtgacacaggacagtctcaat

SEQ ID NO: 78989 - DNA, 96 bp, Homo sapiens
  chr16:48644969-48645065
  hypo
ctcaaaaaaaaaaaaaaagataaattcaggagagtgatttcttctgtgagggaagaaaggggatatgttatgggagaagcccgaaaagtgggagtt

SEQ ID NO: 78990 - DNA, 54 bp, Homo sapiens
  chr16:48845119-48845173
  hyper
cggggctctgccctcaccctggcatcgtcctgccgggcccgggtgatgctggcc

SEQ ID NO: 78991 - DNA, 30 bp, Homo sapiens
  chr16:4900604-4900634
  hypo
gatggtcttttgcagcgccagcctgttaca

SEQ ID NO: 78992 - DNA, 55 bp, Homo sapiens
  chr16:4920234-4920289
  hypo
ctgagcagtcaggtccgctctggggtgtatgcctatcttgcgtcattcctgccct

SEQ ID NO: 78993 - DNA, 37 bp, Homo sapiens
  chr16:4920489-4920526
  hypo
ccttgaattgtgtcccgctcttcgcaggggggccgtc

SEQ ID NO: 78994 - DNA, 487 bp, Homo sapiens
  chr16:49309010-49309497
  hyper
cccacaccttccctccgcgccgcactatcccccaccaccacctcattaaggcaacaattaaggagaggggtgaggctccctctccatctgggtaattgtgttctcattaagagcggatgcgcccgggctctgagcattagcgctccagtgcagcttggaaggcatgctcccagctcggctaatggtggaagcggcggccgggcagcaagcgagctggggggcaggcgcggggcccagcgcaacccagcgctgctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaacagcctctgccctgggagaactgacggggtgtggggagg

SEQ ID NO: 78995 - DNA, 927 bp, Homo sapiens
  chr16:49311063-49311990
  hyper
cagggagcgccaaagcgtacaggggcagcttccttgagcggtggctctccaaccttcgcggccctacagcctcaagcttacacgcaccctactgactatagggtctccacaagcccggagggctggccctgcaacggcagagctgctgggtggagctagtttcgctgccaaaggctccaactgtctccgacctctccttcccaaccaggagacttcggagaaagcgcgtctctttattaaaagcagtttttctttaaatccctttaaggccccttatttcttctcattcacacttccctggggcctaacagagtagaagggaaactgttgggcagaaacagaaaagtactcgggtccactcctcactcgcgaagtccctatctatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagagg

SEQ ID NO: 78996 - DNA, 545 bp, Homo sapiens
  chr16:49312032-49312577
  hyper
cgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagctccttggcgtttcgtggagtcacagagcacgacggcattgacaagca

SEQ ID NO: 78997 - DNA, 1668 bp, Homo sapiens
  chr16:49313154-49314822
  hyper
ttgtcccacagctggcgcgcacctttttacccagatacagttagagaacatgtaggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgagg

SEQ ID NO: 78998 - DNA, 1357 bp, Homo sapiens
  chr16:49314959-49316316
  hyper
cgagacgggaacgaaggggagtgggcaggaatcggtcccggactgtcgtccccgcgcctccgcagagcccttggagaggaccgggcatcggtcttccatccatccctccttcaccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcaggg

SEQ ID NO: 78999 - DNA, 30 bp, Homo sapiens
  chr16:4931529-4931559
  hypo
acacctgtgggaaaacggaccgctcttggc

SEQ ID NO: 79000 - DNA, 203 bp, Homo sapiens
  chr16:49316508-49316711
  hyper
gactgctctgccggccgcggaggtcggatcgagcggtcattcattcatttgttaattcgttcacttattcaggggagatcattgaacccctacggagtaccgggtactgggccgggcgctgaggacgcggggctgagcaaaagcagccgaggcccaccttcgtgccccttaaaacccagcgtgcggggcggcaacgagtactg

SEQ ID NO: 79001 - DNA, 182 bp, Homo sapiens
  chr16:49317053-49317235
  hyper
aggctggtagtagggcggcgggagggcggggggacctgtcagtcaagtccaaagcagaaacgcggcgccggatcccagtcagaggccggctggaacgcttcccacaggctcctggcgctccggtccccaccaggcgaccttgatcctggcgtgctcagcggagccagcgcagcgtcgggagc

SEQ ID NO: 79002 - DNA, 48 bp, Homo sapiens
  chr16:49317700-49317748
  hyper
gactggcagctctggcggcgcgctggaggggaccgggaggggcaccct

SEQ ID NO: 79003 - DNA, 30 bp, Homo sapiens
  chr16:4932123-4932153
  hypo
aggcagacctacaggcgaggccgcagcaga

SEQ ID NO: 79004 - DNA, 30 bp, Homo sapiens
  chr16:49434635-49434665
  hypo
ccctcccctaccccacgccagcccacccta

SEQ ID NO: 79005 - DNA, 30 bp, Homo sapiens
  chr16:49464835-49464865
  hypo
attacacctggatgtcgcagtgagctgtga

SEQ ID NO: 79006 - DNA, 30 bp, Homo sapiens; identical to SEQ ID NO: 44691
  chr16:49500178-49500208
  hypo

SEQ ID NO: 79007 - DNA, 30 bp, Homo sapiens
  chr16:49508868-49508898
  hypo
tgcctacactgagcacgctggattattcaa

SEQ ID NO: 79008 - DNA, 184 bp, Homo sapiens
  chr16:49532989-49533173
  hypo
ccccacccagcaagccgaggtttgcctcatttacgcagatggcagggcaaggtttgcccgagtgggtgtgacacccaaccctggcctcagagtgaagctggtggcccactggccttggacaaagccctgagatgtcctatggcagagggagcagcagctcttccatgcacgggatgtgcgtgag

SEQ ID NO: 79009 - DNA, 161 bp, Homo sapiens; identical to SEQ ID NO: 44693
  chr16:49545215-49545376
  hypo

SEQ ID NO: 79010 - DNA, 52 bp, Homo sapiens
  chr16:49577715-49577767
  hypo
ggagtcatatgaccccggtcacagcgaccgccactcacgggctggctgacct

SEQ ID NO: 79011 - DNA, 30 bp, Homo sapiens
  chr16:49593939-49593969
  hypo
ctgagagcagggtaccgagtagaacatatg

SEQ ID NO: 79012 - DNA, 90 bp, Homo sapiens; identical to SEQ ID NO: 44694
  chr16:49623675-49623765
  hypo

SEQ ID NO: 79013 - DNA, 43 bp, Homo sapiens
  chr16:49634728-49634771
  hypo
tgactaccacattgccgaaataaatcaccgtcgctcaggaggg

SEQ ID NO: 79014 - DNA, 44 bp, Homo sapiens
  chr16:49638054-49638098
  hypo
tcaccatcagcaccccgctggcgggcacccgggcccctcaccac

SEQ ID NO: 79015 - DNA, 30 bp, Homo sapiens
  chr16:49671197-49671227
  hypo
gctgagagccgctgccgcttcggggaagac

SEQ ID NO: 79016 - DNA, 97 bp, Homo sapiens
  chr16:49671872-49671969
  hypo
atcttcttctgcccccgcagcggcttcaaggtggagtccggggtggagccacgctccacagaggcgctggagtcgggtgtggcgctgctcatggagg

SEQ ID NO: 79017 - DNA, 20 bp, Homo sapiens
  chr16:49736772-49736792
  hypo
tgtgtgctggaggagcgagt

SEQ ID NO: 79018 - DNA, 140 bp, Homo sapiens
  chr16:49736852-49736992
  hypo
cacacacactccatggcaggataaagcaccatatgctcatgttcataaaattttaaaggtaaaagcagatgtaatttgataaatgtgtacatgtgttgatacgaacacatgcaccaacacaggcgcgcaggcatgcacac

SEQ ID NO: 79019 - DNA, 30 bp, Homo sapiens
  chr16:49893240-49893270
  hyper
cgtatgtccgtttcccgacgctccgccctc

SEQ ID NO: 79020 - DNA, 27 bp, Homo sapiens
  chr16:50070326-50070353
  hypo
ggcataagccaccgtgcctggcctctt

SEQ ID NO: 79021 - DNA, 69 bp, Homo sapiens
  chr16:5007727-5007796
  hyper
cgtgtggctcaccggcggctctccagcgcctggacagggctgacccccagcaggcgctctgtgaaggtg

SEQ ID NO: 79022 - DNA, 37 bp, Homo sapiens
  chr16:501346-501383
  hypo
acctcaccctccccacgcttcccgtatcagggagctt

SEQ ID NO: 79023 - DNA, 17 bp, Homo sapiens
  chr16:50292023-50292040
  hypo
aacctccaagctactcg

SEQ ID NO: 79024 - DNA, 37 bp, Homo sapiens
  chr16:50292820-50292857
  hypo
tttagttacagtaaaaaccttccgtattcaccctgtt

SEQ ID NO: 79025 - DNA, 51 bp, Homo sapiens
  chr16:50335767-50335818
  hypo
tttcactctggtcctcgctatgccttggggctggcccgactgccagaccct

SEQ ID NO: 79026 - DNA, 30 bp, Homo sapiens; identical to SEQ ID NO: 44700
  chr16:50336356-50336386
  hypo

SEQ ID NO: 79027 - DNA, 152 bp, Homo sapiens; identical to SEQ ID NO: 44701
  chr16:50336625-50336777
  hypo

SEQ ID NO: 79028 - DNA, 667 bp, Homo sapiens
  chr16:5037514-5038181
  hyper
ctgccccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggctgggctggggagtagcgggaactgggcggggttcgcggggccagggccggagctgggtggtgaagatgggttggcggcagggcggaagtcgggggttggtgtcctgggtccgggctgggtgggcggtggcgcaagggacctgggactcagggcagggggtgactggggcaggcccgccggactcgctctccattcctgtgtgctccacgccgcccacccacctccgcctccccgccccttcccttgcagatcgcaggtgttgagcacgtggtcttcgtgca

SEQ ID NO: 79029 - DNA, 237 bp, Homo sapiens
  chr16:50501876-50502113
  hyper
cgcccctacccccagcggcgcgagctctaacgcagagcagatggcgggggcgggagcccgggcgggcggggctctgcgcctaggcggctgcagccgggcctgattaggtccccctcccgctggcggccgctggcgctttgaagtgagccgctgcccggcggctccggccgcctggccgtccctgccgccaggccgtcggacccaggctggcggcggggctggcggcgcgtgttgatc

SEQ ID NO: 79030 - DNA, 24 bp, Homo sapiens
  chr16:505034-505058
  hypo
gcgaaactccgtctcaaaaaaaaa

SEQ ID NO: 79031 - DNA, 66 bp, Homo sapiens
  chr16:50581600-50581666
  hyper
gcggttacccccttccgggccgcgcagtttggcagcgcgccccgacccgggcgggcacccacgggc

SEQ ID NO: 79032 - DNA, 53 bp, Homo sapiens
  chr16:50667548-50667601
  hypo
ggccctgtcctggggcgggagcacctgcgggagctgcccgccttggtggtgta

SEQ ID NO: 79033 - DNA, 184 bp, Homo sapiens
  chr16:50699260-50699444
  hyper
accccaagtggaggtcgcccggggaccccccatcaaaacacttgctggggagaggttatagaggcagcaaagctctttccagcatgatttcaaatcccgtctaagggctttcagaagcctggagaaagtttcggtttcccagctgtttcagctttttccgcccgcaccgcggcgatgcgttcgg

SEQ ID NO: 79034 - DNA, 188 bp, Homo sapiens
  chr16:50753089-50753277
  hypo
tggagacctgaaaggcgagttctcctagctgccacaccccttctccaaggatacaataatatctgccttataggattgttgtgagctgagtggcttgacgttccttgaaagaatgaaagcgtatagttatcccaggaagcctagggttgcaggtgagagctctggggcttctccgaagctctccgagg

SEQ ID NO: 79035 - DNA, 195 bp, Homo sapiens
  chr16:50753681-50753876
  hypo
aactagacctagcagcgagggcacctgatgtggctgctgcctcccgggcaggtcttcaatgctttcttcctgtgtttccctggccagggcacagacggccctccttttctgcctgccgctgtgttctctcagcctcctctgtcttcccttccaggctggggaataactacatcactgccgcgggagcccaagtgc

SEQ ID NO: 79036 - DNA, 91 bp, Homo sapiens
  chr16:5090543-5090634
  hypo
aggaaaaactttaagaacatgatgacttaatggaattacttgtttacagtaggattttataccttgagccgggagccggaaggaatgcact

SEQ ID NO: 79037 - DNA, 30 bp, Homo sapiens
  chr16:5094354-5094384
  hypo
gctgcttggtggtggcggtgtggatgggtg

SEQ ID NO: 79038 - DNA, 197 bp, Homo sapiens
  chr16:50958551-50958748
  hypo
cacttttcaaccaaccggcccactacaaaatccttaaaaccccaactccaaactcctccagagatggatctgaggtttcctctcatctcactcggtgaccctatgactaaatctctttctctgctgcaacccggtgtttcagtatattgatttgctgtgtacatcacgcaacaaagctgttccggttacagttctac

SEQ ID NO: 79039 - DNA, 170 bp, Homo sapiens
  chr16:5105315-5105485
  hypo
agaagtcggagaagccgcccattccacagaacatgactggaagtaaagacgggggccctctgcaggcctgccccccaggcccacctcctcccactccccagggctgccacggtgccacctgccttcatctgcctgggttaggcttaggaggtgggcgttcaatgcagagg

SEQ ID NO: 79040 - DNA, 30 bp, Homo sapiens
  chr16:511064-511094
  hypo
tggtttcatagaagacgcctttccacagac

SEQ ID NO: 79041 - DNA, 72 bp, Homo sapiens
  chr16:511477-511549
  hypo
cacagccatcagaaacggaggtcagtcatccccgccatgagctcccacctcctctcccgttcctcagccacc

SEQ ID NO: 79042 - DNA, 30 bp, Homo sapiens
  chr16:5115288-5115318
  hypo
agtggggtgggaacccgatcttgagggtcc

SEQ ID NO: 79043 - DNA, 72 bp, Homo sapiens
  chr16:5115525-5115597
  hypo
tagctgggccacagccgccaggaagatccagcccctggcctcctctctccttatagccgaggcaggctatac

SEQ ID NO: 79044 - DNA, 123 bp, Homo sapiens
  chr16:51167687-51167810
  hyper
ttaattcagtgaattcggttctcggtgatttcaataccaccacgaggcacctctagtgaggcgtagcggggcaagggtcggggagtaggtgaggagggggtgcgcgcccgtcagctgccttca

SEQ ID NO: 79045 - DNA, 468 bp, Homo sapiens
  chr16:51183963-51184431
  hyper
cgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccc

SEQ ID NO: 79046 - DNA, 281 bp, Homo sapiens
  chr16:51184677-51184958
  hyper
gagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaat

SEQ ID NO: 79047 - DNA, 238 bp, Homo sapiens; identical to SEQ ID NO: 4350
  chr16:51185054-51185292
  hyper

SEQ ID NO: 79048 - DNA, 423 bp, Homo sapiens; identical to SEQ ID NO: 4351
  chr16:51185542-51185965
  hyper

SEQ ID NO: 79049 - DNA, 304 bp, Homo sapiens; identical to SEQ ID NO: 36147
  chr16:51186025-51186329
  hyper

SEQ ID NO: 79050 - DNA, 955 bp, Homo sapiens
  chr16:51186595-51187550
  hyper
gggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 79051 - DNA, 25 bp, Homo sapiens
  chr16:51189183-51189208
  hyper
cccagctcaaggccccgctggcccc

SEQ ID NO: 79052 - DNA, 92 bp, Homo sapiens
  chr16:51189282-51189374
  hyper
cggcgccccgggggcgggggacgaggcacatcgatggtatcaacattattgatggggaaaagttcggggcaggagcccggagatcaggttcc

SEQ ID NO: 79053 - DNA, 116 bp, Homo sapiens
  chr16:51189922-51190038
  hyper
ttttgggggaactcccgccgcccgccaccaagggctatctccagacgggcgccgggtgcagcgccgtgaccgggcgccctggcgccggctcgggcgcgaaattcagcggtggcaag

SEQ ID NO: 79054 - DNA, 130 bp, Homo sapiens
  chr16:51190121-51190251
  hyper
cgcttggagggctgttcctacaccggtattaagaaaccgacttcgctagcgactgcaagtgcttgcgattttgactttccgtccacagttgagcgtcttgcacttaaattcactgcgccccgcatgcaac

SEQ ID NO: 79055 - DNA, 22 bp, Homo sapiens
  chr16:5130483-5130505
  hypo
ggtgtgggaagaggccgggtct

SEQ ID NO: 79056 - DNA, 22 bp, Homo sapiens
  chr16:5130565-5130587
  hypo
tggaacccgcgccatatgctct

SEQ ID NO: 79057 - DNA, 95 bp, Homo sapiens
  chr16:5164973-5165068
  hypo
catgttgaaagaatgcgtgaatctcatctccttttgtgggtgattcctgattaactttctttcttttttcaaaatggagccgtgatctgtcaccc

SEQ ID NO: 79058 - DNA, 21 bp, Homo sapiens
  chr16:5215934-5215955
  hypo
agcaagtatgaaaagcgttct

SEQ ID NO: 79059 - DNA, 42 bp, Homo sapiens
  chr16:5257258-5257300
  hypo
cacgactgatctgaacggggtgcacttcgacccggaagttta

SEQ ID NO: 79060 - DNA, 309 bp, Homo sapiens
  chr16:52580711-52581020
  hyper
atccaccgtcgagggcgcccgggggtggcgcgtgggactcgcggccggaggggcgccgggacccagagcccgaggagctcgggagccgcggccgccgcacacaaaggcgcggccacgcgagccgcgggagagcgggaggcggccggggggacgcgccccgccggggcaccgaggcagcgctgcgcgcgggccgggcgccgggggcgcggggcgcggcgctggggcccgggtcggcgaggcgagttcaggtgcgctgggcgaggctgggacggcggcggcggcggcggctggccccgctcctcctcctcc

SEQ ID NO: 79061 - DNA, 145 bp, Homo sapiens
  chr16:52581360-52581505
  hyper
cggacgccagccctgcgtcccgtgtgtcccaccctcctcctgcgcgaccacagcttccccgggccccagcatccccaagccgtctgctcccttcctgtcgctttcctccccatgacccccttccttcttcatgggtgcctgtccc

SEQ ID NO: 79062 - DNA, 80 bp, Homo sapiens
  chr16:53448471-53448551
  hypo
tcaccgggcctggcccgaaaccgggtctcttaagggaaaaacaaaaaccacaaagattagccgggcgtggtgggccgcac

SEQ ID NO: 79063 - DNA, 200 bp, Homo sapiens; identical to SEQ ID NO: 44704
  chr16:53563454-53563654
  hypo

SEQ ID NO: 79064 - DNA, 25 bp, Homo sapiens
  chr16:5412643-5412668
  hypo
tgagccaccgcgccaggccacatca

SEQ ID NO: 79065 - DNA, 94 bp, Homo sapiens
  chr16:54317132-54317226
  hyper
aattcttcaaacaaccgaggggagaaaaaacccaaaaaacaaaaaaccaccaaacagatccgtcgagggggcagacaggcgggttatagtcaaa

SEQ ID NO: 79066 - DNA, 30 bp, Homo sapiens
  chr16:54317821-54317851
  hyper
cgaggcgtcaggacccgaggtctggggctg

SEQ ID NO: 79067 - DNA, 84 bp, Homo sapiens
  chr16:54318505-54318589
  hyper
gcccagcagggagagcgggtgcaggcgggggccgggcggtgggcctggaaacggccggttggtccaagccgggaacttgcccag

SEQ ID NO: 79068 - DNA, 129 bp, Homo sapiens
  chr16:54318621-54318750
  hyper
cggcggcggccggagagagctgcagggcggaaggcgcgaccgctgcccccggtggagacccccccgcgccgggaggcgagcggcgcgggttgtccgggcttgtggcagtctccgcgagggaccagatct

SEQ ID NO: 79069 - DNA, 98 bp, Homo sapiens
  chr16:54318955-54319053
  hyper
gtcgccatccctgcgcgccgccccagccagggacagctcaggctcggtggccgcgccgtctaagttctccaaatcgatctcctcgtcctcgtcgtcgt

SEQ ID NO: 79070 - DNA, 295 bp, Homo sapiens
  chr16:54319354-54319649
  hyper
gagccaggccttcagcgtgctggtgctctccctggtggcgttcttgggacgggacgggtccccgaactggtactggccatacgggtagaaggcggggtgcgggtgcggaaacgcggcagccgcggccggatgctgcaccccggggctgtccttcagctcatactgcgcgccctgtacgcacatggagaaggaagggacacgcgcggagggagcgcgagtgagccccagccatcgctgcctcccccctcctggcctgcacccctctagtccggcccccgcgcgctcagctcgccct

SEQ ID NO: 79071 - DNA, 341 bp, Homo sapiens
  chr16:54320739-54321080
  hyper
aaatctcgggtctgacgtcgcgccctcttattcgacttttccccgcgtctcttccccgagtcgccaatcgcctgggcgccttacgggcgaggccgcccacccccgcggatcccgcgcgcggggcggggcggggcaggggcgggagccggagcgccgcgagtccctgcccgccccctcctgctcgcgccgggcgggggagcgagaggcgcggggactgggtgagtgcagggtcagctcgcccctcccgcctcccgcccctccgagcctgtccccaggctgaggcgcgggacctgggccgaggctggctccgggagctcccctgtgcccgggccccttttaca

SEQ ID NO: 79072 - DNA, 533 bp, Homo sapiens
  chr16:54321286-54321819
  hyper
ccttactaaaaatggcgggctggctccgggggctgaagggtggcagcccgggggcactggaagggtagggagccgccacaaatcggtgaagcaggcccgcgccccaggcggctgggaatgggggaggagcagggcgccgggggacggaggccctaggaacttttggagagctcttcgagaagtttctgtattggcgtttttgtctgtggagaaccttccttgcgcgacccctaccccttctcccggtcccggcgctaacctcttttctctctgcaaggatcctcccaccgcctccggtggggatggaaagcaagagttttggtttaatgatgggatatttcctaaatcaaacttgaaatctcaggatcgggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgc

SEQ ID NO: 79073 - DNA, 53 bp, Homo sapiens
  chr16:54322754-54322807
  hyper
ttagggactcagtcacgccggcgggtggggggggggggcgcccacagcccagg

SEQ ID NO: 79074 - DNA, 33 bp, Homo sapiens; identical to SEQ ID NO: 36160
  chr16:54325062-54325095
  hyper

SEQ ID NO: 79075 - DNA, 150 bp, Homo sapiens
  chr16:5439193-5439343
  hypo
aaataaataaataaataaataaaggtaaggtatgatttttgtgaaaatttcaaagaatgaaggacacaaagaagaaagtggaaatcctcgttctcagcttctcttcctccaatcttacctgcataacaggcttttcgaccttggctctat

SEQ ID NO: 79076 - DNA, 342 bp, Homo sapiens
  chr16:54628674-54629016
  hyper
tcccgggatagtctacggggagcagagttaatcgaataaactaatcttcgctgtggagattaactctcagtagctgcaggaaaccgggcaagggagaatgcaaatagcagagacctcaaggtgctggaggagttaggaatctcccctccctcactctaacgctgccgccgccgcaccccgccacctccccccctccccacccccgccgcccacccgccctcaggttttaaatttggaagatattgtggaaatggacaaactcgcctttgcctgctgaccagagcccagccccaggcatgaaactgagaaagtgagcagttgcaaggacgtgacgctttcttg

SEQ ID NO: 79077 - DNA, 285 bp, Homo sapiens
  chr16:54962651-54962936
  hyper
ccagagggcctggcccgggcgggggctcacctctcctccgccgcgcgggcgcgcgggccgcggacgctccctcgtggctggcgcgagcccccggcgggcggcgcgcgcgggccgttaccgaccgttagcgccaggggctgcggctgcggcgggcggagccgggggcgggcgctgaggggccgtggggccgcaagaggcgggagcgaggggagcagggcggggacgctgctcccaggagctcccggcgacgactcgggcctactgcgagcccgggaagaggccgcc

SEQ ID NO: 79078 - DNA, 446 bp, Homo sapiens
  chr16:54963430-54963876
  hyper
tatatagttatgcttcggcttgcgtgtggccccattatgcgaagttcccgatatcccgagcttccgcggcgtgcccaaacctgtgccatcttctgtcctggttcaccagcgcccctgtctgtcccagagttcgagtgcgtccgtggcttgtggtggcgggaggtggagagaagaggagagggtctgttttgtattctaactgtgtggccgtcgtgggcaagggctctgcctctgactcagttgtgtgtgtttgcttcgccagcgcctcgctgaacaaacagtggttgggttgggcactgctctgcccagtgtttgcagtggagcgtgggcggatgcgagagtgcgtgcgaaggggaaggcgacttagttaaacaaaagggaaggggacccgcaccctccaccaccaccgacttggcggtgcgagctgcgtgcggtgggaaaaccgg

SEQ ID NO: 79079 - DNA, 44 bp, Homo sapiens; identical to SEQ ID NO: 36164
  chr16:54964141-54964185
  hyper

SEQ ID NO: 79080 - DNA, 163 bp, Homo sapiens
  chr16:54964972-54965135
  hyper
ccggagccccggagccggggccagaggagcggcggcccagggcagccagaggccaggtgcccgcccgctcgccctcgcagggcgccgcccggctcgttggcggccgcggcgcggcgcgccccatgcccgtgtgtggccatgtcctatccgcagggctacttgt

SEQ ID NO: 79081 - DNA, 93 bp, Homo sapiens
  chr16:54966076-54966169
  hyper
atctgcatggagggccgggccgccgtggccagatctgcgcacggggtacggacgtgcccgggcagatgggggcctacggggtgacaccgaggc

SEQ ID NO: 79082 - DNA, 500 bp, Homo sapiens
  chr16:54966765-54967265
  hyper
cgagccccagaagcccgaggacaagggcgaccccgagggccccgaagcaggttggtggacatgggaaagggcgtgttgggcgggagtaaaaaggaaaagagaggcctggagggggcgcgcacggggcctggaggttgggggcaggggtccctgcctttgcgggcgggaaccgggtcccgccgcgcggcctctgcgcccctgacagcctgggtttcgcccgcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcc

SEQ ID NO: 79083 - DNA, 224 bp, Homo sapiens
  chr16:54971342-54971566
  hyper
agctagctgccaactcggacggaagcgcggaacagcgcaatgcaaaccgcccaaagtgaaaggaatgtaattgcgctcccatgacagagccagacgcggatgcagtttaggaagggcgccgcctaccggcccctgggagccatgcgattcgaagggagggggacctagaggagacccccgctatccccccacccaccgtggggccttagctttgaactccggcc

SEQ ID NO: 79084 - DNA, 46 bp, Homo sapiens; identical to SEQ ID NO: 36169
  chr16:54972930-54972976
  hyper

SEQ ID NO: 79085 - DNA, 402 bp, Homo sapiens
  chr16:55090666-55091068
  hyper
aatcccatcttttcccgcgccccaagcgccgaagccccagaactgccgccggccgggcccatccccagcccaggctcgtaatcaaaaggcagatttccgcgccgggcacctgtttgcagggctgcgcctccttccgctgcggtgttttatctcggcgcggcggtgaataattcatggccccgggtctgctttgcagtcaaacgcgctgcgttctgtccggcgccgccgccgccgcccgccggccgctgtgatttattatttaccaacgcgcggccgcgccgtgtaaggtgagcattgtggctgctcgcagaactgttacaatctggcctcgttagtggcctttcttgctgcatctccaaacagcggccccgcttattgattttcccgcggaacctctgccaa

SEQ ID NO: 79086 - DNA, 82 bp, Homo sapiens
  chr16:5512088-5512170
  hypo
caacaaaaggtggaacgctgtgcttgcctacatcccatgagcaagcataaaagaaacccagcgagtttctttctttctttct

SEQ ID NO: 79087 - DNA, 244 bp, Homo sapiens
  chr16:55203739-55203983
  hypo
tacatagagttagagcgcatattttattaatgttcatcctttagagaccagatttgtgcgttcgctaaaataaacactacagtctttagggcgtggttgggtggagactgcagaagtatgagggcaaagaacattttgcaaggaagtagccactccagagccatcgtcgggtgatgggaggcgcccagagctgggatccagggacccggagtcttgcatctactattcacgaattgaatgactt

SEQ ID NO: 79088 - DNA, 129 bp, Homo sapiens; identical to SEQ ID NO: 36171
  chr16:55357444-55357573
  hyper

SEQ ID NO: 79089 - DNA, 330 bp, Homo sapiens; identical to SEQ ID NO: 36172
  chr16:55357611-55357941
  hyper

SEQ ID NO: 79090 - DNA, 360 bp, Homo sapiens; identical to SEQ ID NO: 12479
  chr16:55357991-55358351
  hyper

SEQ ID NO: 79091 - DNA, 110 bp, Homo sapiens; identical to SEQ ID NO: 36174
  chr16:55358566-55358676
  hyper

SEQ ID NO: 79092 - DNA, 341 bp, Homo sapiens; identical to SEQ ID NO: 36175
  chr16:55358784-55359125
  hyper

SEQ ID NO: 79093 - DNA, 294 bp, Homo sapiens
  chr16:55362962-55363256
  hyper
cgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 79094 - DNA, 527 bp, Homo sapiens
  chr16:55364692-55365219
  hyper
aggtgcttgagaggtcggtgtgcaggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaaga

SEQ ID NO: 79095 - DNA, 34 bp, Homo sapiens
  chr16:55365434-55365468
  hyper
cgtttccaacgccgggtcccggccaggccaggcc

SEQ ID NO: 79096 - DNA, 285 bp, Homo sapiens
  chr16:55404915-55405200
  hyper
cttttgcatcttatacggatagccggctcatggcaatgtgactcaagctggcaggggtctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctc

SEQ ID NO: 79097 - DNA, 43 bp, Homo sapiens
  chr16:55405201-55405244
  hyper
tttctaagcagcagctcacagcgccagccgccctcccgcagaa

SEQ ID NO: 79098 - DNA, 237 bp, Homo sapiens
  chr16:5541116-5541353
  hypo
tctgcagtctgtcatcggccgaaacatcgttacatggtgtgtgactatgtaataaacacacaaaaaagcaatcaacgcaagagtacagctggatgaattgtcacagtgtgaacacatctaggacgccagcacccacttgaagaactggaatattaccagccaccccgagccacccacctagcgactcggcagccaccctcccaagcgccacctgactattatcgccaaaggttaatt

SEQ ID NO: 79099 - DNA, 119 bp, Homo sapiens
  chr16:55512644-55512763
  hyper
cctatccctaaatatcgaaaatttctgtctctgaccatctatcattgtggctgatcatctgtttctgaccattccttcccgttcctgaccccagggagtgcagggtgtcctagccaagc

SEQ ID NO: 79100 - DNA, 429 bp, Homo sapiens
  chr16:55512935-55513364
  hyper
cggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccggg

SEQ ID NO: 79101 - DNA, 57 bp, Homo sapiens; identical to SEQ ID NO: 36183
  chr16:55513482-55513539
  hyper

SEQ ID NO: 79102 - DNA, 437 bp, Homo sapiens
  chr16:55514076-55514513
  hyper
ggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggaggaggagtggggcaggcgctggagggcccggcgcgtggggcgggggcggactgcgctccgctcgggtcggagagcggccagagagccctccttcctggctgggctcccaaaccgcggttcagatgttgtcttgtgagcgtgcgcgcgcctggctggaggggcactgagcctggccgcagtgttgcgtaa

SEQ ID NO: 79103 - DNA, 170 bp, Homo sapiens
  chr16:5559726-5559896
  hypo
tgggccaggcgtggacgttaaggccaagatgggcgcatacacaggggagtggatggacccaggaggtactcttggaggcaaagttgacagggcttagtgatgggtatataagtaagggagtgcggggtgtcccagatggtgcccaagaaccttggcgcagacgagtggag

SEQ ID NO: 79104 - DNA, 76 bp, Homo sapiens
  chr16:55689542-55689618
  hyper
gagctggtgctgcaccggtcgctgcttccccagtccttttttggcctcctttctgacgcgacgcagaccccagttc

SEQ ID NO: 79105 - DNA, 25 bp, Homo sapiens
  chr16:55689876-55689901
  hyper
taccagcccggcccccgccaggcac

SEQ ID NO: 79106 - DNA, 478 bp, Homo sapiens
  chr16:55689902-55690380
  hyper
gccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccgg

SEQ ID NO: 79107 - DNA, 124 bp, Homo sapiens; identical to SEQ ID NO: 12490
  chr16:55690453-55690577
  hyper

SEQ ID NO: 79108 - DNA, 48 bp, Homo sapiens
  chr16:55690761-55690809
  hyper
cgcgcagccccgggagacctggggcaagaagatcgacttcctgctgtc

SEQ ID NO: 79109 - DNA, 418 bp, Homo sapiens
  chr16:56224364-56224782
  hyper
aaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgc

SEQ ID NO: 79110 - DNA, 10 bp, Homo sapiens
  chr16:56224783-56224793
  hyper
ggtttattcc

SEQ ID NO: 79111 - DNA, 39 bp, Homo sapiens; identical to SEQ ID NO: 4358
  chr16:56224794-56224833
  hyper

SEQ ID NO: 79112 - DNA, 783 bp, Homo sapiens
  chr16:56224880-56225663
  hyper
cgggcgacaagatggagagccggcccgagagggacagaggccgcgctggcagcgagctggggggcccacctgaccgtcctgcgggcagcccggccccgcgctcccattgacaaggaggtccgcgccgccggcgcgtggggcgggggcggaggcggggtggggcgccccggcgcgcgcccggccccactccccgcccccgccagtcccgcaagcacccaccccgggggagccgcgggccgggagggcgctggggggaggggcaggccgctccgcgagcgcgtgtgcgcgccgccgccggctgacgcgaactccggcgcgcgcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgc

SEQ ID NO: 79113 - DNA, 158 bp, Homo sapiens
  chr16:56225723-56225881
  hyper
agccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttgg

SEQ ID NO: 79114 - DNA, 215 bp, Homo sapiens
  chr16:56226149-56226364
  hyper
gggatgtactctgagcgcagaggagagagccgccctcgagcggagcaaggcgattgagaaaaacctcaaagaggatggcatcagcgccgccaaagacgtgaaattactcctgctcggtaaggaccgccgctgctacccccatcccccgaccccggccactccgcaccccctgccaccagctcccccaccccactcgcgcccgggagacctggtcc

SEQ ID NO: 79115 - DNA, 48 bp, Homo sapiens; identical to SEQ ID NO: 36194
  chr16:56228369-56228417
  hyper

SEQ ID NO: 79116 - DNA, 14 bp, Homo sapiens
  chr16:56228577-56228591
  hyper
gggggaggggagtg

SEQ ID NO: 79117 - DNA, 43 bp, Homo sapiens
  chr16:56460223-56460266
  hypo
atgctacaataggaacgaaccttaaacacgtgctaagtcaaag

SEQ ID NO: 79118 - DNA, 816 bp, Homo sapiens
  chr16:56623053-56623869
  hyper
aagagctgggaaatacgcaaagcgcctttttctccactttcggagatggtacgtgcgcgcttccacgcagtggcggctgctgcggcgagcacgtcccctgcgggacccacgcggggagtgggctggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccc

SEQ ID NO: 79119 - DNA, 125 bp, Homo sapiens
  chr16:56650999-56651124
  hyper
aggcctacccagggacgaagctggggttgcacaccggctccgggaatggcgaaataccgcagatggggtggtgggggtgggaatatcgcgaccaccagaggctgggttcccggaacgctcgggga

SEQ ID NO: 79120 - DNA, 127 bp, Homo sapiens
  chr16:56651238-56651365
  hyper
cgggtgccaagcaagagacccgcggtgcacaccttgcgcccggccggcctgctgctcacagtccctccacgtacccacaggaggcccagactcagcggggcgggtgcaagcgcggggcggggcctct

SEQ ID NO: 79121 - DNA, 715 bp, Homo sapiens
  chr16:56659106-56659821
  hyper
ccgatccgtgttccccgtgttgctatgtaaggaggtgcgggaccgaggaacctaggtgtggacagggacaggcaaggcgggggacgaagagaaatgaaagccacatcggtggcggatgttctgaacacaactcgctcgctaccgcacgttccccgctccgcactcagcggatcccgggacggcagcaggtgggctgcacacggactctgggacaagtcgagctgaaaaccgcggagctaggggtggggtggagacgcccgcgacgccaaggctggggtcccggaacacgctgggaggagggtggaaggcaacctcggggaaactgggaaaggcggcctggacttcgggaacaccgcgtacctgcgggggcacagccccacccgagcgaacgggctccaaaggggaggtcccgcggtgcccaccgcgcagagctcagggggtggtgcgcccggcccttctgcggcgcacagcccagcccaggaacgcgggcggtgcggactcagcgggccgggtgcaggcgcggagctgggcctctgcgcccggcccgacctccgtctataaatagagcagccagttgcagggctccattctgctttccaactgcctgactgcttgttcgtctcactggtgtgagctccagcatcccctttgctcgaaatggaccccaactgctcttgcgccactggtaagggaagctctgcgccctggaatcccc

SEQ ID NO: 79122 - DNA, 649 bp, Homo sapiens
  chr16:56665943-56666592
  hyper
ggcgaagagaatggacgggagagagaggccgaccagtgttccccgtgttgctgtgtacggaggagccagtccgagggaccgcggtgtggacagggacaggcaaggcggggaaggaggagaaacgaaagccacattggtggcgggtgctctgcacacgactcgctccctaccacacgccccccgctccgcacacgaccgatccggggactggagcaggagggctgcaccgggactccgggacaggcccagttgaaaacggcggggcgagggggtggggtggagacgcccgcgacgccaaggctggggtcccggaaagcgcggggaggagggtggaaggcaaaggcaacttcggggaaactgggaaaggcggccgggacctcggggacactgcgtaccacccggcgcacagcccctcccgcgcaaacccgagccaaaggggcggtcgagcggcgcactcggagcggagctcaggggatggtgcgcccggcacttatgctgggctcagcccagcccagcccaggaccgctggcggtgcgaacccagccgggcgggtgcaagcgcggggcagggcctctgcgcccggccccctcccctgagtagaaaagcagccgcaggctgtggcgctccaccacgccgtccgggtgggcct

SEQ ID NO: 79123 - DNA, 59 bp, Homo sapiens
  chr16:56672114-56672173
  hyper
cgctctgcactacgccgatccggggacaggagcaggaggctgtggctgcactcagactt

SEQ ID NO: 79124 - DNA, 165 bp, Homo sapiens; identical to SEQ ID NO: 36202
  chr16:56672221-56672386
  hyper

SEQ ID NO: 79125 - DNA, 172 bp, Homo sapiens
  chr16:56672513-56672685
  hyper
cgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaaggg

SEQ ID NO: 79126 - DNA, 451 bp, Homo sapiens
  chr16:56677117-56677568
  hyper
cctcgctgcgcttcccgcctcggtcttatctggggacgtgagcactaggctggggtagcacatggactcccacagagccgaagctcacgtcactggtgcggggtgcgggggtggggataccgcgaccacctgaggctgggttcccggaccgcccaagggcaggaatggagtgcaatctccgggaaattcgggagggccgggattatagcagggacgccgcgtaccgccaggagcacagcccctccaaagcgagcgtgagccaaagggccgcccccagggtgcgcaacagccacgttaaggaggatcctgcgcccggcccgcctggtgcgcacagccccgccctgaaccctgggcagcgctgacactgagctgggctggtgcgagacctggggcggggccactgcacccagcaccctgccctgactgtaaagtcaggcggcctgctcctgtt

SEQ ID NO: 79127 - DNA, 74 bp, Homo sapiens
  chr16:56692017-56692091
  hyper
gtgcctggggatgctcgattcccagacaccatagagagtgttcctgggtttgagaaggtcgtattttgagatct

SEQ ID NO: 79128 - DNA, 265 bp, Homo sapiens
  chr16:56701956-56702221
  hyper
ggtgcacgtggaaggcggagtggagcccaacagccagcggctgtttttatagtcaggagacggggccgggcgcagacgccccgccccgcccttgcacccagcccgctgagtccgcaccgcccgcggtcccggcctgggctgtgcgcaggagatgggccaagtgcaaggtcccttgagcgcagctgggcgcacaccgcaggacggcccctttcgcaccggctcgcgagggaggcgctgtgccccccgtgtgcggcttctctcaccc

SEQ ID NO: 79129 - DNA, 27 bp, Homo sapiens
  chr16:56703372-56703399
  hyper
ggggtgggcaggccccggggtgtgggg

SEQ ID NO: 79130 - DNA, 79 bp, Homo sapiens; identical to SEQ ID NO: 36206
  chr16:56709814-56709893
  hyper

SEQ ID NO: 79131 - DNA, 100 bp, Homo sapiens; identical to SEQ ID NO: 12506
  chr16:56709949-56710049
  hyper

SEQ ID NO: 79132 - DNA, 27 bp, Homo sapiens
  chr16:56774935-56774962
  hypo
ggagagggagagcgctaaatttctttt

SEQ ID NO: 79133 - DNA, 30 bp, Homo sapiens
  chr16:57017302-57017332
  hypo
cctgagattatcactcgagatgtgagtaca

SEQ ID NO: 79134 - DNA, 30 bp, Homo sapiens
  chr16:5703116-5703146
  hypo
ggtggggtgctgagccgtgtgctggccttc

SEQ ID NO: 79135 - DNA, 216 bp, Homo sapiens
  chr16:57222193-57222409
  hypo
tactagtgtttggttcgtcgtacttgttagagatggttttccaaatatcgggcaatcatttcctgggatggtatcttgctttgtagatccctctatgagattgtaagagacttgtgtccctgtatgacattttactagtgtttggttcgtcgtacttgttagagatggttttccaaatatcgggcaatttatatgggattttttccgaagtaattt

SEQ ID NO: 79136 - DNA, 35 bp, Homo sapiens
  chr16:57222709-57222744
  hypo
gagccactgtgtctgcctttcgaagtaatttttgt

SEQ ID NO: 79137 - DNA, 35 bp, Homo sapiens
  chr16:57299645-57299680
  hypo
gacagggcaggaggccgggtgcagtggctcacacc

SEQ ID NO: 79138 - DNA, 82 bp, Homo sapiens
  chr16:57321270-57321352
  hypo
tcccactgtctggtggggatgagaagtaataaacccgggaggaataatactttcagatagtgacaaacgctgtgactaaagt

SEQ ID NO: 79139 - DNA, 23 bp, Homo sapiens
  chr16:57457827-57457850
  hypo
tacaaatccactggtcgggcgtg

SEQ ID NO: 79140 - DNA, 30 bp, Homo sapiens
  chr16:57656267-57656297
  hypo
tttgagccccccaaccgctggggctcctcc

SEQ ID NO: 79141 - DNA, 37 bp, Homo sapiens
  chr16:5769148-5769185
  hypo
ggcttagcgtatctacggagttggaaggctgccaccc

SEQ ID NO: 79142 - DNA, 30 bp, Homo sapiens; identical to SEQ ID NO: 16055
  chr16:57759922-57759952
  hypo

SEQ ID NO: 79143 - DNA, 30 bp, Homo sapiens
  chr16:57935550-57935580
  hypo
ggtcagaggcaaggccgggccccaccccag

SEQ ID NO: 79144 - DNA, 199 bp, Homo sapiens
  chr16:57937598-57937797
  hypo
acaggccccagtactcgggacctcagagacacagaggacgagggaggcgccccgaaggcatggcaccgggcaccaggcgacaggagttgactgggagctggtggctgccagggcgtgaccatcttacccagcatgccttgcgagtgccaggtgtactcgtaccaggtcttgacgcggttctgcacggacttggggatct

SEQ ID NO: 79145 - DNA, 933 bp, Homo sapiens
  chr16:58018551-58019484
  hyper
acaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgaggtcagtctacgggccgctgaaggaactgccgggcaggtgggccgcggggctggagcagggaacgtggactgcggacgggaacgcaggcggcgggccaggcagaaacagggcggggccgctgagatgaagctgtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtggggagcggcttaagccgggggttgaggggggaggagacccagagcagggcctcccagtcttcaggaccacggtctctagcaggaagccctgtgtggggcgtgggcagggcgtccgtgctcccccgactcaccgcgcccctatccctgctgcccgcctcagtactgcctcagccagaaccccagcctggaccgctacggacagaagcccctgcctttcgactccctgtaagtgacgccacgcgcccggggaccccatatc

SEQ ID NO: 79146 - DNA, 103 bp, Homo sapiens
  chr16:58061004-58061107
  hyper
ctttctgcgcttttgcgaggaagcctaggcacgcccgggcggggtcctaaggacggaccctgcctcccacagcgcttcctcccaacagcgcccctacgtcgaa

SEQ ID NO: 79147 - DNA, 122 bp, Homo sapiens; identical to SEQ ID NO: 44712
  chr16:58120963-58121085
  hypo

SEQ ID NO: 79148 - DNA, 50 bp, Homo sapiens
  chr16:58192290-58192340
  hypo
attaatcaacctgagcgggcgaggggaggcctccacgtgtaggagggcct

SEQ ID NO: 79149 - DNA, 214 bp, Homo sapiens
  chr16:58427268-58427482
  hypo
tggtgagctgggattcggaacccaaggccatatggcttcaaatataaaattgtcccaggaacatggcttgtaatgattaatttggatatcctgtttcacctaagttttgtatagaacgatgtttattgtttggtctgtttgtttcaagttaatttttatcaaagtaatacataaccaacgttttaaaagtcaaataggccggatgcggtggctc

SEQ ID NO: 79150 - DNA, 23 bp, Homo sapiens
  chr16:58462000-58462023
  hypo
taatacatcgtggacatccttcc

SEQ ID NO: 79151 - DNA, 122 bp, Homo sapiens; identical to SEQ ID NO: 12509
  chr16:58497214-58497336
  hyper

SEQ ID NO: 79152 - DNA, 1116 bp, Homo sapiens; identical to SEQ ID NO: 36210
  chr16:58497469-58498585
  hyper

SEQ ID NO: 79153 - DNA, 64 bp, Homo sapiens; identical to SEQ ID NO: 12512
  chr16:58498586-58498650
  hyper

SEQ ID NO: 79154 - DNA, 119 bp, Homo sapiens
  chr16:58499185-58499304
  hyper
caggaccttaatgtccgatgagggagcagagccccggagccctgttacaaggctggaaggggcagccgtctgtgggtgcgctcaggaaacggtggaatccgagtcgggggcagcttttg

SEQ ID NO: 79155 - DNA, 44 bp, Homo sapiens
  chr16:58540563-58540607
  hypo
ccctcccagctggctcggtaggaggcaggcgagtgtctttggca

SEQ ID NO: 79156 - DNA, 97 bp, Homo sapiens
  chr16:58548289-58548386
  hypo
gtattatcttagtttcgcaggtgaggagactaaggttcaggaaaaaggatttgcctgagtaacagaccaggccgcgcgcggtggctcacgcctgtaa

SEQ ID NO: 79157 - DNA, 87 bp, Homo sapiens
  chr16:58549151-58549238
  hyper
agaagcctcagccctcggggacagaccgaaggccagggctgtacctggctcagaaccaggcgccaagcggcacgggactctccttct

SEQ ID NO: 79158 - DNA, 50 bp, Homo sapiens
  chr16:58550442-58550492
  hypo
gatttggccaacatccgcagcgagtaccagtccatcgtgctgcccttcat

SEQ ID NO: 79159 - DNA, 145 bp, Homo sapiens
  chr16:58831937-58832082
  hypo
tgcatattcaggcatcgcatgtagtttgttttcttatttcaagagttatatatgcattccgaatacagtttttctgtcagatatcggatttgcaagtattttccttcatggaatgttgaattgcagtgataagagtgtaattttt

SEQ ID NO: 79160 - DNA, 35 bp, Homo sapiens
  chr16:58850468-58850503
  hypo
caggcgcccgctaccacgcccgaagctgccagttt

SEQ ID NO: 79161 - DNA, 20 bp, Homo sapiens
  chr16:58886050-58886070
  hypo
aatgctggtcaggcacggtg

SEQ ID NO: 79162 - DNA, 33 bp, Homo sapiens
  chr16:58886324-58886357
  hypo
taaaaaaaaaagaggggacgttgaaagtggcca

SEQ ID NO: 79163 - DNA, 27 bp, Homo sapiens
  chr16:58932088-58932115
  hypo
tttgcctaggctgagcgcagtggtgtg

SEQ ID NO: 79164 - DNA, 61 bp, Homo sapiens
  chr16:58969757-58969818
  hypo
ctgtaggtagtggaacgaagcgatgttccaaatttcatggggctgccgaagaggcttgcag

SEQ ID NO: 79165 - DNA, 38 bp, Homo sapiens; identical to SEQ ID NO: 16056
  chr16:59046529-59046567
  hypo

SEQ ID NO: 79166 - DNA, 30 bp, Homo sapiens
  chr16:59182473-59182503
  hypo
tttctcatattttaacgagaaacagcagaa

SEQ ID NO: 79167 - DNA, 30 bp, Homo sapiens
  chr16:5950685-5950715
  hypo
ctccagcaagtcatgcggggttcttgggga

SEQ ID NO: 79168 - DNA, 28 bp, Homo sapiens
  chr16:60166000-60166028
  hypo
gcgtgagccaccgcgtcaggccgaaagc

SEQ ID NO: 79169 - DNA, 28 bp, Homo sapiens
  chr16:6068899-6068927
  hyper
aggagaccagggtaccgggtcgcgtgtc

SEQ ID NO: 79170 - DNA, 41 bp, Homo sapiens
  chr16:6068936-6068977
  hyper
cgcccgctggaatccagggctgcacgcgtgaccgcggcggc

SEQ ID NO: 79171 - DNA, 60 bp, Homo sapiens
  chr16:6069492-6069552
  hyper
ccccccagcagcacccgcggtggggcgggggcgctctgccagccccgggaacagcagagg

SEQ ID NO: 79172 - DNA, 17 bp, Homo sapiens
  chr16:6069577-6069594
  hyper
cgcgcctccggggctga

SEQ ID NO: 79173 - DNA, 202 bp, Homo sapiens
  chr16:6070067-6070269
  hyper
gaagcgctaggtccccgagaactggcctcctcctagcgccagtctgggcgctctggacgggaactttttcagggtgtgtggaaagatctcgaggcgtgtccccccctacccccaggaggccgagaccctgagcccccttgtgcgtcgcttccagaagcacgtccttccttgccccagagcgcccctccgaagcatccaggct

SEQ ID NO: 79174 - DNA, 5 bp, Homo sapiens
  chr16:6070542-6070547
  hyper
cggtg

SEQ ID NO: 79175 - DNA, 39 bp, Homo sapiens
  chr16:607668-607707
  hypo
actggccatgccgagcgctgcctccgctgccttctctga

SEQ ID NO: 79176 - DNA, 451 bp, Homo sapiens
  chr16:609865-610316
  hyper
gcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcc

SEQ ID NO: 79177 - DNA, 158 bp, Homo sapiens; identical to SEQ ID NO: 35998
  chr16:610343-610501
  hyper

SEQ ID NO: 79178 - DNA, 205 bp, Homo sapiens
  chr16:611376-611581
  hypo
gggtgatcgatggcccggcacagccgcctctgtcgccggagcgcccacacccatttgtcatccacatgggtggggggggcggcgggcagggagaaggggccgcctctgcacccaccacccagtccaggccgggtctgcagcccctcggggagccccaggacctctcctggcccagcccctgcctcccgaccgccaccctgtctca

SEQ ID NO: 79179 - DNA, 370 bp, Homo sapiens
  chr16:611950-612320
  hypo
gtgcagccagggccccgcacttggtggcagactccgttctgagcttaggtggcacagaggtggcttctccgggcactgggtgagggctctgtgtgagcctgtgggctgtgtacacacacccaaagcccgtgtgcgcaggcgtgctgtgcaccccacacaggcgcgtgctggggcggtggacagcccaggtggcggcccagatggagtgtggcgcgcataccagcgccgtgtggggcgtggggaggagcgggtcttggctgagtgtggccgctgcaggctcggccgctgacctgcccgaagccacccagatggagctgggctgagcaggtggctgagccgtggggccatgctgggacgtccactccccaca

SEQ ID NO: 79180 - DNA, 287 bp, Homo sapiens
  chr16:612869-613156
  hypo
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggacttttttttttttttttggtgccctggactttgctgccaccctggaagtgcacgtggggaggagccgaaggatggggctcggggggcacgttgcagggcagaggcggcggggtggggggagc

SEQ ID NO: 79181 - DNA, 496 bp, Homo sapiens
  chr16:613552-614048
  hypo
gcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccg

SEQ ID NO: 79182 - DNA, 30 bp, Homo sapiens; identical to SEQ ID NO: 44404
  chr16:614353-614383
  hypo

SEQ ID NO: 79183 - DNA, 502 bp, Homo sapiens
  chr16:614755-615257
  hypo
ctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccaga

SEQ ID NO: 79184 - DNA, 30 bp, Homo sapiens
  chr16:61479596-61479626
  hypo
ccagcacaatccagacgcgcaactcttcca

SEQ ID NO: 79185 - DNA, 30 bp, Homo sapiens; identical to SEQ ID NO: 44589
  chr16:6186354-6186384
  hypo

SEQ ID NO: 79186 - DNA, 85 bp, Homo sapiens; identical to SEQ ID NO: 36213
  chr16:62068463-62068548
  hyper

SEQ ID NO: 79187 - DNA, 75 bp, Homo sapiens; identical to SEQ ID NO: 36214
  chr16:62069009-62069084
  hyper

SEQ ID NO: 79188 - DNA, 138 bp, Homo sapiens; identical to SEQ ID NO: 12513
  chr16:62069136-62069274
  hyper

SEQ ID NO: 79189 - DNA, 99 bp, Homo sapiens
  chr16:62069336-62069435
  hyper
cgcagggcgactccggagcccggcaagtttgtagcgggcaccgcacctcccagagctggagctgccacttgtgggaaagcctcgcgctggggctttcgc

SEQ ID NO: 79190 - DNA, 2 bp, Homo sapiens
  chr16:62070111-62070113
  hyper
tc

SEQ ID NO: 79191 - DNA, 43 bp, Homo sapiens; identical to SEQ ID NO: 36217
  chr16:62070743-62070786
  hyper

SEQ ID NO: 79192 - DNA, 55 bp, Homo sapiens
  chr16:623234-623289
  hypo
gtttctccacacctccgggacctgtaagcctctctctccccgtttctaggcaccc

SEQ ID NO: 79193 - DNA, 28 bp, Homo sapiens
  chr16:62670669-62670697
  hypo
ccagtggcgctatcccggctcactgcaa

SEQ ID NO: 79194 - DNA, 30 bp, Homo sapiens; identical to SEQ ID NO: 44590
  chr16:6314961-6314991
  hypo

SEQ ID NO: 79195 - DNA, 112 bp, Homo sapiens
  chr16:643882-643994
  hypo
cctgggtgatggtggcgagttacccggcaggaattatgcttcatccaggagtgtgggtggtgcacgcggcggggaggagaaagctgcagttcaggagcgaacctgcagtcag

SEQ ID NO: 79196 - DNA, 30 bp, Homo sapiens
  chr16:64407177-64407207
  hypo
tgaatttgatcaatacgatgaactaaggct

SEQ ID NO: 79197 - DNA, 767 bp, Homo sapiens
  chr16:65154509-65155276
  hyper
ttagggataacccgtcgtcaggcagggatggtattaaataattaaaagatgcgatttcttaatagcagtgtgatggcccatgaaattcctactgcattatcagcaaaagcaacagggcttcttctagcacctagaaaacctttcacccgggagaggcaggcgcggcgagccccgggcgaaagcagggcctcggcaaaaaaacggacaaggaagccggacccgcaagcctcccccgaccccactttctctggggactccgcttcacagcgtgaggcgggccctcctacagttcctctgggttggggaggggggagaagggagctctcctcgccgtcctccccatctggccagcttctcagtgcttcccacctcccggctcgcgttccggggcagagcgcagggagggaggccgtgcgtgccgggagctagagaggcttggcgcgctccgagaagcggcgcaggtttcgggaaggtgtggttctcaaagttaacgttgaccctggcagctttcgccaatcccaagccagaggcgagcccgagtctgggccgctcatggacctactcctgcgctggtgggagcttacaaacgggcgccagagctcccgcagagactcgggctggagggctgtagcgcaccgcagcctgctgccccagaaccacagtcggcggccccaaacccacgctattaaagtgcgggcaatctccttccggagctggggtctttccgttttcccgggcttacccggcagtctcgactgcagggacta

SEQ ID NO: 79198 - DNA, 1218 bp, Homo sapiens
  chr16:65155677-65156895
  hyper
ctcaccaccccgccccgccaagacattctcttcctgagaaaatcctgccccccattccaagaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagctctcctctcgtctagtgccccccacgcaacgcctcggagaggggtgcgcggggagcgcttcgccggggtcggcctcgctccagcttttgggagggtgccttggcccctaccccagccaggtatcagtggcccccgccggtagtgtcacttgttgccactccctcgctacagacccgccagggcccggtggagtgtgcgtttctacgggagaaagggcctaatggggcgcagcgc

SEQ ID NO: 79199 - DNA, 378 bp, Homo sapiens
  chr16:65156939-65157317
  hyper
cgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctgcggagggaaagctgggcgccacagccaagca

SEQ ID NO: 79200 - DNA, 316 bp, Homo sapiens
  chr16:65157522-65157838
  hyper
gcttggggagacgcccgcgggggcgggtgccggcgaggctgccccgggacctaccctcttcggcctgcgcgcccgcgtttttcttgacgactccaggatccgggtggcgctgcgtgcctgcccccagtccgcgtcctgcgcggagaggatgcctctgtcaccctctgtgtggacgtggcctttgaactcctcattcctccactgcgggggaagagctgtaagtttccagctgcccggttatcttactcctcagccttccccccaccataggtgtccaaggtgatagccccctgggtctccagtaaccccccaacct

SEQ ID NO: 79201 - DNA, 203 bp, Homo sapiens
  chr16:65157863-65158066
  hyper
cgcgaggacattgactcccggtgctttcctgtagagcgccagagagcagatcgtggtgcctgccactcctgcctccccctgtgggtccctggccctgaaccttttcagagctctaccctgcttcctctgtctgcctttttggcctctgctgtaacccctaaaactttgggtacttcccaagccaccgccgaaagtccccactc

SEQ ID NO: 79202 - DNA, 289 bp, Homo sapiens; identical to SEQ ID NO: 36061
  chr16:6533425-6533714
  hyper

SEQ ID NO: 79203 - DNA, 478 bp, Homo sapiens; identical to SEQ ID NO: 36224
  chr16:66461511-66461989
  hyper

SEQ ID NO: 79204 - DNA, 30 bp, Homo sapiens
  chr16:66512694-66512724
  hyper
gctgacacaggaaatcggcctttgtcaagg

SEQ ID NO: 79205 - DNA, 362 bp, Homo sapiens; identical to SEQ ID NO: 36225
  chr16:66612734-66613096
  hyper

SEQ ID NO: 79206 - DNA, 175 bp, Homo sapiens; identical to SEQ ID NO: 36226
  chr16:66638277-66638452
  hyper

SEQ ID NO: 79207 - DNA, 195 bp, Homo sapiens
  chr16:666712-666907
  hypo
acttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaag

SEQ ID NO: 79208 - DNA, 77 bp, Homo sapiens
  chr16:667484-667561
  hypo
cggaaaacctgattccgtggtggctgtgagccccttccctccccttctgtcggcttcaccttaaaaagcatttccca

SEQ ID NO: 79209 - DNA, 810 bp, Homo sapiens
  chr16:66878235-66879045
  hyper
ctggggggtggggggcgggtcccccgggaactgctcctcccgccagccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggtaggcacagacctcccccaccgcctctggctcggacccccgacccaactgcactcgccccaaccctcttgcccagctggtttcccagaccggaaagctcccacactccaggctgggcgggacccctcttcccatcccggcccccgaacttggcccaagccttggtcccccgcgccagacgcaaagtccgcgctgcgccccgggtggccccgccgccagcaagcgacctggcggctgtgtcctgccgcctcctccgcgaagcccctgattgcccagcccgctcagacccaggcccagactctcactcactcgccccgggcgtgcgcagcgcgtgggggtggcccagggcagcggggggcgggcgccgcggagcgctgtgcgcgggtgtctgcggggagcgcgcacggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtgg

SEQ ID NO: 79210 - DNA, 273 bp, Homo sapiens
  chr16:66958730-66959003
  hyper
gcccgtcctccacaccgccgaagatgcgcgccagggcgctcttgcccacgccgggcgcccccagcagcagcaccttgtaaacgctctcgtctgagtcgctgccccctgagctgagcgagtcctcggagtcctcgggccagtccagcctgggaccctgggtccccgtcccggccgcggccgccgtcagggcacccggggtcagcgccgcctgcaggtcgcgctcgtccaccggcatgctgcggcggtgcagcggcggggcggggccccagggtg

SEQ ID NO: 79211 - DNA, 167 bp, Homo sapiens
  chr16:66959249-66959416
  hyper
cccctccggacctggcgcatccatctgcagccgccccgaccccgctccgccaggacactcacccactcgcacacagacacgctcaggactaggatccggattaggaggccacgcactcgtagtccggactcggactttagggtttccgccgccgctgctgctgcagc

SEQ ID NO: 79212 - DNA, 226 bp, Homo sapiens
  chr16:66987397-66987623
  hypo
aacaagccacctcctcgcctatctgtgtcctgcagaggtgactcaacccatttttgtaagaagcaagactgggcttgtccacaggcccctgagcctgggcctcctgtacagttgccaggaaagccaagccgattcctcagtggccgtctcctgaaggttgctcttcttctcagtggttctacagacactgtaaggcccctactcacaggatcgtagcacactcgcg

SEQ ID NO: 79213 - DNA, 30 bp, Homo sapiens
  chr16:67049292-67049322
  hypo
cagtggaatgaggtgcggctgcattaaaga

SEQ ID NO: 79214 - DNA, 55 bp, Homo sapiens
  chr16:671371-671426
  hypo
actgtctgtcccagccgggatttgtcactctgcctccctccgttagagagtggag

SEQ ID NO: 79215 - DNA, 269 bp, Homo sapiens
  chr16:67184148-67184417
  hyper
tcccgtaggcgtgggcggcgccggtgtgtccccttcgtaggccggcggggctgcacccgcgtcgggtaactggaacgcgcggggtccgggggtgggcctcggtgccgccctccctcgccctcgcggcgcgctcgccgtcggggccgcgccgtcgcgctgcgcatagagtaagaggcccagggaggcgccaaggagcagcgtgagcaatgcgtccctgcgtaggcgcagcctcctcctcatctccgcgcggcctgcgccctccctcccct

SEQ ID NO: 79216 - DNA, 91 bp, Homo sapiens
  chr16:67189168-67189259
  hyper
gccagttcttcatcccggagccggtcgggctaggggaatggaacgtgccgtcacgggggacttaaccgcggatccccgccctaccccatcc

SEQ ID NO: 79217 - DNA, 689 bp, Homo sapiens
  chr16:67197593-67198282
  hyper
ggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 79218 - DNA, 980 bp, Homo sapiens
  chr16:67198552-67199532
  hyper
ccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatg

SEQ ID NO: 79219 - DNA, 30 bp, Homo sapiens
  chr16:67241204-67241234
  hypo
gcaccagaccctgcccgctgggggcctggc

SEQ ID NO: 79220 - DNA, 277 bp, Homo sapiens
  chr16:67241603-67241880
  hypo
gttgatgccagggcacgtggccacatccaacacccggagctgcctgcacgcctgcccaatagcatccagtgtcctgtggggaggccacctgatgagtgcctggcccggtgtgggacccagcccagcccctgcaccgtggctccatctgcctggtgtcatcggacacacttactgctctatgagctgactgcagctggacaggttgagatgctgcagccttggccaggagctggctgcctgggcccagcccttgtcactgagtcggctgcagtgactc

SEQ ID NO: 79221 - DNA, 30 bp, Homo sapiens
  chr16:67242338-67242368
  hypo
tgctccagctctgggcgtgactgtgggaag

SEQ ID NO: 79222 - DNA, 101 bp, Homo sapiens
  chr16:67244020-67244121
  hypo
gcctgggccagttcccgccctcggccatgtcgaggctctgcagctcctgcaggccacccagagctgtacatcctgcatctgtcagccgctgcagcttcccc

SEQ ID NO: 79223 - DNA, 48 bp, Homo sapiens
  chr16:67289799-67289847
  hypo
ctgctgaaatggcctcgctctccgccattcttgcgtgagttctggggg

SEQ ID NO: 79224 - DNA, 102 bp, Homo sapiens
  chr16:67299098-67299200
  hypo
gggtgcattcagcaccgtgacctggggctcttcctccagggacttgatttccaagttggaaatgttcaaagcagttattagacaatgcgtgacaggaggcat

SEQ ID NO: 79225 - DNA, 106 bp, Homo sapiens
  chr16:67313852-67313958
  hypo
ccactgagtcccactcgactgtcttcagcgcggttcacactgagacccagccctctcccgctggccccgagcaggcccacctttaggagggcgtgatggaaaggcc

SEQ ID NO: 79226 - DNA, 83 bp, Homo sapiens
  chr16:67320453-67320536
  hypo
cctgcgggggccccacgcaggagctcagtgcgctgcgggaggcccagagccttgtgcacttccagctgcggcacggaaacgac

SEQ ID NO: 79227 - DNA, 348 bp, Homo sapiens
  chr16:67360535-67360883
  hyper
aatccttggccacagcggcccccattcgccgctttggtgcttttggcgcccccgccagagcgggctccgtaccatggtcgcggctccagcagcgggcgggcgggcttgtgacccggccaataacggttcccggggtcgcggcggcgcgcgcgcggggggcggggcagtgggcggggcctggcgtgcgccgggtggtctcgcgggcggtggcaggtgagcggcgggcggggatggcggagcaatgggagctggacgaggaaggcattcgccgcctgggggcgctgacgctggagcagccgggtagggtctggccgggagggtgtggactgggaacgtagggtcagaagc

SEQ ID NO: 79228 - DNA, 162 bp, Homo sapiens
  chr16:67427310-67427472
  hyper
ggaaggacagaacgacgcaggaatggaccgatggacgcgggagaccaggcggctccgcagctccgctccctgccggctcccgggtgggactgcagcccaggcggctccgccgtattatcccctgtttctcggtctccatagagacggcgagtcccacccccg

SEQ ID NO: 79229 - DNA, 30 bp, Homo sapiens
  chr16:67427854-67427884
  hyper
ccaggccacaactcccgtgctctcttgggt

SEQ ID NO: 79230 - DNA, 137 bp, Homo sapiens
  chr16:67433335-67433472
  hyper
ctgcagtgcttggagcgagcgctcctgcagggagagggggcacagcgcgattggccggctcattccccgctctgcggcccggccggtcggggtggttgagtggggtctgtggagggaccaagcgccaggcctgagac

SEQ ID NO: 79231 - DNA, 30 bp, Homo sapiens
  chr16:67478638-67478668
  hypo
catcaaggtgggggccgggaagtcctggca

SEQ ID NO: 79232 - DNA, 30 bp, Homo sapiens
  chr16:67496823-67496853
  hypo
ggctcctgttccacacgcacagccatcttc

SEQ ID NO: 79233 - DNA, 38 bp, Homo sapiens
  chr16:67571498-67571536
  hyper
aggtaggacccagctcggggctgcgaaagctcagggac

SEQ ID NO: 79234 - DNA, 74 bp, Homo sapiens
  chr16:67572364-67572438
  hyper
gtgcggccgcagcgccgtctgctcagcgcccgggtcaataggagccagtccttcgcaggcgtcctcggcagcca

SEQ ID NO: 79235 - DNA, 81 bp, Homo sapiens
  chr16:67578633-67578714
  hypo
gcatgggccctggagcggctgctgcgggaagcccgagtactggaggcagtatgcgagttcagcaggcggtgggagatcccg

SEQ ID NO: 79236 - DNA, 77 bp, Homo sapiens
  chr16:67678709-67678786
  hyper
ggaggggaccagccccggtgggccgcggggatccccaggcaggcagcgtcccctggtgttcgcggcagggactgcgg

SEQ ID NO: 79237 - DNA, 117 bp, Homo sapiens
  chr16:67679041-67679158
  hyper
ggagcaggtggctgccgtgcgggtctgggccccaggcttcctgtgtgcgcgctcgtcctctgctgtttcccgccggagctcgttgggcctccccggcccgcccggcccatggcccag

SEQ ID NO: 79238 - DNA, 41 bp, Homo sapiens
  chr16:67683741-67683782
  hypo
tttgggtctgctggacgtggcgcaggcgctggagcagaacc

SEQ ID NO: 79239 - DNA, 259 bp, Homo sapiens
  chr16:67700832-67701091
  hyper
gccccaagcagctgtcgaggacgcactcagcctgcgcagccatggcctcggcaggggcggagaggcggccgggggtccaggaggcgacggtcgtggggcagggacagctcacggaggagcccggcagcgctcagacctccgaggtgaccgtcaggctgtttaaccttcaaacacagggccgcagcgctctgagaggtggaactgagcgccccgacccgctaactgccaggctgggccctccaggcggggaggggcacag

SEQ ID NO: 79240 - DNA, 18 bp, Homo sapiens
  chr16:67730391-67730409
  hypo
tttttgagacagtctcgc

SEQ ID NO: 79241 - DNA, 30 bp, Homo sapiens
  chr16:677437-677467
  hypo
acctcaagtccttctcgatggccaacggca

SEQ ID NO: 79242 - DNA, 72 bp, Homo sapiens
  chr16:677837-677909
  hypo
tccgggaatcttggtcggaaacaagccgggcctccccagctgcctgggcttgaccggcggggagcctggttg

SEQ ID NO: 79243 - DNA, 100 bp, Homo sapiens
  chr16:67854142-67854242
  hypo
agccaccgcgcccgactatgctttctcactgcatcctcacatcaatacactgtgacaaagactaccatcatccctattttacagacgtgagaactaaggc

SEQ ID NO: 79244 - DNA, 129 bp, Homo sapiens
  chr16:67877005-67877134
  hyper
agacgtgaagcccatcgatctcacagtgcaagtggagtttgcagccgcagagggcgcagccgctgcggccgccgcgtcggagttacaggctgctaccgcagggctggaggctgccgagtgccctatggg

SEQ ID NO: 79245 - DNA, 270 bp, Homo sapiens
  chr16:67982004-67982274
  hypo
caggagtgtctgcaccgcacaggcgaggttcacgaacaggtagcacatcagaaagaacctgcggcacagagggcggttggcgaagagcagcctcctcggcagctggggacctgatgtcaggctgggcctggcccagaaacggggcgtggcccggccctgccctgcatggctcagcaaggtcttctcaacctcattgctgccacctccatggcctgaggcaatgagactactgtggaggagtcctcggagccagatcgcagaggatgggca

SEQ ID NO: 79246 - DNA, 157 bp, Homo sapiens
  chr16:68002842-68002999
  hyper
agtgtcctggctctgcgccctgggcttacgaagcgctctgttacttagggacggggcagggtaggccggaccggcccaggactgcagaagccacctgcccagggcctcccaccaaccccgtatacctccttcccatttccagcgtctgcatcccatt

SEQ ID NO: 79247 - DNA, 30 bp, Homo sapiens
  chr16:68012551-68012581
  hypo
agaatgaggccagggcggtcttcaaccccc

SEQ ID NO: 79248 - DNA, 217 bp, Homo sapiens
  chr16:680959-681176
  hyper
gggcctgggagcccccgcacggttcagacagaggggccaggctgaagctggagaggaaccagcgtcacacagacggcctctgagaacttggagaccccgttacccacccagcaggggtgtcaggacaagcatctgctgcaggcttcagcctcaggggcaaaagggagccccggggtcctggtgggggcaccgaccacaggcccggagggtggatgcc

SEQ ID NO: 79249 - DNA, 416 bp, Homo sapiens
  chr16:68118224-68118640
  hyper
tccctgtccaccttgcgcctcagcggagccttaggtaaacaagccaggctcccagtccccaaggacggccttcaccccagaccccaggaggaggcgtcttgggccatctcgggaaggctagcttgctcgggaggggcagatcacgaaaacggttctttaggcagtgtcacttcctctccactgccagccacccaatttaggcggctccatccctcccgctttcatggatatgcagcaggatgcagagagcacagagctgtgattggcacgagctcacaacgggctttcccgctcaatctactcaacttccagcaagggacaggccctgcccattggggttcgctgaggcctcaaacgcgcatgctgtcaagggagcagctgcgggggcccgctagtggggacaaaggcgcagccac

SEQ ID NO: 79250 - DNA, 156 bp, Homo sapiens; identical to SEQ ID NO: 36243
  chr16:68118759-68118915
  hyper

SEQ ID NO: 79251 - DNA, 32 bp, Homo sapiens
  chr16:6825036-6825068
  hypo
gtagacaaggcagggcgcagtggctcacgcct

SEQ ID NO: 79252 - DNA, 30 bp, Homo sapiens
  chr16:68270127-68270157
  hyper
gcggctaccggcccacgccctctccaggcg

SEQ ID NO: 79253 - DNA, 84 bp, Homo sapiens
  chr16:68273891-68273975
  hyper
tcgtctgcccagacccgtccccgctctcagcgaccctccttatgtcccgggccaccccactagccagcgcgttgggccccacct

SEQ ID NO: 79254 - DNA, 30 bp, Homo sapiens
  chr16:68362039-68362069
  hypo
aatgctaatcctccacgctgacttctgacc

SEQ ID NO: 79255 - DNA, 183 bp, Homo sapiens
  chr16:68385408-68385591
  hypo
caccacccccactgccgcctccgggatgagtccagcccctcaccctgtcctggctgccttgggctgggctggcttctgtccagctccacaccctcaccttggggggccttgctgtctcccggcctcactcttgcccctgctgcccctccctcggccgttcaggctcctcgctgtgcacgtgtt

SEQ ID NO: 79256 - DNA, 35 bp, Homo sapiens
  chr16:68386152-68386187
  hypo
ctctctcctcctgggcgagccgttcttcactacca

SEQ ID NO: 79257 - DNA, 148 bp, Homo sapiens
  chr16:6838778-6838926
  hypo
cactgatttttctgaggatgcctctgtgatgtcatacgatgtgccaatttccatcttatgtcctaaaatggcatcgcctcacttctgagaaatactgtcactctgtagctaactctctgctctaagaactcagcgtccccaagccaac

SEQ ID NO: 79258 - DNA, 41 bp, Homo sapiens
  chr16:68480923-68480964
  hyper
ctttgtctcccgccccgctcctggcacgtttccgtggaagc

SEQ ID NO: 79259 - DNA, 265 bp, Homo sapiens
  chr16:68504027-68504292
  hyper
tgcagttagtggtagcgtttgccagaaaaaaataatagattgtaaaggaagcaacacggaacaaccacgtttttgttattcgaaatgcagctacacgtgtttacagtccttaaccatttcatctgacagcctggggagacagacttctaatttgtgttttgataaactgagagtgacagagcggttgttggccctgcttggaggtggagtgatggtgtggtcagaagggaagccggagggaagttacactcgtggggtgtgtgtt

SEQ ID NO: 79260 - DNA, 236 bp, Homo sapiens
  chr16:68544142-68544378
  hyper
gagagggaggaggctcgtggaccaagaggacgcactcggatctggagttctccggcccggacacccacgggccaccgcgtcgaggcagcgcgagccccgggcgccccctgcaggttgtacgggcctcagctgcgcagcgcagacggaggagggcgctggcggttaagaactcctacttgtcaaccggaaaaacatcccccataaaaaaacggtcaaagggccgggacagaagcatt

SEQ ID NO: 79261 - DNA, 60 bp, Homo sapiens
  chr16:68572648-68572708
  hypo
ccaaacaaaatcctgcgtaaggggatacgaagtaatgaaataacacggcagtagatctgc

SEQ ID NO: 79262 - DNA, 245 bp, Homo sapiens; identical to SEQ ID NO: 4365
  chr16:68676360-68676605
  hyper

SEQ ID NO: 79263 - DNA, 198 bp, Homo sapiens; identical to SEQ ID NO: 36247
  chr16:68676841-68677039
  hyper

SEQ ID NO: 79264 - DNA, 174 bp, Homo sapiens
  chr16:68678982-68679156
  hyper
tctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcag

SEQ ID NO: 79265 - DNA, 108 bp, Homo sapiens
  chr16:68679959-68680067
  hyper
cccagcagaggaatgcgccggccacattcttcccccaacccgcgcgcaggtgtggggatgagccgtgccccgggcagcccccttcgcccctctcgggccccctttgtg

SEQ ID NO: 79266 - DNA, 80 bp, Homo sapiens
  chr16:68759191-68759271
  hypo
gttgatttgcactcccgtctgccatgtttagttaggttatttcacccaattctttttttttttgagacagagtctcactc

SEQ ID NO: 79267 - DNA, 120 bp, Homo sapiens
  chr16:68770606-68770726
  hypo
ggagttcgagaccaggctgggcaatacagggagacacagcgcccccactgcccctgtccgccccgacttgtctctctacaaaaaggcaaaagaaaaaaaaattagcctggcgtggtggtg

SEQ ID NO: 79268 - DNA, 149 bp, Homo sapiens
  chr16:68770846-68770995
  hypo
accccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccata

SEQ ID NO: 79269 - DNA, 76 bp, Homo sapiens
  chr16:68771248-68771324
  hyper
cagcccgctccagcccggcccgacccgaccgcacccggcgcctgccctcgctcggcgtccccggccagccatgggc

SEQ ID NO: 79270 - DNA, 45 bp, Homo sapiens; identical to SEQ ID NO: 44724
  chr16:68787504-68787549
  hypo

SEQ ID NO: 79271 - DNA, 42 bp, Homo sapiens
  chr16:68876805-68876847
  hypo
atatatgcgtgtgtacgtctgtacttaggttttgtttgtttg

SEQ ID NO: 79272 - DNA, 30 bp, Homo sapiens
  chr16:69106048-69106078
  hypo
tgtgtgtgtcacatgcgctctctaaattct

SEQ ID NO: 79273 - DNA, 25 bp, Homo sapiens
  chr16:69107559-69107584
  hypo
gttagaaagggcactcgaagccagg

SEQ ID NO: 79274 - DNA, 48 bp, Homo sapiens
  chr16:69133585-69133633
  hypo
attgtgtctcctgttcgttacttaacactgcatcgtaggtgtctggag

SEQ ID NO: 79275 - DNA, 30 bp, Homo sapiens
  chr16:69139552-69139582
  hyper
gacaattctcttcagcgcctctttcctgcc

SEQ ID NO: 79276 - DNA, 136 bp, Homo sapiens
  chr16:69352213-69352349
  hypo
tgaggtgtgagtcaccgcacctggcctgggctgctctttaagtccagctgaagcacatttcccttacggccttcaggagagggccgacccggattcccatctgctccgcgaagaaacagggcgggttataggagtg

SEQ ID NO: 79277 - DNA, 30 bp, Homo sapiens; identical to SEQ ID NO: 44727
  chr16:69352566-69352596
  hypo

SEQ ID NO: 79278 - DNA, 21 bp, Homo sapiens
  chr16:69359280-69359301
  hypo
tcgagagttgctgggcgcggt

SEQ ID NO: 79279 - DNA, 30 bp, Homo sapiens
  chr16:69372480-69372510
  hypo
cccacaactgcccttcgagggagggacgtg

SEQ ID NO: 79280 - DNA, 36 bp, Homo sapiens
  chr16:69563669-69563705
  hypo
ctggaagcaagactgcgttcccgagcagatggccca

SEQ ID NO: 79281 - DNA, 19 bp, Homo sapiens
  chr16:69564030-69564049
  hypo
agtcttggccgggcgcgat

SEQ ID NO: 79282 - DNA, 30 bp, Homo sapiens
  chr16:69776566-69776596
  hypo
ctggtaaggtgcagccgaccttgcagatcc

SEQ ID NO: 79283 - DNA, 187 bp, Homo sapiens
  chr16:69791463-69791650
  hypo
gtccagctccactttcgcaatctccgctagggttcgtgtttccaagcggataaagccaaatccttaatccttatgaatgaagacttcgcctgcctttccatatttctcaaatagtttcctcatttcttcctcagtgatgtcgggaggaagatttcccacaaaaagacggcttcgttgggtgaaggtc

SEQ ID NO: 79284 - DNA, 33 bp, Homo sapiens
  chr16:6990605-6990638
  hypo
ttttcttttttgaggcggagtcttactctgtca

SEQ ID NO: 79285 - DNA, 228 bp, Homo sapiens
  chr16:700101-700329
  hypo
ctgtatgtgctctttcggcccctgcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttc

SEQ ID NO: 79286 - DNA, 64 bp, Homo sapiens; identical to SEQ ID NO: 44412
  chr16:700572-700636
  hypo

SEQ ID NO: 79287 - DNA, 140 bp, Homo sapiens
  chr16:70379985-70380125
  hypo
aatgagaccctgactcaaaaaagaaacgaaaaaacgcattgtgtgttgtgtttattggatggtggaattatggggtttacgggtcttctgttgcgttttggtttttgttttcttacctgttatcgcgttcctaacagtag

SEQ ID NO: 79288 - DNA, 136 bp, Homo sapiens
  chr16:70416085-70416221
  hypo
agttccatttttacacgaagtaggcctggggctcagagctggtgggggcagtcgtccagctgaaattcaactacatacactctccattctatttatgtttttttttcttttctttttcaagacagcgtctcattct

SEQ ID NO: 79289 - DNA, 126 bp, Homo sapiens; identical to SEQ ID NO: 44730
  chr16:70427606-70427732
  hypo

SEQ ID NO: 79290 - DNA, 19 bp, Homo sapiens
  chr16:70439156-70439175
  hypo
aggcacagcctggtgcggt

SEQ ID NO: 79291 - DNA, 30 bp, Homo sapiens
  chr16:70514821-70514851
  hypo
caagccagacagcctcgctcagctccttgg

SEQ ID NO: 79292 - DNA, 28 bp, Homo sapiens
  chr16:70522735-70522763
  hypo
gagccaccacacccggcccagctactgt

SEQ ID NO: 79293 - DNA, 77 bp, Homo sapiens; identical to SEQ ID NO: 44731
  chr16:70595623-70595700
  hypo

SEQ ID NO: 79294 - DNA, 140 bp, Homo sapiens
  chr16:70610992-70611132
  hypo
tacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggct

SEQ ID NO: 79295 - DNA, 50 bp, Homo sapiens; identical to SEQ ID NO: 44732
  chr16:70680482-70680532
  hypo

SEQ ID NO: 79296 - DNA, 32 bp, Homo sapiens
  chr16:70719509-70719541
  hyper
aggacacacagacaccgcggcgcgcggccaca

SEQ ID NO: 79297 - DNA, 30 bp, Homo sapiens
  chr16:70769908-70769938
  hypo
atgaatttggtaggccgtggtggcctggct

SEQ ID NO: 79298 - DNA, 69 bp, Homo sapiens
  chr16:70795276-70795345
  hypo
ctcacagtgccttggcgctcagaagaggaaagtgggctgaggctcagcttggaccgtcagcatctgaga

SEQ ID NO: 79299 - DNA, 3 bp, Homo sapiens
  chr16:71264576-71264579
  hyper
ccc

SEQ ID NO: 79300 - DNA, 92 bp, Homo sapiens
  chr16:71264580-71264672
  hyper
cactctccatgcgccgcccgagctgttgccgtccgttgccacggtaaccacggagccgcacagcctagcaagccgcgcgatgattggaggag

SEQ ID NO: 79301 - DNA, 23 bp, Homo sapiens
  chr16:71266650-71266673
  hypo
gggtgcagtggctcacgcctgta

SEQ ID NO: 79302 - DNA, 30 bp, Homo sapiens
  chr16:7137064-7137094
  hyper
gtgtgctgagctgtgcggtgtgaagagtaa

SEQ ID NO: 79303 - DNA, 30 bp, Homo sapiens
  chr16:71418717-71418747
  hypo
gatcttcacattttacgacaaggtaagaga

SEQ ID NO: 79304 - DNA, 22 bp, Homo sapiens
  chr16:71433525-71433547
  hypo
cgcgccccgcagctgtggttaa

SEQ ID NO: 79305 - DNA, 133 bp, Homo sapiens; identical to SEQ ID NO: 36250
  chr16:71459956-71460089
  hyper

SEQ ID NO: 79306 - DNA, 247 bp, Homo sapiens; identical to SEQ ID NO: 36251
  chr16:71460270-71460517
  hyper

SEQ ID NO: 79307 - DNA, 167 bp, Homo sapiens
  chr16:71715744-71715911
  hypo
gctcaggaacctcctcgaggctgtaacacgagagatccacggtactgattcgctgggacaccacctgaataatgtcaaagagaagagccttctgagctagtactggatgtctatcacccagcaaagaatggaatggcatttacacaaaaagacgctaattaaaaaga

SEQ ID NO: 79308 - DNA, 45 bp, Homo sapiens
  chr16:71841040-71841085
  hypo
actttttgccaggcacggtggctcacgcctgtaatcctagcactt

SEQ ID NO: 79309 - DNA, 104 bp, Homo sapiens
  chr16:71841325-71841429
  hypo
ttcgtctcaaaaaataaataaataaaaataaagacatactttttattcaagcatgctagactgcaaacatgcctttagaataaaagtgacgagattacgagtac

SEQ ID NO: 79310 - DNA, 23 bp, Homo sapiens
  chr16:71919058-71919081
  hypo
tggttggacgcacttctagtcaa

SEQ ID NO: 79311 - DNA, 140 bp, Homo sapiens
  chr16:72038633-72038773
  hypo
tatttatcctttcccatgtaaatagcgcaggcagatgaattaacgctgctgctggtgaagtagaacaccatgatgctggcgggggtgcggtgactccaccgtggagcagcagcgttcaactgtggcggttgcctggtccc

SEQ ID NO: 79312 - DNA, 39 bp, Homo sapiens
  chr16:721687-721726
  hypo
tccctgcaggatccacgtgccccccggctgcagcacgga

SEQ ID NO: 79313 - DNA, 30 bp, Homo sapiens
  chr16:72461127-72461157
  hypo
aacttgaaggcagagcgatttggaaggggc

SEQ ID NO: 79314 - DNA, 114 bp, Homo sapiens
  chr16:72461587-72461701
  hypo
taatgaatgagctttcgctgttaatgaggaataatcgtttggctaatgagctttgaaacattaagagaaaagaggttttttccgttaatcgctctggtgcgactgcatggatgg

SEQ ID NO: 79315 - DNA, 703 bp, Homo sapiens
  chr16:725275-725978
  hyper
gcagggagctccagccggtggcaacatgaaccgcagggagtactgggtcagcctggagggggagcaagcagtggtcagggaaggcttcctggaagaggtggcatcctcacaggcctgagcccgggaaggctgtgagagggcgaacggtcttgcatggggggttttaggtgccccccatccccgtgactccatttaccagcggctgccgtggaggtagtccagtgtgctggagctgcgccagagcgggggtgggggccggcgctgagacgcggtgctagctggaggcggttcctgtccggggtgtgcgtccgcgtgcagggtgcgcgcgtgtcttggccgcgcgtggcggcgtgtgcggcaggggcgggcaggcgggcgactcggtgacgcggcccaagcgcggcgccgagcggagcgggcggagcgggccggctggggcggagcggagtcgtccgcagagcagcccctcccggccgcggccgccgaccccggaccccggcccccggccaggctctatggacaggagctcgctgctgcagctcatccaggagcaggtgcgtcggggggtggtctggggagctggcaccgcccccaatgcggccctcctgccgctgagctgagcttgtgcgggaccgagctccccgaaagccccgctcggtacctacctcatccctccacgaccttggtccgtgtgtctgggacc

SEQ ID NO: 79316 - DNA, 467 bp, Homo sapiens
  chr16:726580-727047
  hypo
gggggcttgtggatgcggggagctgggtgagcctcacaggcaggggtgccatggggaggtccgtggcccacactcaggcccctgcccccagatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgggtgctgcagacctaccaccccgagtacatgaagag

SEQ ID NO: 79317 - DNA, 30 bp, Homo sapiens
  chr16:72697029-72697059
  hypo
cagcctggaattccccggcccaagtgatcc

SEQ ID NO: 79318 - DNA, 121 bp, Homo sapiens
  chr16:72835621-72835742
  hypo
tagctgttgatgaatcgttaagaatggagtggagattgccaaactcattccatctattttctttttaatagaaggcatttctgactagtgtggttggggagtccagcgggaatccgagaag

SEQ ID NO: 79319 - DNA, 70 bp, Homo sapiens
  chr16:72957744-72957814
  hypo
tactttgaattgcctcgtcctaccacgttcaagacgcggctactgggcaggtccacgtctttaagttgtg

SEQ ID NO: 79320 - DNA, 30 bp, Homo sapiens
  chr16:72963559-72963589
  hypo
cgacagggccctccacgcaagctggctgta

SEQ ID NO: 79321 - DNA, 30 bp, Homo sapiens
  chr16:72995364-72995394
  hypo
ccctgatcctttgcccgtaggtccccagcc

SEQ ID NO: 79322 - DNA, 30 bp, Homo sapiens; identical to SEQ ID NO: 44739
  chr16:73033457-73033487
  hypo

SEQ ID NO: 79323 - DNA, 82 bp, Homo sapiens
  chr16:73062471-73062553
  hypo
ccaacagacaggggacgattgttagaactcaagacacagaattccatctccaataacctcaaccgctcggagggattctcaa

SEQ ID NO: 79324 - DNA, 85 bp, Homo sapiens
  chr16:73099886-73099971
  hyper
cagggcgtggccccacggccggcaggagtccggcgcacactgggcctggagcgcactgactggggctctggctagccgggctacc

SEQ ID NO: 79325 - DNA, 28 bp, Homo sapiens
  chr16:73100271-73100299
  hyper
cggagccagcgtgcgcgtccctaatgcc

SEQ ID NO: 79326 - DNA, 15 bp, Homo sapiens
  chr16:73100575-73100590
  hyper
cgccccagcagtggt

SEQ ID NO: 79327 - DNA, 336 bp, Homo sapiens
  chr16:731331-731667
  hypo
atcgccaatctgcagcgaggttggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggaccctcaccccaggccgccctgtcttgggataattctgaatcaccgactcccgacacaa

SEQ ID NO: 79328 - DNA, 43 bp, Homo sapiens
  chr16:73397226-73397269
  hypo
aaaagctaactgttacgtattttaaaaacgattccaaattcta

SEQ ID NO: 79329 - DNA, 33 bp, Homo sapiens
  chr16:73422838-73422871
  hypo
cacagactatggccacggcgtcttagaggtttt

SEQ ID NO: 79330 - DNA, 25 bp, Homo sapiens
  chr16:73450459-73450484
  hypo
actcaatttagcagacgaaagttga

SEQ ID NO: 79331 - DNA, 1210 bp, Homo sapiens; identical to SEQ ID NO: 44416
  chr16:734741-735951
  hypo

SEQ ID NO: 79332 - DNA, 33 bp, Homo sapiens; identical to SEQ ID NO: 36062
  chr16:7354091-7354124
  hyper

SEQ ID NO: 79333 - DNA, 270 bp, Homo sapiens
  chr16:7354388-7354658
  hyper
tgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacct

SEQ ID NO: 79334 - DNA, 30 bp, Homo sapiens
  chr16:73558881-73558911
  hypo
gactgtctccaggttcgaggtagagctgtg

SEQ ID NO: 79335 - DNA, 205 bp, Homo sapiens
  chr16:73693831-73694036
  hypo
tggtcactgtaattacggaaggtgtatcatttcctaagctctctttgcattaagtgtatgccatacatacatcagacataattagcactttaggtgacaatgatttgatttctttccttgtaataaaagccctctgcgttggcatatacattcagaacgggaaattgaacactgttgctgtttattcacccgaggcaaaatttag

SEQ ID NO: 79336 - DNA, 17 bp, Homo sapiens
  chr16:73984305-73984322
  hypo
gagtcgcaggcaggccg

SEQ ID NO: 79337 - DNA, 27 bp, Homo sapiens
  chr16:740887-740914
  hypo
tgtgagccaccgcgcctggcctgtttt

SEQ ID NO: 79338 - DNA, 338 bp, Homo sapiens
  chr16:741169-741507
  hypo
ccaactcctggcctccgccttcccctgcccacctccagccatggcagcctccacccccattcccagcccaccaagccctttcctgcctcagggacattgtacgtgcgtgcgatgcctcctccacagagcggacctccctgaccactgccctaatgggcttctccatcactgtggcctccacggcacttgtcaccacccattcgtttgtttactggttgttgtcggtcacatacgagtgtgaattccaccaaggcaggaatcacattctggctcaatccccaccgaatgcccagtgcctgacacacctgttcaaccagttgctctcgttctttttttta

SEQ ID NO: 79339 - DNA, 30 bp, Homo sapiens; identical to SEQ ID NO: 44742
  chr16:74331835-74331865
  hypo

SEQ ID NO: 79340 - DNA, 30 bp, Homo sapiens
  chr16:74401355-74401385
  hyper
catcccggtacatcacgtttacatgcatgc

SEQ ID NO: 79341 - DNA, 20 bp, Homo sapiens
  chr16:74490343-74490363
  hypo
caccgcgcccggccctgacc

SEQ ID NO: 79342 - DNA, 30 bp, Homo sapiens
  chr16:74702004-74702034
  hypo
aagcaaaagggtgcacgcttcagaatattt

SEQ ID NO: 79343 - DNA, 179 bp, Homo sapiens
  chr16:7489013-7489192
  hypo
tggagcagagttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttcaccattgc

SEQ ID NO: 79344 - DNA, 152 bp, Homo sapiens
  chr16:74901411-74901563
  hypo
gccaaaccacgcatacagtaaggaagagacagcatggcgccagccaggcaaagaccccatctccataataagattacggtggggtgcccagcttcctcttgtgctaaacgtcacacctggtccaccctatccgtgggcgctacgtaaatcag

SEQ ID NO: 79345 - DNA, 240 bp, Homo sapiens
  chr16:75019623-75019863
  hypo
ctccgtctcggaaaaaaaaagaaaaaagaaaaatcaaagctcgtgcaaaccgaagatacctcttctcctgatgcctatcccatcgagatatttaaaagtctgaatgtgcaatttattgtttcatacaatacagcagcgcctcccgtaacaatgaaggtagacttaaatgtgagaatccagctgttttcttgatctgtagtccaatgctctacctgtgagctataccccctcctgcaatcc

SEQ ID NO: 79346 - DNA, 1062 bp, Homo sapiens
  chr16:750349-751411
  hyper
ggaggcacccacagccggtgacccccatcatgtgcccatgatcagaaggcgcggcctccggaggccgacatcacaacgtttgcaagggccggctggggtcggcacatgattcgacctcacggccgcccttaggggtggaggggtcgctacctcaggtttggggaaggaacacgaggctctgaggagcgaatttgccccaggtgtccggggaggcctggcgcggggctgcctcggttccctcccagagccggggagaggggatatcgcaggatgccggcgcccgaggcggcagcaccaggcccacgggcgccccagtctaaatatcctccgtgcccctagagcggggaccctcgctccccagacccggaagcgccgccttccccgccagggacgcctgggcctccgcagaccccgccggccggcgcgccacccgcgccagcaccatggacagcggccgccccagccgcgcgctcagggccaggcccgggctggcttccaccgcggacggctgcggggtcggggcagccccgcaatcccaaatcccggcagcccccgctcagcagggaggggccccgggggcgaagagtgggggagaagccgggaaggatccggaggaggcggcgggggcggcgccaggggaggaataatcccggcgcagtgccgatttaggttgaaaacgctcccagtcatgggcctgcacgtggagcgccggggctgggggaggcattcgcggggctcctttcccgccccgctcgggagctcacgtttgccggcgcccacagtcccgtccccacctccaggcctcagggtcgagatggagaaaccaagccgcactttgagagcccacaggagggaggggacaggctgaggagcggccgtctgggtatgggtccggggcctggcttccctcatccacacccgcagcgctgccagaaggcgctgctctgcctgtggtcagccctcgacccgtgtgcttggtgggagctgcatccccgcacaggcagccccactgctccccaatctcgcgtccacgttcctgccggcccccgctgctcctcacac

SEQ ID NO: 79347 - DNA, 30 bp, Homo sapiens
  chr16:75112923-75112953
  hypo
ccattcttatctacccggttcaagtaacct

SEQ ID NO: 79348 - DNA, 598 bp, Homo sapiens
  chr16:75148553-75149151
  hypo
tgccacagagagaggcgtccgcgcctgggtctggagggcggcgtacagaaggcagcctcagggaccggaggtcctttccctcgggctgggggaggaaggtcccctgaaccccagacacagccctgctcccacggtgccctcagggtcccaggaaaggttcgcgagtcctacccacgggaaaccagaggccgctgtcccgcaggtgggcgttgagggctttgcgggtgacacctggctccaccaccacagagaagtcctcctggttcagctccaggattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagccacaggtgtgccaaggtgtgctgggaccatcctcgggccgggcgagggagccccactgtacctgcacagcacagacgccaccctcaagcccggtgccggtgccgaatgggatgatgg

SEQ ID NO: 79349 - DNA, 37 bp, Homo sapiens; identical to SEQ ID NO: 44746
  chr16:75171636-75171673
  hypo

SEQ ID NO: 79350 - DNA, 38 bp, Homo sapiens
  chr16:75178915-75178953
  hypo
ttcaagttttaatcacgttgtagcgtgtaccagaacgt

SEQ ID NO: 79351 - DNA, 120 bp, Homo sapiens
  chr16:75183609-75183729
  hypo
ccgcgtccggccagacacaatttattgatgtaactgttcctctaaatactactttaactacatcactcaaatttttatatcttgtattttcttttctgttgttgttgtttttgagactga

SEQ ID NO: 79352 - DNA, 30 bp, Homo sapiens
  chr16:75227098-75227128
  hypo
ttcggcactgcagcacgcttcaagtgctcc

SEQ ID NO: 79353 - DNA, 87 bp, Homo sapiens
  chr16:75403259-75403346
  hypo
aatatagcaaaagttcgcttcaaaaaaaacaaaaacaaaacaacccacaaaaaaacaaaaagccaaaaaacccgcacactgctatac

SEQ ID NO: 79354 - DNA, 35 bp, Homo sapiens
  chr16:75465061-75465096
  hypo
acactgggcctggcacggtggctcacgcctgtaat

SEQ ID NO: 79355 - DNA, 34 bp, Homo sapiens
  chr16:75465516-75465550
  hypo
acagagcgagacactgtctcgaaagaaaaaaaaa

SEQ ID NO: 79356 - DNA, 39 bp, Homo sapiens
  chr16:75469080-75469119
  hypo
gattacaggcgtgagccaccgcgccgggcaccttcaagg

SEQ ID NO: 79357 - DNA, 198 bp, Homo sapiens
  chr16:75528671-75528869
  hyper
gcgatgccctttccacgttgctgatggaaaagccactcccagctcttcccgccaccccaggtccccggtgcaggacagaggagcgtccccagctgtgccaccagcccggcccccagccgacccgagtgtggggacatcccccgcggagaatgaagaaccaacgtaccccaaagcttggcggctctgcccgagctgcag

SEQ ID NO: 79358 - DNA, 451 bp, Homo sapiens
  chr16:75528922-75529373
  hyper
cgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtcccgaggtggccagcgggagctagcgccgtgggggaaggaag

SEQ ID NO: 79359 - DNA, 32 bp, Homo sapiens
  chr16:75549843-75549875
  hypo
caacaagagctaaactccgtctcaaaaataaa

SEQ ID NO: 79360 - DNA, 166 bp, Homo sapiens
  chr16:755523-755689
  hyper
tcctggctcatgccacgctgtccgccgggcgacctcccgtcatggggagcccggcatgggcgtcggcgcgcgggggccgccggggtgctggactggccggcagggcccggccgcgccctgcgccccgcgtcccgtcctggccgggccccctcggcagcgcacggaa

SEQ ID NO: 79361 - DNA, 144 bp, Homo sapiens
  chr16:756288-756432
  hyper
ctcccgcccagcccacggcaaggacccttcacagccctcacaccccccgcgcacctgctgcgtgcccggccggaagcccctcattggagaccctggcacacccgcagagcgcgaaaacaagtgactgcacggatcagttcagac

SEQ ID NO: 79362 - DNA, 99 bp, Homo sapiens
  chr16:75658303-75658402
  hypo
ctggattacaggcgtgagccaccgcacctggctgccgagtctcaatattttaaaaaatacttatgttctgttctgtttttaatgcgaagtttaagaaat

SEQ ID NO: 79363 - DNA, 120 bp, Homo sapiens
  chr16:75666903-75667023
  hypo
gccagatggccctcttggggggaggttgaccaaagatactgctccctaatggtatttactttagaccatggtacctggactttaataattcctagaactcctctcttacgatgttaatta

SEQ ID NO: 79364 - DNA, 99 bp, Homo sapiens
  chr16:75680068-75680167
  hypo
cccaactataaacttcgacaatttctcttatactttttctaagatatttgaagcacaaagccagggacacaaaaggaaacatcaggccaggggtggtgg

SEQ ID NO: 79365 - DNA, 69 bp, Homo sapiens
  chr16:7568309-7568378
  hypo
aaacctgtaccctcccgcccagacgcactccgagcagagcccggcggacacgagcgctcagaccgtctc

SEQ ID NO: 79366 - DNA, 30 bp, Homo sapiens; identical to SEQ ID NO: 44750
  chr16:75733411-75733441
  hypo

SEQ ID NO: 79367 - DNA, 32 bp, Homo sapiens
  chr16:75787877-75787909
  hypo
cacctgggcaacaagagcgaaactccatatca

SEQ ID NO: 79368 - DNA, 30 bp, Homo sapiens; identical to SEQ ID NO: 44418
  chr16:760916-760946
  hypo

SEQ ID NO: 79369 - DNA, 41 bp, Homo sapiens; identical to SEQ ID NO: 36256
  chr16:76311161-76311202
  hyper

SEQ ID NO: 79370 - DNA, 30 bp, Homo sapiens
  chr16:76685067-76685097
  hypo
ttcctactagagtatcgatatgagttgaac

SEQ ID NO: 79371 - DNA, 36 bp, Homo sapiens
  chr16:766969-767005
  hypo
ggccgcatgcaccagcgacttcggtgagtgtccccg

SEQ ID NO: 79372 - DNA, 955 bp, Homo sapiens
  chr16:77245975-77246930
  hyper
gtgtagccaagaggacggccaaacggggaggcctcctctttgtcctcgcagatgctggagcagcgactggcccgggagatccgtgccctggagagaagcaaggagcagctgctctcggagagtgagcctcccgcgccaggtgggcggggggagggggatgtgcccgggcctcggccctgcccctgacgcccgcccaccgacagggaggctggtgcgcgccaagctgcgggaggtggagcggcggctgcactcgccgcctgaggtcgagggcgccatggcggtgaatgacgggtgagaggggaagggaggagtgggcgaggagggcaggggcagggcggaggggaacccgcccaggtcccccgctccgcccccgactgccgcttccccggcctgtgcctccctcggcgtcgtcgggtctccgcgtctcggtggcttcctcctcgtcccctggactctcgctctcttcctcctgtctcctcggccccttctccgcaggctgaaggcggagctggagatattcggggagcaggtccggagcgcccccgaggtcggggccggcgagggagaggtagggagcccgaggaagggaggcggggcgggcagggaccgagtcaggagagagcgggcgggggtcctgggagcggcccccgagagtggggtctgtggggagcagggcggccccggggacagaggaagccgcggtggaggcctagggcagacgcgggcggacgcgaggagcgtaggaacctggtccgcagcctcacccagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatgctcgcgttctccgcggagtctgtgctac

SEQ ID NO: 79373 - DNA, 129 bp, Homo sapiens
  chr16:77247382-77247511
  hypo
tctgttaaatgtgtccgccactctggaggccggcatttgggacccaaatccaaaggcacccagcagcaggctgcggccattgactgagcatgtactgactaagcaggcatttgccgattgcctgctggg

SEQ ID NO: 79374 - DNA, 67 bp, Homo sapiens
  chr16:77247715-77247782
  hypo
tctggagaaggccggcgtggtagagtggaatgaggtagagtgggatgggagacgacactggagagtt

SEQ ID NO: 79375 - DNA, 25 bp, Homo sapiens
  chr16:77372556-77372581
  hypo
agtaagtggcttggccgggcgcggt

SEQ ID NO: 79376 - DNA, 197 bp, Homo sapiens
  chr16:77468261-77468458
  hyper
agggtcaaagtgctgcgaaaggcccttcttggggatggggggcaaatacgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggc

SEQ ID NO: 79377 - DNA, 92 bp, Homo sapiens
  chr16:77469028-77469120
  hyper
gggctcgtccgagcccccgggctggtgcaagggcgtgggattcccggctccagctctgagggagggggcgaagggggcggggaggctgggtg

SEQ ID NO: 79378 - DNA, 273 bp, Homo sapiens
  chr16:775524-775797
  hypo
ctggtgccatctcctcgcagctccagctccagtacccggctctccagccgaaggatctgtgggacaactggcatgagcaggtgcacctgcccgcgggccacctggggtaggtgaacattcacccggtgcacgctcaggggcgcgcagcactcagaggcaggctgagacccacagatgccatgtgcgtgtgcatgcccatgcagggcacgtgtcctgggcctgcaccccccgtcccccatgcactgaggctggttcacacggctgctcacctca

SEQ ID NO: 79379 - DNA, 30 bp, Homo sapiens
  chr16:77753074-77753104
  hypo
ttgtaaatatcacagcgatatttcactgat

SEQ ID NO: 79380 - DNA, 200 bp, Homo sapiens
  chr16:77753871-77754071
  hypo
acagcgatgtttcatcggtatcacagtttgtaaaccttggatattataaacatcacagcgatatttcatttatatcacgatgtgtaaacactggatactataaatatcacagcgatgtttgcttaatatcacggtgtgtaaacactgtatattacaaatatcacagccatattttattaatatcacggtgtgtacacact

SEQ ID NO: 79381 - DNA, 302 bp, Homo sapiens
  chr16:77822117-77822419
  hyper
agagggcaaccttgtcgcggtaaggcatcctccaggcccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggc

SEQ ID NO: 79382 - DNA, 900 bp, Homo sapiens
  chr16:77822420-77823320
  hyper
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgcttaacagaattaaaaatatatgtattaagaaccgcaagcccactgtgtgccagccgccgttggtagttttacacgtgcgatcttatttaatacttcctgggacctaatgagtcaggtgccatcatgatccgtttacaggtaagaaagccgccgctcagcgagaatgagtgatt

SEQ ID NO: 79383 - DNA, 30 bp, Homo sapiens
  chr16:78057993-78058023
  hypo
atactgtacttctttcggtgaaagattaaa

SEQ ID NO: 79384 - DNA, 408 bp, Homo sapiens
  chr16:78079769-78080177
  hyper
gatggaatgctgccccggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcggcggccctggcagggcggtgcctggggtgggcgctgggcctccaggcctgcagccacgcttggcgctgtccgctagggccaggtgctgaagtgttggccgcgagcggagctgctgcagcgctggcttccccgggccgctgcgggtggacttggacaacataaagggctgattgagcggggccactttttcgcccgcgtaaagtgtcct

SEQ ID NO: 79385 - DNA, 30 bp, Homo sapiens
  chr16:7827953-7827983
  hypo
agaggatacatgctgcgacaatctattgag

SEQ ID NO: 79386 - DNA, 30 bp, Homo sapiens
  chr16:79253226-79253256
  hypo
gagtgcttaccaaaacgcctatctgaaatt

SEQ ID NO: 79387 - DNA, 48 bp, Homo sapiens
  chr16:79253546-79253594
  hypo
ccacttcctgtgtgacgctgtgccaccattgtacgtctccactccaag

SEQ ID NO: 79388 - DNA, 52 bp, Homo sapiens
  chr16:79623822-79623874
  hyper
ctccctgggcactgccgcgggtctgggactgcaggcccggcccaggactgag

SEQ ID NO: 79389 - DNA, 213 bp, Homo sapiens
  chr16:79632604-79632817
  hyper
tagcaagcccacacccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggt

SEQ ID NO: 79390 - DNA, 504 bp, Homo sapiens
  chr16:79633073-79633577
  hyper
cgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgc

SEQ ID NO: 79391 - DNA, 51 bp, Homo sapiens; identical to SEQ ID NO: 36268
  chr16:79633792-79633843
  hyper

SEQ ID NO: 79392 - DNA, 30 bp, Homo sapiens
  chr16:79634334-79634364
  hyper
acacttcatgcttctcgcctcctcttctgc

SEQ ID NO: 79393 - DNA, 936 bp, Homo sapiens
  chr16:79634758-79635694
  hyper
aacaaggaaacttttcggagctgtcaatcagggcccaatcagctgactgtcagctgggacgggctggcttaacccttcctgcgccgctgcctacccgggagggaacgaggcccggcgcaaagtttggtgtaagaggggaaggagtttttccagaggggcttcggcaatccgggcggacctgggagggcggtttgcttttctttggagcgcgagacaggcctcccatccggagccccagctcgctgggggctcactcggctgggattggcctgattcccctcccctgcctgccctccacccccaggattgtgaattcgcctcccagcttttcctcctcgcaccaactctggtacccaggtgtctgccggggaccttccttccctgagcctggccgtgcccggcgctcaaacttggccccaactctttgtccgtctctcgggcgcccgtgcggggaagggaccgggaagggagggatgcagtggggtgtccggatcggggctgcgggctgggcgccgcccggccatgcgcctgcccagaaggctgggcatccgtggagagggaaagcccattttatccctctctttacaacgaggtaaaataagttgtttagaggccattcttcacggagaccggctgcccgctggcgtcgcgtgcccttggacagagcgagcgcctatgcgagataactccggggaagctcaaagtcaggtcagccgggctcagccttccggctcctgactggccggagtttggcctttgagactcatattgcgcgctcgctctctctctctcttacacacacacacacaaacacacacacactcacactcacccgtccccttacgaaatctgacctctgtttatcagggtcaggcgcgccctttgcacttttacgtttcctttaattatttcggacttgatcgtggcagggagcaa

SEQ ID NO: 79394 - DNA, 30 bp, Homo sapiens
  chr16:79635937-79635967
  hyper
tctaagattttaaagcgataggcaagtcga

SEQ ID NO: 79395 - DNA, 36 bp, Homo sapiens
  chr16:79674118-79674154
  hypo
gtctgacttaagaaccggaggctggccgggcgcggt

SEQ ID NO: 79396 - DNA, 215 bp, Homo sapiens
  chr16:79804242-79804457
  hyper
gacagaggcaagacacgcagcgagtgctctcgcgagagttcaccgagttgataaaattattaaaacacaaaatacacatttgcgtgagggggaaaaaatacccgcttgtccgtcctgtcccttcaggctgcgcaacgctggagggcgatgggagctccacacaggtgggacgagcctagcaggtaaaccttccaccggcccgagctccgcgacgc

SEQ ID NO: 79397 - DNA, 126 bp, Homo sapiens; identical to SEQ ID NO: 44420
  chr16:798233-798359
  hypo

SEQ ID NO: 79398 - DNA, 194 bp, Homo sapiens
  chr16:79880975-79881169
  hypo
ctcccactgctggtgcgggctcctgtagccaccgtggagggtataagcatcagaaatggcagccccttgctgcctgtgatctgtgtcttttgccttcctgaggtgggagggttcagaaagcccaacccatccccacccttccaggacattctttcttggccctgcgctggcatggctgtcgggatcgacagtcc

SEQ ID NO: 79399 - DNA, 30 bp, Homo sapiens
  chr16:80015013-80015043
  hypo
aaacaaagcagcattcgagctgagccgtgt

SEQ ID NO: 79400 - DNA, 444 bp, Homo sapiens
  chr16:80574608-80575052
  hyper
tcagcagtttttgaacgaataagtggttatcacattaattcgtgcctcaatgaatgaatgaatggacaaacacaggccgggagcctgacccacttccctcttccctcccgggacccactgctccaggattgggcgaacctcaggtgagcgcctgctcccctcttccgcgaaccttcgcctacggcggccgggaggcatcaggagcgcggtcagggcgaaaaagccgactcgcgagcgcgcaggcgcagccctgacgcttccgtggggccacttccttttttgtctcctagcaacggcgggtagcgttgttgacatcccgggaggctgtgccgccggcctgagcccagagtttcgcggcctccgcgatggtaaatctggggtctccgtccacgccccgccgttccaagcacgccgaccgtcaaggaccttcgcacccagcttctg

SEQ ID NO: 79401 - DNA, 225 bp, Homo sapiens
  chr16:80641678-80641903
  hypo
gctatagatgttttgcgtttttgtggtgtttaggactttctttgaaagcagtgacgctaccctagagtatccatctctcctgtgaggtttctctgcctggagatgatggacaatttgtaataatgctgactgtctccctctgattgaagctgtcaatactgagaaaaggcatttgttaaattgcaaagggtcttttgcttattccctgtgcgacctctagcaagt

SEQ ID NO: 79402 - DNA, 135 bp, Homo sapiens
  chr16:80644760-80644895
  hypo
gcccccagtggaccccgggcagaccttgctgaggcaggcacaacacagaaggcccagcaccctccccggcatgccaggctcgcaggggccactccacgccactgccatggcctcatccctcgccctctccccacc

SEQ ID NO: 79403 - DNA, 116 bp, Homo sapiens
  chr16:80654735-80654851
  hypo
ggccgctgcagaacacgctccccactgcgctgaggagcagcagtttgctgtcgtctgtggctgcgttgcagagcgctcgccggacttctttcatgatctgccggcagagatgaatt

SEQ ID NO: 79404 - DNA, 30 bp, Homo sapiens
  chr16:80671402-80671432
  hypo
aaagaactggattaacgaaaaaagaaaaaa

SEQ ID NO: 79405 - DNA, 181 bp, Homo sapiens
  chr16:80704532-80704713
  hypo
agaaccccggggctccgtggacggcaacgtcttaatgacacgaggtgcgcaaacctatttccaggctcattttgccccagggtctcgattttctttctgggacaggatgaaagaaagagaagccatgttgcaacataaaaagtgtgaatcgaggcctcgaggctggcgctcccaggaacac

SEQ ID NO: 79406 - DNA, 115 bp, Homo sapiens
  chr16:80718633-80718748
  hypo
agtcctgtaagacaccgtcttggtggccctgtcacctcctgaagagggcttgcctgaataccctttttttggcttggccaggggagggttaattcgcttccgtttatgggaggtc

SEQ ID NO: 79407 - DNA, 29 bp, Homo sapiens
  chr16:80837395-80837424
  hyper
cgtccgagctggtgcgggggcagcaggtg

SEQ ID NO: 79408 - DNA, 44 bp, Homo sapiens
  chr16:80838149-80838193
  hyper
gtgcgcgtgtgtgtgcgcgcgtgtgtgtgcgagtgtgtgtggtg

SEQ ID NO: 79409 - DNA, 189 bp, Homo sapiens
  chr16:80871876-80872065
  hypo
gttacgtactaggtacggaagatacggcagtgagcaaaaccaatcatgttccttgtcctcatggggcttacagtggggggagaaaattataagcaaaaagaaaatacaaagaaatacaacacagaaagcacaggcatgaggaaggagggcacggttctgggaaggcttcttggccgaagcaaccagaca

SEQ ID NO: 79410 - DNA, 665 bp, Homo sapiens
  chr16:809389-810054
  hypo
tgttcagggctcagccgtgtctacggggccctccgagctcttcctggaccctcctcggctccttcagttcagggctcagctgggcacgtgggcgcctccttggctcctccggctcaggcctctcctcgagctctgggccctgagtattctgggctccttccttggtttcctttggcctttggccgggaaagttgtgggtgtccgtggcagcctgggccacttcacagccccgcagccaacctgcggctccttcagagcaaagctgtgtggacacaaagggaacgccactcggagctggcctctccctttacctgtgagttcccgcccaagccggctgccttctgtcccctccccagagcccttgggtaactggtttgctacaagagtgtctggaatttttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggagg

SEQ ID NO: 79411 - DNA, 30 bp, Homo sapiens
  chr16:80965838-80965868
  hyper
gaaaggggagaggagcgagagagagaagag

SEQ ID NO: 79412 - DNA, 32 bp, Homo sapiens; identical to SEQ ID NO: 36273
  chr16:80966399-80966431
  hyper

SEQ ID NO: 79413 - DNA, 16 bp, Homo sapiens
  chr16:8097095-8097111
  hypo
agcattagggccaggc

SEQ ID NO: 79414 - DNA, 90 bp, Homo sapiens
  chr16:81042175-81042265
  hypo
catgttggcctgggtggtcttgaacgactgacctcaagtgatacaccacgcccggcgcgctcccggcccctcgcccgtgttcttaatggg

SEQ ID NO: 79415 - DNA, 22 bp, Homo sapiens
  chr16:81111435-81111457
  hypo
aggcgcggtggctcacgcctgt

SEQ ID NO: 79416 - DNA, 100 bp, Homo sapiens
  chr16:81230844-81230944
  hypo
actaaaaatcatgcccgagggtggagctttaacatgctaatgagacataccacacatcaagaagcatgtgaccagactgcacaggcgctgaacattcccc

SEQ ID NO: 79417 - DNA, 30 bp, Homo sapiens; identical to SEQ ID NO: 16070
  chr16:81533258-81533288
  hypo

SEQ ID NO: 79418 - DNA, 52 bp, Homo sapiens
  chr16:81557303-81557355
  hypo
ttgtctggagagcaccgtgcctgttctccaaccacctcgtagcccctggtgg

SEQ ID NO: 79419 - DNA, 150 bp, Homo sapiens
  chr16:81564391-81564541
  hypo
tttgtgtgctaggcacgtaccctcttttacatacattatcttcgatcagttcagcttcttctgcataaaaaagaaatttctctaccgtcccagggagaataattggaaaagcgagccctgagtactcagcccacccgcccttctcctgct

SEQ ID NO: 79420 - DNA, 151 bp, Homo sapiens; identical to SEQ ID NO: 44759
  chr16:81569552-81569703
  hypo

SEQ ID NO: 79421 - DNA, 66 bp, Homo sapiens
  chr16:815699-815765
  hypo
gccgcgtggcggcaacgctcctctcgggacccatcctggcggcagcctgaacggaccatcctccgg

SEQ ID NO: 79422 - DNA, 30 bp, Homo sapiens
  chr16:8158291-8158321
  hypo
tttttttttaaccctcgcaactggggttta

SEQ ID NO: 79423 - DNA, 223 bp, Homo sapiens
  chr16:816004-816227
  hypo
gaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataa

SEQ ID NO: 79424 - DNA, 30 bp, Homo sapiens
  chr16:81615132-81615162
  hypo
ataatcttatggaaccgcagtcataaatgt

SEQ ID NO: 79425 - DNA, 30 bp, Homo sapiens
  chr16:81619949-81619979
  hypo
gggtgctattatcatcgaaacagcgatagt

SEQ ID NO: 79426 - DNA, 120 bp, Homo sapiens
  chr16:81627222-81627342
  hypo
aggcttgaaagtaatcgcctccgtgtattgagtgcccgccgaccacctggcgcgtctgggcattgagctcattggccgctggcacaaatggatcctcgcctcacccggtgcctgcctgta

SEQ ID NO: 79427 - DNA, 200 bp, Homo sapiens
  chr16:81632912-81633112
  hypo
gaccaaggcccaaaccggcccttctaggatcatatcgttacctgccactttgcgtttgctgtatgactttccgtttgtgagattaaaaagaacatgaaatattttgacgggccttccccaaatgagcatccatgggtttctgccttggaggccaagctgatctataggtgtctgaggacctgctgcgtggggtagcaaca

SEQ ID NO: 79428 - DNA, 30 bp, Homo sapiens
  chr16:81694683-81694713
  hypo
cggagagggcatgcccggcacccattctta

SEQ ID NO: 79429 - DNA, 30 bp, Homo sapiens
  chr16:81700035-81700065
  hypo
attcagacaggctctcggggcttcaccata

SEQ ID NO: 79430 - DNA, 30 bp, Homo sapiens
  chr16:81739542-81739572
  hypo
gaccagtggtggcagcgtcttctgggggct

SEQ ID NO: 79431 - DNA, 165 bp, Homo sapiens
  chr16:81779848-81780013
  hyper
ataacttcatctactcgtgacacgtgggggtccgccgccgccactggcagggtgccttgagtgcttgagttttcgcccccagcacaggtggagaacccaactcccagaaaacatctggggcggaaacggaagcatggccgcagcggtgaacgcactgcattctgg

SEQ ID NO: 79432 - DNA, 197 bp, Homo sapiens
  chr16:81813400-81813597
  hyper
cttgtgcccagagctcgcggacgctcggagccacacttccctgtctcacttcggtggttgcgggtggcgggtgggagcgataccgcgggaggcgcagtccttcccggagacttttggagagcttgcaggacactcgcgatgcccgctccgcagctgtctgcgtaattatgcgtgtgtctgtgcgtgttgtgttttgt

SEQ ID NO: 79433 - DNA, 30 bp, Homo sapiens
  chr16:81901263-81901293
  hypo
tccttttgcctgggacgtgttctcccttgc

SEQ ID NO: 79434 - DNA, 102 bp, Homo sapiens
  chr16:821742-821844
  hypo
ccataagcccaggggcgccaaaccttgtcagcaatgccagaagctggaggaggcaggaagggtcctccctgcagggttcagagggggcggggactgccagca

SEQ ID NO: 79435 - DNA, 189 bp, Homo sapiens
  chr16:8222706-8222895
  hypo
aagtggctaggctcacggccgccttccaactttatgatggagaacggctcccttcaaatgtaaaaaccatcactcagcaaagcgtggcaggttggggtctcatctgtccaaatgtagcacacacattcattttgatttcagctgtgtccaattcgctgcctgcatatgcaatatcgcacacacctgagc

SEQ ID NO: 79436 - DNA, 16 bp, Homo sapiens
  chr16:822480-822496
  hypo
ccgtctcaaaaaatga

SEQ ID NO: 79437 - DNA, 213 bp, Homo sapiens
  chr16:822897-823110
  hypo
ggttctccagggccacgtcggaggccagcagagccatgaccgtgtcctgggaggtgatgctccactggccgatctcggtgcgggagtagaggtagaccagcgaggtgatgagccgcagctgatcctccgggaggccttgtgggtagatctgagcaggtgggcagggctaggcagggtcagcagaggtgccgcgcccaccggcctccctgtccc

SEQ ID NO: 79438 - DNA, 30 bp, Homo sapiens
  chr16:82336003-82336033
  hypo
agtgcatatggcttccggcaggctgcctgt

SEQ ID NO: 79439 - DNA, 30 bp, Homo sapiens
  chr16:8234670-8234700
  hypo
aaaataaaataaaaacgaagtgtttgagtg

SEQ ID NO: 79440 - DNA, 145 bp, Homo sapiens
  chr16:824015-824160
  hypo
caggccccctctttgaccccttcccctccacttctgaccttggtcagaccttggctttccctgagttctaaccaagaacttgtccaaactacttctctgaagtcagccaggcccgagggaaaagctggaccggtgaggtgcaggg

SEQ ID NO: 79441 - DNA, 480 bp, Homo sapiens
  chr16:824923-825403
  hypo
gcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctcagcagctccacgtccccctgggcggcacggcggatgaaggcccggcagtcggcttcccgcacctggctcaggctacaggtgagtgtgaggctgtcaggccgactgggggtggggccggacctcccagcagccctgagatgcccctggggctttgagggcccccaggactcctgtggccgggtggccgggcag

SEQ ID NO: 79442 - DNA, 194 bp, Homo sapiens
  chr16:82540089-82540283
  hypo
attcagtgggtctggcgcagtgcctgagaatctgcatttcttacaaattctgtttgggttctgatggcctgggagccacacgtcgagaaccactggtttagagaattttgtgcaggccagtttagttcatttctggctgttcttgaacccaaagaacctttccattgttttagtgttaccgtccctcctccttc

SEQ ID NO: 79443 - DNA, 426 bp, Homo sapiens
  chr16:82660301-82660727
  hyper
taggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgc

SEQ ID NO: 79444 - DNA, 176 bp, Homo sapiens
  chr16:82660728-82660904
  hyper
ttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcc

SEQ ID NO: 79445 - DNA, 233 bp, Homo sapiens
  chr16:82661179-82661412
  hyper
ctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccc

SEQ ID NO: 79446 - DNA, 327 bp, Homo sapiens
  chr16:82661468-82661795
  hyper
cggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtccccca

SEQ ID NO: 79447 - DNA, 181 bp, Homo sapiens
  chr16:83151734-83151915
  hypo
ctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtc

SEQ ID NO: 79448 - DNA, 169 bp, Homo sapiens
  chr16:83197025-83197194
  hypo
gctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttcta

SEQ ID NO: 79449 - DNA, 221 bp, Homo sapiens
  chr16:8322627-8322848
  hypo
aaccccaaggtccaccgaagttcagtgacttagccaaaaatcacactgcaaggaaatgtcagagctggactagaatcctgtctcgagacatacttctttaatataccaccccttctttcgcagatgtatctttagaccagagtttctcaaacttagcactgctgacatttggggccagaaatactgcattgtcgggggctgccctgcgcattgtagaatgt

SEQ ID NO: 79450 - DNA, 30 bp, Homo sapiens
  chr16:83566510-83566540
  hypo
cctgcatctgagcagcgtggcttgttagtt

SEQ ID NO: 79451 - DNA, 28 bp, Homo sapiens
  chr16:83670814-83670842
  hypo
ttaaaatatcaaaaacgtctaatagaaa

SEQ ID NO: 79452 - DNA, 250 bp, Homo sapiens; identical to SEQ ID NO: 44427
  chr16:837308-837558
  hypo

SEQ ID NO: 79453 - DNA, 32 bp, Homo sapiens
  chr16:83842937-83842969
  hypo
tctggaaaagaatatcgcggacctcatgacac

SEQ ID NO: 79454 - DNA, 343 bp, Homo sapiens
  chr16:83968763-83969106
  hypo
gtgtagcacctaaagcgccaatgagactgtgtagaaaaatgtagctgcgtgagcgggagggagttccggtttcatgcagggagcgctggcctggctgagaagacgctggagcacagacctgaattcactgaggcagcgtcgtgtgggcgtctgagggaacagtgttccaggcacagggaacagccagtacaaaggccctggggtaagagtcaatcaggagcagggaggagcccagggagatggagacggggacaagggacccagctcagcggtgacttgtcgatatccggcgtggtcagcagagggctttgttctggtgtgggtgtcccggccgctgtgtgga

SEQ ID NO: 79455 - DNA, 162 bp, Homo sapiens
  chr16:83974810-83974972
  hypo
ggtgaccagcagagacgcaatgtcgagccacagaagccaggcacaagagagaacgtcctgcgcggttccatctatgccaacatcgagaacaggcacaactgatgtatgggacggaagtcagaaaaggggttgactgctgagccgggcccggtggctcacgct

SEQ ID NO: 79456 - DNA, 125 bp, Homo sapiens
  chr16:84001778-84001903
  hyper
gtgggcgccgctccccggggctggagccggcagagggcgctccgggctcgctggacacccgcgcttcggcctctgctgcgcgccgcgagtgggaggggggactttagaagcggggagagcaggag

SEQ ID NO: 79457 - DNA, 66 bp, Homo sapiens
  chr16:84002378-84002444
  hyper
ggagtcgctggcccccgccgcccccgcggaccccggcccagcctcgccgcgcgggggcaccgccgt

SEQ ID NO: 79458 - DNA, 30 bp, Homo sapiens
  chr16:84067071-84067101
  hypo
acactgccagagacacggggagagctgagc

SEQ ID NO: 79459 - DNA, 30 bp, Homo sapiens
  chr16:84074841-84074871
  hypo
caggcaaggccggcccggctctgtgtgggg

SEQ ID NO: 79460 - DNA, 41 bp, Homo sapiens; identical to SEQ ID NO: 16073
  chr16:84075186-84075227
  hypo

SEQ ID NO: 79461 - DNA, 30 bp, Homo sapiens; identical to SEQ ID NO: 44764
  chr16:84129364-84129394
  hypo

SEQ ID NO: 79462 - DNA, 30 bp, Homo sapiens
  chr16:84131007-84131037
  hypo
tcaagatggaaaagacgcttactgctgaag

SEQ ID NO: 79463 - DNA, 39 bp, Homo sapiens
  chr16:84148968-84149007
  hypo
cctggggagtgcagtcgtttgacacgtgtctgggtcagg

SEQ ID NO: 79464 - DNA, 30 bp, Homo sapiens; identical to SEQ ID NO: 44765
  chr16:84152910-84152940
  hypo

SEQ ID NO: 79465 - DNA, 58 bp, Homo sapiens
  chr16:84153336-84153394
  hypo
acctggaggtgaaaacgggaagatctggactggcaaccaaagtcgaacatgatggaag

SEQ ID NO: 79466 - DNA, 102 bp, Homo sapiens
  chr16:84328322-84328424
  hyper
tgcctgggctgcagacgccctggttggagcgtctggggccagatgttatagggcaagctaaaaataaccgggcaggccagccaccatcgaggaaggggcatg

SEQ ID NO: 79467 - DNA, 398 bp, Homo sapiens
  chr16:84402023-84402421
  hyper
ggcgagctcgcggggcggggccgggtgagccggcacctccctgtgcgcagccccgccccaggggcggggcctcacctgccgcgggcaggtagacagctacctggtaaccgggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttggtgagtccccgcgactccgcgccgggcgtgcgacccgaccccccatcccctccgtcgtaaccgtccccggcccgagaccccgcgttcgcgctgcgatccgc

SEQ ID NO: 79468 - DNA, 30 bp, Homo sapiens
  chr16:84483442-84483472
  hypo
acttaagagtggacacgttagtaagtaaac

SEQ ID NO: 79469 - DNA, 168 bp, Homo sapiens
  chr16:84573769-84573937
  hypo
tgctggcagaagacacgagcctcctgggtcagagacaagtgactttattactcgcagcacagcaagtagcatgagctttatgtttgcatcggtttcccttgtccccaagtcccacaggggccatgcaaaggggcccggaaggggtgggtgttgcgcacacagcacatt

SEQ ID NO: 79470 - DNA, 654 bp, Homo sapiens
  chr16:845850-846504
  hypo
gggtgggggattccccgcctgctgccctcctgtcctaggtgagcacacatttgtacagcctgctcagctccctgtctgctgcctcccatcccctaggtgagcacacagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatca

SEQ ID NO: 79471 - DNA, 30 bp, Homo sapiens; identical to SEQ ID NO: 44767
  chr16:84593218-84593248
  hypo

SEQ ID NO: 79472 - DNA, 122 bp, Homo sapiens
  chr16:84593455-84593577
  hypo
cctgccccagagaggcgcacagttagtgggggaggggagaagcaactggaggagggagggaagagggcggactcattccccatggctgccacagtcagtcaccacaccgggggctcaacaca

SEQ ID NO: 79473 - DNA, 194 bp, Homo sapiens
  chr16:84633325-84633519
  hyper
actttacagagactccggagaggttatgcaaacacggctcaggaagggaaaaaacaacccacacaccaaaaagctgagctgtcagcttccaccgagggagctccctggagcgaggatgaaaggaaatgggaaagaattcttacatcctgctgcccagagcaaggggacagctgggcagtcgccatggcagcggc

SEQ ID NO: 79474 - DNA, 78 bp, Homo sapiens
  chr16:847008-847086
  hypo
gagaaaggggtgcaccgacctgccccacgcaaccatgagcagcggctggagcacatcatgaggcgagcggcccgggag

SEQ ID NO: 79475 - DNA, 142 bp, Homo sapiens
  chr16:84765227-84765369
  hypo
aaaatccttttttctcgaaactttcaaaatgttgccccattgccttccatagccttgttgattttgctattaagacgttctgttgagttttttaatttagtgatttaaaattagtaattaatttccgcgaacactttcatga

SEQ ID NO: 79476 - DNA, 48 bp, Homo sapiens
  chr16:84780623-84780671
  hypo
tcaggagcatcaagacgccactaggcggcaggacgtttcagttccact

SEQ ID NO: 79477 - DNA, 18 bp, Homo sapiens
  chr16:84852343-84852361
  hypo
gcccggccagtctgcatt

SEQ ID NO: 79478 - DNA, 297 bp, Homo sapiens; identical to SEQ ID NO: 36283
  chr16:84853364-84853661
  hyper

SEQ ID NO: 79479 - DNA, 30 bp, Homo sapiens
  chr16:84933190-84933220
  hypo
atgctgccagttgcacggtggcatcctggg

SEQ ID NO: 79480 - DNA, 30 bp, Homo sapiens
  chr16:84998014-84998044
  hypo
gggcctatgggactccgaggaggggaacta

SEQ ID NO: 79481 - DNA, 60 bp, Homo sapiens
  chr16:85001619-85001679
  hypo
ctgaaagcataatgccgagtgaaagaagccagacacagaaggacacgttttgcaagattc

SEQ ID NO: 79482 - DNA, 426 bp, Homo sapiens
  chr16:85007493-85007919
  hypo
gcccatgcagccgcccggctcaggtgtgcgcctccgtgttcgagtctccttctcatttccgcgtgtctggaatgccaccaggagccccaaggcacagcacgtgcgaggcagggctgcggcacacactgaccatctggcctctgaaaggtaagcgaggcagggctgcggcacacactgaccatctggcctctggaaggtaagtgggcattttggttccctcagtgcaaatgttagacaaatttgttgaatgaattaaaatcaaattgtaggtacttgagattctgaactgtggagattttgaaacattgtttttatttcaacgtgcactaaaaaaaggactaagtaaaacgatgggagtcgaattaaacattcaacaagcaacagtactcactgggcaacatttgtgagtcgcgcttgagtgcccag

SEQ ID NO: 79483 - DNA, 30 bp, Homo sapiens; identical to SEQ ID NO: 44770
  chr16:85010139-85010169
  hypo

SEQ ID NO: 79484 - DNA, 173 bp, Homo sapiens; identical to SEQ ID NO: 16076
  chr16:85028164-85028337
  hypo

SEQ ID NO: 79485 - DNA, 30 bp, Homo sapiens; identical to SEQ ID NO: 44772
  chr16:85028787-85028817
  hypo

SEQ ID NO: 79486 - DNA, 75 bp, Homo sapiens
  chr16:85033827-85033902
  hypo
cagcacaggtatgtacggccggtgtgatagtgcaagggtgcggcacaaggcaagtcccagcgagcagtggagtca

SEQ ID NO: 79487 - DNA, 212 bp, Homo sapiens
  chr16:85043907-85044119
  hypo
atgagccacgagccaccgcgtgcgtaccaggccacaaagtgactaaaaggtgatttcaggtatgtaaacactgtaaaacataacaaaaaagagattcttcatctgtgagatgaagagttcagaaagaaatattaatacacattgacctaaatctctaaaccccttgggatagtaacagtaaaatagataaatacgtgcgcttaagtgcatac

SEQ ID NO: 79488 - DNA, 66 bp, Homo sapiens
  chr16:85075504-85075570
  hypo
gtcccgctcttgaaacgattcccgggattccgagcgtttgcccctatgctgcgcactcctgtccct

SEQ ID NO: 79489 - DNA, 243 bp, Homo sapiens
  chr16:85083548-85083791
  hypo
agtggaaggccaagtcggtctctgtccgagttgaattcagctgtcccggagtcagccgctgtgtccttttgtgaaagaagtacagcccgtcacccagggagggcgcgccttatggcgggttctaacacgcagttgcaatggaaccaactcagtcaatggtgatcgctgatggtaaacaacccctcaccctgcactgtctcggtgcctgaaactcaagggcccagccctcgactcaggaattac

SEQ ID NO: 79490 - DNA, 72 bp, Homo sapiens
  chr16:85136820-85136892
  hypo
cccttctgccacatgcggactcatagcaggcaccagccatggggaacaggccctcctcggatgctgaatctg

SEQ ID NO: 79491 - DNA, 47 bp, Homo sapiens
  chr16:85141797-85141844
  hypo
gtgtccagagctgtgcggcgggaggtggagcgcgaggtgccctccct

SEQ ID NO: 79492 - DNA, 135 bp, Homo sapiens
  chr16:85147716-85147851
  hypo
gccatggggcagggacgggagcggcgcagtgtgagccaggagcacggagagctgccaggagccggagacagccccggagcctccggagggactgcagcagcctccgtagatccttgatttcggactctgtggccc

SEQ ID NO: 79493 - DNA, 30 bp, Homo sapiens
  chr16:8519135-8519165
  hypo
tttgaagcacctctccgtctttcaagagcg

SEQ ID NO: 79494 - DNA, 207 bp, Homo sapiens
  chr16:85203399-85203606
  hyper
ccgctgcttcctgggcgagcagtgggccgccttcgagcgcgcccgcacgccggtggacaagcgcatgtactggctcaagcggccccaccagtgcgacgcgggcgcaggcggccgccgtggcggcgccggggccccccgcgagtggaacgtcgcctacgcgctgggcagcgccaccggcgacgacgacgaggacgacggtggcggccc

SEQ ID NO: 79495 - DNA, 39 bp, Homo sapiens
  chr16:85255435-85255474
  hypo
gggggccagagcccacgtcagtcccgcttggagccctca

SEQ ID NO: 79496 - DNA, 42 bp, Homo sapiens
  chr16:85264292-85264334
  hypo
atgactggcctaccccggggcacatgccgtgtgtataaaggg

SEQ ID NO: 79497 - DNA, 137 bp, Homo sapiens
  chr16:85317660-85317797
  hypo
aattaaatgcatgcccgtggctgtggcatgcgtgaggacagctgcctgccagccttcagaggccagttgttcagctttcaagatgcccccggcccaggagaaggcccggcgggtcgggaggccgggagaattgagaa

SEQ ID NO: 79498 - DNA, 48 bp, Homo sapiens
  chr16:85318173-85318221
  hypo
cgattctcgggaactcggtgcagatgctgtattcgagccagcgagggg

SEQ ID NO: 79499 - DNA, 32 bp, Homo sapiens
  chr16:85328962-85328994
  hypo
agttttcaaggttcacgcgtgctgcagcgcgg

SEQ ID NO: 79500 - DNA, 239 bp, Homo sapiens; identical to SEQ ID NO: 44779
  chr16:85336342-85336581
  hypo

SEQ ID NO: 79501 - DNA, 30 bp, Homo sapiens
  chr16:85337464-85337494
  hypo
atcgcctggcagtgccgctgcccccagggt

SEQ ID NO: 79502 - DNA, 30 bp, Homo sapiens
  chr16:85369520-85369550
  hypo
ctccagcatgctgaccggctggcctgagtg

SEQ ID NO: 79503 - DNA, 30 bp, Homo sapiens
  chr16:85399740-85399770
  hypo
tcgggtactgggctccggcctcccgaagtc

SEQ ID NO: 79504 - DNA, 30 bp, Homo sapiens
  chr16:85401274-85401304
  hypo
ccctcaccatgaaggcggggaccgtggctc

SEQ ID NO: 79505 - DNA, 221 bp, Homo sapiens
  chr16:85427749-85427970
  hypo
agccgtgactgctgacgaaaaacacaaacatctgtgaggggagaggcggggctggagggtgggaggcagccgggggccggggagcgaggtcaaggcccgagaaattaaatgttcataaatgtaggcctggcactcacaaagtagggcagagccattagcgctcattaaagtttaatacctgtcggtgctggtgcggccccgctggacgctgctctaatttg

SEQ ID NO: 79506 - DNA, 100 bp, Homo sapiens
  chr16:85455150-85455250
  hypo
caaacagctgcacagcgattttctgaccaggcggggaggagaaggcaggttttcggggctgctggcagctgctcatttgcaggcccgagcttgtgaacgg

SEQ ID NO: 79507 - DNA, 30 bp, Homo sapiens
  chr16:85455735-85455765
  hypo
tgcccgggtcatcctcgcaccccacctcgg

SEQ ID NO: 79508 - DNA, 30 bp, Homo sapiens
  chr16:85462609-85462639
  hypo
cagcagcgtgcacaacgcacacatacaaca

SEQ ID NO: 79509 - DNA, 82 bp, Homo sapiens
  chr16:85464220-85464302
  hypo
gggagctgcatggaacggggacgcctggtgccacccccagaggctctggcttgatagtccccaggtacgggctgggcacagg

SEQ ID NO: 79510 - DNA, 30 bp, Homo sapiens
  chr16:85464926-85464956
  hypo
ggtgccgcatgatggcgtatggcaaaatct

SEQ ID NO: 79511 - DNA, 30 bp, Homo sapiens
  chr16:85478405-85478435
  hypo
ccagtccctctcctccgccccctccagcct

SEQ ID NO: 79512 - DNA, 30 bp, Homo sapiens
  chr16:85479322-85479352
  hypo
agccctctcctggctcgagggagagctccc

SEQ ID NO: 79513 - DNA, 108 bp, Homo sapiens
  chr16:85485747-85485855
  hypo
tgggagtgctgaagccgtttgccaccctggcctgcatcggggccccgcaattaagccgattatgttttgagagtcaagctgtctgactcctcgcgtccctaatgtgat

SEQ ID NO: 79514 - DNA, 54 bp, Homo sapiens
  chr16:85496643-85496697
  hyper
ccctcctagaggccccgggtcccgcggcccggggggcggcgcaggatgctgggc

SEQ ID NO: 79515 - DNA, 30 bp, Homo sapiens
  chr16:85498216-85498246
  hypo
gtactcacgaagcctcgggaatgtgccacc

SEQ ID NO: 79516 - DNA, 42 bp, Homo sapiens
  chr16:85515663-85515705
  hypo
acccatgaagggagccgctgttgtggacgacccaacttgtca

SEQ ID NO: 79517 - DNA, 45 bp, Homo sapiens; identical to SEQ ID NO: 44783
  chr16:85516822-85516867
  hypo

SEQ ID NO: 79518 - DNA, 402 bp, Homo sapiens
  chr16:85517218-85517620
  hypo
gggatcaagtgtctccgaggcggcgggctgagacggatgggcctcctggccgcacacctgagaacatgctggcaaaagcgtttgcttaattaattgactttgagcgagggagcccgtccccgtgtaaacctagcagcaggctcggtgcttgccgccgggatgctgcgaatgcaaggctagactttaaataagggtgtgattattgtgtgaataattgaagaatgttggggagcttgcagtcctcggtgtaccgtcccctgccagcaggcctctgggccctgcccgtcacgggtacaactctgctgccatcctctcagctgggacagtgggggactttcagacctaagcgttggaggaaacctcctcagcgaccctccccgagaggtgcgtccctgttttcca

SEQ ID NO: 79519 - DNA, 141 bp, Homo sapiens
  chr16:85537491-85537632
  hypo
ccaggctggggaattcgccggcgcttaattaggaccggcagtgcggaagatagatggtcatcctttttgctcccttcattaggagggagggtcaggtgtggcggtggtcaccggagcccgggctgccgaccctgcagaaaa

SEQ ID NO: 79520 - DNA, 26 bp, Homo sapiens
  chr16:85586238-85586264
  hypo
caggtggacctcgatggctgtctcca

SEQ ID NO: 79521 - DNA, 30 bp, Homo sapiens
  chr16:85612527-85612557
  hypo
ctccccccagcacagcgatctggtttgtct

SEQ ID NO: 79522 - DNA, 70 bp, Homo sapiens; identical to SEQ ID NO: 44786
  chr16:85617748-85617818
  hypo

SEQ ID NO: 79523 - DNA, 61 bp, Homo sapiens
  chr16:85618591-85618652
  hypo
atggccagggaagtccgaagacctcgtcttccaaggccaaatccagcgtatggggcaggag

SEQ ID NO: 79524 - DNA, 59 bp, Homo sapiens
  chr16:85627887-85627946
  hypo
acctccctgccccaccgcggtcagcttctccatctgctctccaccgaagcctcctttat

SEQ ID NO: 79525 - DNA, 30 bp, Homo sapiens
  chr16:85628473-85628503
  hypo
atcattggaggcccacgaggctgtgctgaa

SEQ ID NO: 79526 - DNA, 88 bp, Homo sapiens
  chr16:85668900-85668988
  hypo
cagggggcagcccctcgcctcctggctcttcctggcaaaccaggcacaggcaggaccgccagaaaaccctccacgcccttggcagggg

SEQ ID NO: 79527 - DNA, 30 bp, Homo sapiens
  chr16:85669859-85669889
  hypo
gagccatgtgcccatcggttcactcaccca

SEQ ID NO: 79528 - DNA, 347 bp, Homo sapiens
  chr16:85670998-85671345
  hypo
gctgcctttctgctccgtcctggagttggaccagtgagggcctccccaccttcatcatggcagtggctgtgcccccttgattgcagcagtggctatgtatcgagtccccccttgatcgcggcagtggctatgtattgagtccccccttgatcgcggcagtggctgtgtatcgagcgcctgctgtgcccctggcgggctcgctgtgcttctcacacacccttcgcctctggtggatgagaactgagcctccggcttgcccgggtcccacgttgtaagtggcatggggaattccaatccccagcttgtgcctgagactccatagacccctgccccgcaggtgtagcctc

SEQ ID NO: 79529 - DNA, 30 bp, Homo sapiens
  chr16:85671745-85671775
  hypo
ttcgccatctgactgcgattgcctccgcgt

SEQ ID NO: 79530 - DNA, 44 bp, Homo sapiens
  chr16:85672034-85672078
  hypo
ttgggcaagggcagacgcttgcgaatcgccgatgcatgccccag

SEQ ID NO: 79531 - DNA, 55 bp, Homo sapiens; identical to SEQ ID NO: 44789
  chr16:85673184-85673239
  hypo

SEQ ID NO: 79532 - DNA, 48 bp, Homo sapiens; identical to SEQ ID NO: 44790
  chr16:85673838-85673886
  hypo

SEQ ID NO: 79533 - DNA, 211 bp, Homo sapiens
  chr16:85674123-85674334
  hypo
gaggggaggcagatccggttactgtcctgtccctggtgccacctgaaaccgagatcccagctgagtgagtggggactacgtgtgcggggaccacggagcagggaccacagacccatcctcatgagctgccgtgggaatgcttccaccgtggagccggcctgggcgggggagaggctccccctttctgccgctgcctcggaaatctgcctct

SEQ ID NO: 79534 - DNA, 644 bp, Homo sapiens
  chr16:85678117-85678761
  hypo
gcaatgtggatgaaccgtgaagacacggctcccagtgagaggagccaggcgagaagggccacgcggtgggattcccttgatgtgaagtctccggaacaggcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgcccctgaggtgaggggcgtggtgccccgccctgcagccagcgtttcccctcctcaggtggatctagtagcccgccggcacagtgcccagtcccaggtgttggcccggtcgacttggggtggtg

SEQ ID NO: 79535 - DNA, 309 bp, Homo sapiens
  chr16:85679146-85679455
  hypo
gttctgtttccacatcgggatgcctgtggggcctctgcctcctggtcacgccactaaggccactttggctgcctgaggcctctgggcaccccctgtgagcagcagttttctttggtgaatgtgcgcgtgcccactccggacacagtgaaggggagatgaggctgcttctgcccccggaaccaaggccaggtctgaacagaagtcgggcaggatgccgggagctgatgggctggggtcctccttctggaaagggcatctacctgcttctaccacgcattctacctgcttctaccacgcttcctatgcatg

SEQ ID NO: 79536 - DNA, 43 bp, Homo sapiens
  chr16:85679829-85679872
  hypo
ctaccacgcattctacctgcttctaccacgcattctacttgct

SEQ ID NO: 79537 - DNA, 624 bp, Homo sapiens
  chr16:85683970-85684594
  hypo
ggctgctggtgccagcgcccgcagctcatgggaggccacttccctgccccagcctggaccaggagcttctaccagccaggaccctgcacccagccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 79538 - DNA, 79 bp, Homo sapiens
  chr16:85693778-85693857
  hypo
tccccatggaaagtgcggatgagcgcttgcccttaggggaattcacgcaagcaggtgggaaaatcgaccgaaactggat

SEQ ID NO: 79539 - DNA, 30 bp, Homo sapiens
  chr16:85698705-85698735
  hypo
gagggacagtcctgccgtctccctgagtgg

SEQ ID NO: 79540 - DNA, 200 bp, Homo sapiens
  chr16:85699645-85699845
  hypo
tgacatcccaaaggccgcggagcctgggaagctggaacaggtccggccccaggagctgtcgagagtccaggagctagctcctgccagcggggagaaggccaggctgagcgaggcccctggaggcaaaaagagtctgagcatgcttcactatatccggggcgctgcacccaaggacattcctgtgccgctgtcccacagca

SEQ ID NO: 79541 - DNA, 208 bp, Homo sapiens
  chr16:85721429-85721637
  hypo
gggcgctccctctcccgcctgcaccctccaactccggaacaggtttcacacacccaatgttggggtcctggggtgcggggaggtgggtctgggcaggtacagagcctgccctccttctccaggactcccagcgccgaggcgcctccctcatactgaaaacgcaaagccgggcgggcgcgggggctcacaatccagctactcgggaggc

SEQ ID NO: 79542 - DNA, 163 bp, Homo sapiens; identical to SEQ ID NO: 44796
  chr16:85731450-85731613
  hypo

SEQ ID NO: 79543 - DNA, 234 bp, Homo sapiens
  chr16:85741334-85741568
  hypo
cagccaggaccatggcgctccctttcaccaggccggagtcagcaagaacctggaggtgtcagaggtccggtccactcagcggggcctgggaaacactgttctggaagtggacaggctggattcctcgctggtcctgccacgtctctctgagcggaggcccgggttcgctcagttcccatccagggtattcagcacacctgctccaggcagccacgcccccggacacctgaagcc

SEQ ID NO: 79544 - DNA, 35 bp, Homo sapiens
  chr16:85752258-85752293
  hypo
tcactccagccaatgcggtgcgatgattctatatg

SEQ ID NO: 79545 - DNA, 30 bp, Homo sapiens; identical to SEQ ID NO: 44799
  chr16:85758266-85758296
  hypo

SEQ ID NO: 79546 - DNA, 32 bp, Homo sapiens
  chr16:85799033-85799065
  hypo
tgtgcatcaaatgaacgcgatcttccctccag

SEQ ID NO: 79547 - DNA, 145 bp, Homo sapiens
  chr16:858656-858801
  hypo
gcattctccagaggccgaccaatatattggagagacggattaatagacggatgatagtgggtttgtcaggggaattggcccatgcggttagggaggccgagaagtcccgggagggatgccatctgcaagccggagacctgggatg

SEQ ID NO: 79548 - DNA, 35 bp, Homo sapiens
  chr16:85869217-85869252
  hypo
caggtgtcggcactgcggcgcggtgtcccaggcct

SEQ ID NO: 79549 - DNA, 174 bp, Homo sapiens
  chr16:85873671-85873845
  hypo
ccccatgctgtgtgtcgctgggcaagtctccagctcctctgatcctcccctgtaaggcagggccatacgctctccactggagcgtggatggaaggagacaatgggacaaaatgcctgaattacttagcacgagctggtgccagaacatgtccctggcttcgctgtctctggcct

SEQ ID NO: 79550 - DNA, 30 bp, Homo sapiens
  chr16:85919965-85919995
  hypo
gcatgacatctttaccgttggagacaatgc

SEQ ID NO: 79551 - DNA, 368 bp, Homo sapiens
  chr16:85932298-85932666
  hyper
ccaatatccagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggcc

SEQ ID NO: 79552 - DNA, 1 bp, Homo sapiens
  chr16:85932667-85932668
  hyper
c

SEQ ID NO: 79553 - DNA, 376 bp, Homo sapiens
  chr16:85932669-85933045
  hyper
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttcc

SEQ ID NO: 79554 - DNA, 101 bp, Homo sapiens
  chr16:85952205-85952306
  hypo
gacagaggcaggtgacgcggaagctgttcgggcacctggagcgcggggtgctgctgcacagcagccggcagggcgtgttcgtcaagcggctgtgccagggc

SEQ ID NO: 79555 - DNA, 30 bp, Homo sapiens
  chr16:86068336-86068366
  hypo
catgctaatttgtctcggcagccctggttc

SEQ ID NO: 79556 - DNA, 51 bp, Homo sapiens
  chr16:8606896-8606947
  hypo
ctccctgtggccttccgtaatgtggcccctgctgaccgctccagcctctgt

SEQ ID NO: 79557 - DNA, 54 bp, Homo sapiens
  chr16:86081901-86081955
  hyper
ggacccaggcagttccgggcctgggctcgccactctgcccggaagggggagggg

SEQ ID NO: 79558 - DNA, 198 bp, Homo sapiens
  chr16:86092017-86092215
  hypo
cctgacagtatcaagcgttggcggggattggagcaactgcagctcccattgctttggaaaagtggcacagtttcttacagaattcaacacacatttacaatgtgaccctgaagtttaactcctagacatttcttcaagagaaatgaagacatacgcccacagaaagatttgaacatgaatgttcgcacttactttttc

SEQ ID NO: 79559 - DNA, 30 bp, Homo sapiens
  chr16:86101131-86101161
  hypo
tgtttggtgaatgggcgctgctgtctctaa

SEQ ID NO: 79560 - DNA, 55 bp, Homo sapiens
  chr16:86102059-86102114
  hypo
attagacacagtaaccgaagtttcaggagtggaaccgctacgtggaagtagacgt

SEQ ID NO: 79561 - DNA, 38 bp, Homo sapiens
  chr16:86115722-86115760
  hypo
ctgggattacaggcatgagccaccgcgcccggcctggg

SEQ ID NO: 79562 - DNA, 55 bp, Homo sapiens; identical to SEQ ID NO: 44800
  chr16:86119064-86119119
  hypo

SEQ ID NO: 79563 - DNA, 30 bp, Homo sapiens
  chr16:86133147-86133177
  hypo
agatgaagcttcactcgattgcctgcagct

SEQ ID NO: 79564 - DNA, 35 bp, Homo sapiens
  chr16:86141209-86141244
  hypo
tgatttttttttcttcgtaacgcttgtctatctaa

SEQ ID NO: 79565 - DNA, 30 bp, Homo sapiens
  chr16:86149152-86149182
  hypo
tgctcaggagatgcacgggcacggggacac

SEQ ID NO: 79566 - DNA, 96 bp, Homo sapiens
  chr16:86215311-86215407
  hypo
agcaaccacagggggcggggctcacggtttctttgccaggccatgagcacgtgctgggctaaggctgcagtgagagacggccgcccaggtcagtga

SEQ ID NO: 79567 - DNA, 30 bp, Homo sapiens
  chr16:86216291-86216321
  hypo
tataacaaagtgtttcggcttcaaaatgca

SEQ ID NO: 79568 - DNA, 224 bp, Homo sapiens
  chr16:86320265-86320489
  hyper
aaggggagcccagtgcgcagggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaacc

SEQ ID NO: 79569 - DNA, 578 bp, Homo sapiens
  chr16:86320490-86321068
  hyper
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggaggaccaggaag

SEQ ID NO: 79570 - DNA, 37 bp, Homo sapiens
  chr16:86334870-86334907
  hyper
gagcccaggagggcacgtcctccgccagctctcagca

SEQ ID NO: 79571 - DNA, 130 bp, Homo sapiens
  chr16:863747-863877
  hyper
cctgcctgccctgggcggatccccggggccgcgcggttcgggccgcgctcctgcccgctggggtctcccgccgtcctcgccgtcaccaccgggtggagccacaggtccgtgtgatcgtccccgtgacccc

SEQ ID NO: 79572 - DNA, 109 bp, Homo sapiens
  chr16:86530884-86530993
  hyper
cacggccacctacttcgtcgggaaagacagtccagcgcccaccggcccgtgctcgcccgcctgccgagccccgagtcccggcaacgcgccccgggtgctccggtccact

SEQ ID NO: 79573 - DNA, 273 bp, Homo sapiens; identical to SEQ ID NO: 4373
  chr16:86531016-86531289
  hyper

SEQ ID NO: 79574 - DNA, 107 bp, Homo sapiens; identical to SEQ ID NO: 4374
  chr16:86531374-86531481
  hyper

SEQ ID NO: 79575 - DNA, 129 bp, Homo sapiens
  chr16:86531527-86531656
  hyper
cgttccctggttcacaaccaccccacccccacgcgcctgtgcacatgtccctcccgccgcgcagggtctccgcgggcgcgccccgccccaaatagagcttactacagtaacccgggagtctcacatctg

SEQ ID NO: 79576 - DNA, 44 bp, Homo sapiens
  chr16:86531946-86531990
  hyper
cgccccaaccaatctcgcactgtaagtgcatttcttgggttttc

SEQ ID NO: 79577 - DNA, 157 bp, Homo sapiens
  chr16:86537937-86538094
  hyper
gcagataggtggctccgtgccctgggcacacagcctctcacaggcccactgggaacccaacacacctgtccccgcatctccacaccacaccaagagctgccaccacacccctcacagagccacaaagccggtaaatgtcactcgatggctacaaaaa

SEQ ID NO: 79578 - DNA, 324 bp, Homo sapiens; identical to SEQ ID NO: 36295
  chr16:86539103-86539427
  hyper

SEQ ID NO: 79579 - DNA, 166 bp, Homo sapiens
  chr16:86539463-86539629
  hyper
cgctctcggcccgggcggcttcgcttaagcaattagctagtaaaaataccttgggcctggggagtgggagacgttgcagtcgtgtccgtttttacacacccacccccgccctgctcggccagtttcaggattcctggggccagagatggggcgcagatttgttttg

SEQ ID NO: 79580 - DNA, 226 bp, Homo sapiens; identical to SEQ ID NO: 36297
  chr16:86541633-86541859
  hyper

SEQ ID NO: 79581 - DNA, 32 bp, Homo sapiens
  chr16:86542207-86542239
  hyper
cctggagggagaggccgcgcccggccagcagt

SEQ ID NO: 79582 - DNA, 400 bp, Homo sapiens
  chr16:86542273-86542673
  hyper
cgccgcgatgcgccggggctcctgcgctgtcctgcgctccgctctcggcaccacctttcgtggctccaccgcccccagcccgcacccgagcgctgaggtggcaagggcaggtctgcgtgcgagccccctgcgggctggcagccaggtgcgcgagggccgcccttgccggcgctcccagcccgcgctgtctgctctcaggaacctggcctggcgcgcagtgtcagaggccccgcggcggcggcaggccgagcccacaggggcattaggccaactcccccctcccgccctgcgcacgcggaattctctattattattattaaagaatcccccagaacttgtttacgttaaaccctgtaaacttcctgccagggcctttgccatctctcgggaaatcggaacc

SEQ ID NO: 79583 - DNA, 33 bp, Homo sapiens
  chr16:86543017-86543050
  hyper
gtgagtgactgagcacgccgcttattcaggggc

SEQ ID NO: 79584 - DNA, 30 bp, Homo sapiens
  chr16:86543320-86543350
  hyper
tgcctgcgatggtcacgaccgggaggccgc

SEQ ID NO: 79585 - DNA, 199 bp, Homo sapiens
  chr16:86543623-86543822
  hyper
ggtcttaggccgacccgcgagacgcagccgagcggagatggagtgaaggctgcctcgcccggaatctcggagccgagcgccgcgggcggcggggactcagggctgctcccggctggggcgcacggccgtaagacctggaggtggtgcctccccccaaaaaataccggcgggggtagcttcctcacggccttcgcccggg

SEQ ID NO: 79586 - DNA, 384 bp, Homo sapiens
  chr16:86544174-86544558
  hyper
gatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccag

SEQ ID NO: 79587 - DNA, 99 bp, Homo sapiens
  chr16:86545059-86545158
  hyper
cgcggccaaccccctgtccggcagcctctccacgcactccctggagcagccgtatctgcaccagaacagccacaacgccccagccgagctgcaaggtga

SEQ ID NO: 79588 - DNA, 30 bp, Homo sapiens
  chr16:86556449-86556479
  hypo
gcctttctgatttctcggtgattctgttcc

SEQ ID NO: 79589 - DNA, 30 bp, Homo sapiens
  chr16:86564966-86564996
  hypo
agctggctgagggcccggagtgtgtccaca

SEQ ID NO: 79590 - DNA, 30 bp, Homo sapiens
  chr16:86589626-86589656
  hypo
gcatccccgtagccacgtgcctggtacatc

SEQ ID NO: 79591 - DNA, 182 bp, Homo sapiens
  chr16:86599203-86599385
  hyper
ccgtttgcaatcaaccgctcacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgc

SEQ ID NO: 79592 - DNA, 567 bp, Homo sapiens
  chr16:86599480-86600047
  hyper
cgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatccattacacctgggcccccataattaggaaatctaattattcgcttcatcactcat

SEQ ID NO: 79593 - DNA, 1567 bp, Homo sapiens
  chr16:86600250-86601817
  hyper
gttttcaagtgaagacggagtcgccgcggaggccggggcggcggggtcttagagccgacggattcctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccgga

SEQ ID NO: 79594 - DNA, 477 bp, Homo sapiens
  chr16:86602037-86602514
  hyper
cgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagaca

SEQ ID NO: 79595 - DNA, 30 bp, Homo sapiens
  chr16:86740720-86740750
  hypo
acgcggagtgggcctcgacagctatcaacc

SEQ ID NO: 79596 - DNA, 36 bp, Homo sapiens
  chr16:86741248-86741284
  hypo
ggcatacctgtggaccggcgacgtggcctgagagcc

SEQ ID NO: 79597 - DNA, 91 bp, Homo sapiens
  chr16:86775015-86775106
  hyper
gggagaccctccctgcgggagccgctgctagagggaaaggcagcgttggatcggatgccggccccagcctgggagacgtgcttcctctgca

SEQ ID NO: 79598 - DNA, 42 bp, Homo sapiens
  chr16:86824590-86824632
  hypo
gtggcattcccattacgatctgagaagcggaggctgacgact

SEQ ID NO: 79599 - DNA, 30 bp, Homo sapiens
  chr16:86828224-86828254
  hypo
gcatagcagtcttttcggtctgggctgcct

SEQ ID NO: 79600 - DNA, 279 bp, Homo sapiens
  chr16:86878223-86878502
  hypo
cccggctggtgacttctatagtcctttcgtctctctaaagtgggtaagagggaaaggtcaacacaaaaccagccatggcacaggcctcgaggagaaggctgaccgtccatggacagcaggcccatggctgctctagctccgctctgctgctgggagtgagtggccgggtggcaggcgccctccagggcatggatgaaacctcacaaatggcgctttgtcgtcccgccgagagatctgggacatcccgtgagttggaatatataacgcccactggattaa

SEQ ID NO: 79601 - DNA, 38 bp, Homo sapiens; identical to SEQ ID NO: 44803
  chr16:86903475-86903513
  hypo

SEQ ID NO: 79602 - DNA, 85 bp, Homo sapiens
  chr16:86950939-86951024
  hypo
gcgtatttatccactcggtgctgaaggacatctgggttgcttccgggttttgaaaattagaatgaaactgcgacacatctgtgtg

SEQ ID NO: 79603 - DNA, 30 bp, Homo sapiens
  chr16:86951460-86951490
  hypo
agcacagcacaccctcggagtctaagctca

SEQ ID NO: 79604 - DNA, 72 bp, Homo sapiens
  chr16:86981285-86981357
  hypo
gagaaacctgctgcccgctgctaacccatactgagcgtcccgagccaggaccctcatcgtacacttgcacac

SEQ ID NO: 79605 - DNA, 30 bp, Homo sapiens
  chr16:87020868-87020898
  hypo
atttcaggggtcagacgacaagaagccttc

SEQ ID NO: 79606 - DNA, 88 bp, Homo sapiens
  chr16:87022637-87022725
  hypo
ctatgacacaggtgacgtgcgtgacgcaccatccagagtgctgctgctgctctgcggggctcctgtgacaccccgacctcccccggcc

SEQ ID NO: 79607 - DNA, 164 bp, Homo sapiens
  chr16:87052288-87052452
  hypo
acctggcccaccccacgctcctctccttgccactcggccaaacaagcgcaagtgaagagtgatgccgaccagttgttgagcatatataggccacctggatcacccaaccaggaaatcaaaactgcagccatgccgggcacggtggctcacgcctgtaatcccaa

SEQ ID NO: 79608 - DNA, 30 bp, Homo sapiens
  chr16:87091202-87091232
  hypo
gagagtccacaggtgcggcattcaccttgt

SEQ ID NO: 79609 - DNA, 245 bp, Homo sapiens
  chr16:87092376-87092621
  hypo
tgacaaatatgctctcggatagaacagcccagaaagggcaagagggagagttggaacactcagataattacccttcagcgacgcagtgcacttaagtggtgaaaggagattcactggttggaaaaacactccagggcgaagggccagcgtgtgcaaaagcaccgaagcatgaccgagcgcgggcattcccgccagccaccagtgggccacgcatcccaacatgtgagtgccgcaaggatacaagt

SEQ ID NO: 79610 - DNA, 207 bp, Homo sapiens
  chr16:870938-871145
  hypo
cccacttcttttgttcgctgccgcgtgcttgtcaatcaagtttttcatcctatggatccgtcttttgtcagtttaatttgcaggccccagtcgcagaatttaagaggacagaagaatggtcttttgttcccaacagcctccttcaccaccacaaccccactggctgcctcaccttacgtgtgacacgctcgtcgaacttgccagcaa

SEQ ID NO: 79611 - DNA, 30 bp, Homo sapiens
  chr16:87100260-87100290
  hypo
gaaggagatgccagccgggccagtgactca

SEQ ID NO: 79612 - DNA, 30 bp, Homo sapiens
  chr16:87106180-87106210
  hypo
tggggaccctcatatcgaattcatgggagg

SEQ ID NO: 79613 - DNA, 54 bp, Homo sapiens
  chr16:87158485-87158539
  hypo
acacacattcacatacgcaacacacatgccacacacacacgcagcacatactct

SEQ ID NO: 79614 - DNA, 77 bp, Homo sapiens
  chr16:87178999-87179076
  hypo
tgggcagaggtgaggcgctgcttgcattctcagctctagtcaccatccccgcccagtgttgacgtacagcggtgaca

SEQ ID NO: 79615 - DNA, 131 bp, Homo sapiens
  chr16:87186183-87186314
  hypo
ggctggctccttctacgggctccagggagaatccctttccgcatctctctgggcttctagcacccgccacactccttggctcgtggccacttcactccagtccctgctcagccgtgcgtggcctcttctct

SEQ ID NO: 79616 - DNA, 247 bp, Homo sapiens
  chr16:87187799-87188046
  hypo
tcctggtctcatcctcgggtggtagcactcacagcattataaccacgtctctccagccatccagggaaaacgccaaagatgttacacgatatggcagttttccaggtgggaaaatcaaccaaccgccttagaaaacaatcgtacctctgagcctcggggtctgaattcccatcatggaaagtcgagcaagactcgattcatgaagttttggcctcccaagtgcccagtccctcgagatgcttaaagt

SEQ ID NO: 79617 - DNA, 194 bp, Homo sapiens
  chr16:87215623-87215817
  hypo
aattgtagataagaacgaaataatgtccatctgaggggggatcgcatcctccacctggccatcccagaacccaggacagagcgacgctcccccagtgctaacccaggagtggaccccagttctcctgagcccttccagtgcatatcatggtgagaccgggtggtgaagcaaggggaactcgttggtgctttatc

SEQ ID NO: 79618 - DNA, 30 bp, Homo sapiens
  chr16:87221538-87221568
  hypo
gggtgtgcatgtgtacgtgtgtgggtgtat

SEQ ID NO: 79619 - DNA, 30 bp, Homo sapiens
  chr16:87249934-87249964
  hypo
cctcatcctccctttcgcttcagctgggga

SEQ ID NO: 79620 - DNA, 33 bp, Homo sapiens
  chr16:87253357-87253390
  hypo
cccaccccaaagaagcgacgatccagccgagga

SEQ ID NO: 79621 - DNA, 104 bp, Homo sapiens
  chr16:87262420-87262524
  hypo
acagccaccacctcacggcaatctcatgagagaccccaagacagacagtgggagaaccaccagccaagccccactggctcacagaatcacgagacacaattcaa

SEQ ID NO: 79622 - DNA, 30 bp, Homo sapiens
  chr16:87273793-87273823
  hypo
ttctgcagagctgtgcgctgctggagcagg

SEQ ID NO: 79623 - DNA, 30 bp, Homo sapiens
  chr16:87284714-87284744
  hypo
agaggggcaggaacccgccaacaggaagac

SEQ ID NO: 79624 - DNA, 147 bp, Homo sapiens; identical to SEQ ID NO: 16090
  chr16:87296936-87297083
  hypo

SEQ ID NO: 79625 - DNA, 40 bp, Homo sapiens
  chr16:87300104-87300144
  hypo
taggtccagggaaatcgaggagcgtcggctctgattattc

SEQ ID NO: 79626 - DNA, 30 bp, Homo sapiens
  chr16:87311858-87311888
  hypo
gaccaacatcccagtcgaagcaggggtgtc

SEQ ID NO: 79627 - DNA, 36 bp, Homo sapiens
  chr16:87312099-87312135
  hypo
acagcccagagctgccgtctccgtctctcagaaaag

SEQ ID NO: 79628 - DNA, 135 bp, Homo sapiens; identical to SEQ ID NO: 44808
  chr16:87354991-87355126
  hypo

SEQ ID NO: 79629 - DNA, 202 bp, Homo sapiens
  chr16:87356769-87356971
  hypo
ctcaacctcccacaacgcatggagcggcccggcgcacgactcacccggccccaaacaccaactgtgccgaggtgatgccctgccctgaggcgagcgtacaaggcttgagcgtcgagaacactgcaagggtctcagccagtgaggggctgcctgggccccgccgcaggcctgactcctagagccaagccgttttctcccttca

SEQ ID NO: 79630 - DNA, 32 bp, Homo sapiens
  chr16:87418168-87418200
  hyper
gtcgtctcccaggtccgcgggtggtgaccgcg

SEQ ID NO: 79631 - DNA, 85 bp, Homo sapiens; identical to SEQ ID NO: 44810
  chr16:87421370-87421455
  hypo

SEQ ID NO: 79632 - DNA, 207 bp, Homo sapiens
  chr16:87583661-87583868
  hypo
ggcagtgtgcatgcacgtatgtgtgagcatgtggcagtgtgcatgcacgtatgtgtgagtgtgtggcagcgtgcatgcgtggatgtgtgtttgtggcagtgtgcctgcacgtatgtgtgagcacgtggcagtgtgcacgcatggatgtgtgatcgtgtggccgtgtacgtgtgccagcgtgtatgtgaaagacgtgtttgtgtgggt

SEQ ID NO: 79633 - DNA, 78 bp, Homo sapiens
  chr16:87584344-87584422
  hypo
ggtgagcagaacagacggggcctccccgtccggagcttgcgtcccagtgaggacaccgggaggcgacccgtggggagc

SEQ ID NO: 79634 - DNA, 146 bp, Homo sapiens
  chr16:87594957-87595103
  hypo
cctaaggattggaaacgaccatcggcaggggacgggttaaaccgattaaggtgactgacaccgcgcagtgatgcgcagccagtgtaacggccctgtggaggacatctaggtgcatcgtctggtagaaggtacgagggcagacagca

SEQ ID NO: 79635 - DNA, 40 bp, Homo sapiens
  chr16:87622634-87622674
  hyper
tttccagccccactgcgaagggctccggccttttccagtg

SEQ ID NO: 79636 - DNA, 391 bp, Homo sapiens
  chr16:87635070-87635461
  hyper
cagtttctggctcaccgcgctgcggtcaccggcccacactcccaggagcgaggaccctgggcagcctccacacccccatcagcccactgcaccggtctgctgccatttcccgcacgcatttcaggagggctggggacgccggcttctgcctgaggatttatggtccaggaaatgcattttaaatggatcccaggatgctcggatccaagaatcagactctctcttgtgcgtgggaagaggggcggagggtgagagtatgtctggagagagacctagaaacgcccgaatggcggtcccactttgctccccaaaagcgcgaccgttccccgagtgggggggcgctacctgttggccagggcgcagggcgcacggaattcgggtgactttgctc

SEQ ID NO: 79637 - DNA, 87 bp, Homo sapiens
  chr16:87635740-87635827
  hyper
ctctgcaggcctcaccgcccagctcccgggagggggccgagggcgccctgagtgctgcgcgccttcccatgacgcagttcctgtgcc

SEQ ID NO: 79638 - DNA, 294 bp, Homo sapiens; identical to SEQ ID NO: 36310
  chr16:87636197-87636491
  hyper

SEQ ID NO: 79639 - DNA, 156 bp, Homo sapiens; identical to SEQ ID NO: 12571
  chr16:87636626-87636782
  hyper

SEQ ID NO: 79640 - DNA, 537 bp, Homo sapiens; identical to SEQ ID NO: 36312
  chr16:87636783-87637320
  hyper

SEQ ID NO: 79641 - DNA, 193 bp, Homo sapiens
  chr16:87637541-87637734
  hyper
atcaggccccagcttcgcttctggtgttcctgcggcgcccgagggccttcctcagccccgaatctgcccaagccgagagaaagggagtgatggggagcgctaggggcgggggatgccaacccgaaccaaaacagccaggcagtacacttctaggtggttggacgcggactagcgctgtcgaagcaggctgctg

SEQ ID NO: 79642 - DNA, 138 bp, Homo sapiens
  chr16:87648265-87648403
  hypo
gcaggtccctgcacacgtgaggagccgcgcgtcccctcccgggataaactctggtccctgcacacacgaggagccgcgcgtcccctcccgggataaacgctggtccctgcacacacgaggagccgcgtgtcctctccc

SEQ ID NO: 79643 - DNA, 30 bp, Homo sapiens
  chr16:87657914-87657944
  hypo
ccttccccattcccacggctccccacccct

SEQ ID NO: 79644 - DNA, 36 bp, Homo sapiens
  chr16:87678053-87678089
  hypo
gtcccgcgggggcttcgtgctcgtggcccacagtga

SEQ ID NO: 79645 - DNA, 30 bp, Homo sapiens
  chr16:87681285-87681315
  hypo
tgctgtccacacacacggctctgcacacca

SEQ ID NO: 79646 - DNA, 281 bp, Homo sapiens
  chr16:87688422-87688703
  hypo
gtgggctctgaccaccgctctgccctcttctcacaggaaccagcgaccactcggcccggcgtaaccacgcatgtccactggtcacctggtggccttcgacaagaacgtgtgataaatccctgccggagtgcggctccgggaaaacgctgtcaccgcaaaccagctcctctttgttgcagtcccccgggggcatggcccggcaagtttccttagccaggggccagtttgcctggggtcagtgggcagcgcctgggagtcgagtgtctcgagtggggctctgc

SEQ ID NO: 79647 - DNA, 30 bp, Homo sapiens; identical to SEQ ID NO: 44814
  chr16:87701846-87701876
  hypo

SEQ ID NO: 79648 - DNA, 232 bp, Homo sapiens
  chr16:87714174-87714406
  hypo
taggtggaggcactacggagccatggtgcaggggtggggggccccaggtgagctcagatgccctccctgcctgtgccaccgtggcctgaccctccacaggtgggagccataggcgtcaggagccattaccccttggagaactgggtgccaggccgagacctggtgtctcatttatgacaaaccgctgcagtgcgtttgggagtctcctcctccatgacgtgcttgtctggat

SEQ ID NO: 79649 - DNA, 32 bp, Homo sapiens
  chr16:87718103-87718135
  hypo
cagtccttggggcaccgcgtgttgcttgccgg

SEQ ID NO: 79650 - DNA, 30 bp, Homo sapiens
  chr16:87718416-87718446
  hypo
acctcgtcctcccttcgagggggggatcat

SEQ ID NO: 79651 - DNA, 103 bp, Homo sapiens
  chr16:87721480-87721583
  hypo
ctgctaggtccatagcgtctaaggcacaggaatgccagccccttggaagtcccatcctggccaaggaggaggtacgatgtgggtgatccgtgggcatgattgg

SEQ ID NO: 79652 - DNA, 30 bp, Homo sapiens
  chr16:87722716-87722746
  hypo
ggtggggagggaagtcggctcctgggctct

SEQ ID NO: 79653 - DNA, 1244 bp, Homo sapiens
  chr16:87723113-87724357
  hypo
ttgcctgcagcctttcggtgagtgggaagcgcctctgctgccctgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgcagcaggagagccccgagctgtaccgcaagggcaccactccctccgacctgacccccgacgacagccccctgcagagcttccccaccagccccgcggccaccccgccgcccgcgcccgccgccaggaacaaggtcgcccacttctcgaggcaggtgtcggtggacgaggagcggggcggggacatccagatgctcctggagggccgggccggggactgcgcccgcagcagctggggcgaggagcaggccgggggctccaggggtgtccgcagcggtgccctgcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatggggatgagctcaagtccagtacggtgagtgggcggccaccaggctggtcccagtggaggcaacatccacctctctgctgacctggtgtttcctgagggtttccagcaaggtcactgctcccctgttcctctccaggggtggagtagggtgggggtacagccgggagtggtggccctcaggtcgctgggaccctcccctaggaagccaggtggggcaggtgtcatacctctttccgtgagaggctgccc

SEQ ID NO: 79654 - DNA, 20 bp, Homo sapiens
  chr16:87726991-87727011
  hypo
tttcttggccaggcacggtg

SEQ ID NO: 79655 - DNA, 30 bp, Homo sapiens
  chr16:87728594-87728624
  hypo
tgtgaatcctgctgccgggagtgtgtgcac

SEQ ID NO: 79656 - DNA, 30 bp, Homo sapiens
  chr16:87740397-87740427
  hypo
cacttctcaagccatcgccccaaggtgacc

SEQ ID NO: 79657 - DNA, 30 bp, Homo sapiens
  chr16:87740741-87740771
  hypo
ccaattatgcaaatccgaattggccttcag

SEQ ID NO: 79658 - DNA, 70 bp, Homo sapiens
  chr16:877732-877802
  hypo
gctgtggaagctgcacgtgtcaccttatgtcatggctgcaacggcacgcaatgcacgcacaacatgtgtg

SEQ ID NO: 79659 - DNA, 147 bp, Homo sapiens; identical to SEQ ID NO: 44593
  chr16:8781004-8781151
  hypo

SEQ ID NO: 79660 - DNA, 78 bp, Homo sapiens
  chr16:87864575-87864653
  hypo
tgggaagcagtggtgcgtgcctccagggagcacttctcctggacccggggccgtggctgcctacgatgtccactgcct

SEQ ID NO: 79661 - DNA, 30 bp, Homo sapiens
  chr16:878827-878857
  hypo
gtccgcctgctgctccggggccgctggggt

SEQ ID NO: 79662 - DNA, 81 bp, Homo sapiens
  chr16:87905808-87905889
  hypo
aggcgtgagccaccacgcccagcgccctgcaggtcctttttaaggctgtttgcaacataaatgagacgaggcatcttctgc

SEQ ID NO: 79663 - DNA, 59 bp, Homo sapiens
  chr16:87911217-87911276
  hypo
gaagacacgctgcaacgtgcaggacccctgaaaacactgggctgcgtgaaagggtcagt

SEQ ID NO: 79664 - DNA, 60 bp, Homo sapiens
  chr16:87916269-87916329
  hypo
acaacacacttcacccgggcctggttcaggagcgggcgaggcagccgtacaccctgtcct

SEQ ID NO: 79665 - DNA, 30 bp, Homo sapiens
  chr16:87941554-87941584
  hypo
aaaagcggttgtttccgtctggaccatcac

SEQ ID NO: 79666 - DNA, 30 bp, Homo sapiens
  chr16:87960551-87960581
  hypo
ctgcagggagagagacggagaccctgagtg

SEQ ID NO: 79667 - DNA, 30 bp, Homo sapiens
  chr16:87979832-87979862
  hypo
gcctgggtgacatagcgagactccgcctaa

SEQ ID NO: 79668 - DNA, 30 bp, Homo sapiens
  chr16:88056313-88056343
  hypo
gtgtgggcagggccacgctgcctgagaagg

SEQ ID NO: 79669 - DNA, 81 bp, Homo sapiens
  chr16:88092513-88092594
  hypo
taaagtggcccctgccggcttttccttctgcctcctggtgggcccctgagccgctgctcctgctttcggcagctgctcctc

SEQ ID NO: 79670 - DNA, 30 bp, Homo sapiens
  chr16:88098353-88098383
  hypo
ggttgggggtgctgccgctcttgcccgcag

SEQ ID NO: 79671 - DNA, 48 bp, Homo sapiens; identical to SEQ ID NO: 44817
  chr16:88101496-88101544
  hypo

SEQ ID NO: 79672 - DNA, 158 bp, Homo sapiens
  chr16:88101811-88101969
  hypo
gggatggaggaggtgcgggcttaccgtgtgctcctctgctgctcgccccaggcttgggtttcctggcggtcacctggttggcgtgaaccttgggcgtgcgccagggtccctgtgctgtcgtggagtgcaggcaggtgggcaggcgcttgggagttacc

SEQ ID NO: 79673 - DNA, 66 bp, Homo sapiens
  chr16:88107013-88107079
  hypo
tactctgcccatgggcgcggtggcccccgcagaggcgcgccctgtactctgcgtggtgtttggttc

SEQ ID NO: 79674 - DNA, 30 bp, Homo sapiens
  chr16:88133222-88133252
  hypo
ccacccacatgttctcgaggtcagacccct

SEQ ID NO: 79675 - DNA, 99 bp, Homo sapiens
  chr16:88137279-88137378
  hypo
ggtagaataatcctccgtggcacgaggaagcgctggaataatcctccatggcacgagggagcggtggaataatcctccgtggcacgggggtgggtggaa

SEQ ID NO: 79676 - DNA, 47 bp, Homo sapiens
  chr16:88138197-88138244
  hypo
tgggagtgtctccctcgctcagcgtcacattccgggggcctgtccat

SEQ ID NO: 79677 - DNA, 237 bp, Homo sapiens
  chr16:88164335-88164572
  hypo
ggcacctaataaaaacggcagcgcagcctcccacgcactcagtggttcagacacacgaagacagcaatacagatgttacctcggctggtctcagcgcagcaccggcgctgggaaacgacgctgcctgggatggcgggcgcgtgggaaggccccgcggagtgggggtgtgaagtggccgcggggtgtcggcagagacaggcggaagtggcgtcccgatgaggacgaggtgcccgggca

SEQ ID NO: 79678 - DNA, 215 bp, Homo sapiens
  chr16:88165545-88165760
  hypo
ctaatggctcctgcccggcccgcgcatctccggggctgctgaagacagggcagcgatgctccgcccgtgggaagctgggcagcggcaggacggcactcccagcctctccatcggctttgaatcacggcctggagttccgatgcttcgtggccactctcctctccatgtgtggacatcgctgtctgtggccccggccataccgatggcttcaggtg

SEQ ID NO: 79679 - DNA, 30 bp, Homo sapiens
  chr16:88179063-88179093
  hypo
agcccctgcgagcctcgtgcttggccgctg

SEQ ID NO: 79680 - DNA, 30 bp, Homo sapiens
  chr16:88216917-88216947
  hypo
agaaatgaaactgcacgtccccaccaaacc

SEQ ID NO: 79681 - DNA, 79 bp, Homo sapiens; identical to SEQ ID NO: 44432
  chr16:882403-882482
  hypo

SEQ ID NO: 79682 - DNA, 139 bp, Homo sapiens; identical to SEQ ID NO: 44433
  chr16:882542-882681
  hypo

SEQ ID NO: 79683 - DNA, 40 bp, Homo sapiens
  chr16:88261467-88261507
  hypo
cacgcaggtgtaccccgccaggctccgcctccattattat

SEQ ID NO: 79684 - DNA, 30 bp, Homo sapiens
  chr16:88317274-88317304
  hypo
tgtgaggagttggagcggattcttagggct

SEQ ID NO: 79685 - DNA, 71 bp, Homo sapiens
  chr16:883188-883259
  hypo
cagggcacggggaaccggggtcgggctgaacattactccctactctgaaaggacagcgttgggacaatgtg

SEQ ID NO: 79686 - DNA, 150 bp, Homo sapiens
  chr16:88355986-88356136
  hypo
ctgcacctgctctcgcggtctcgggagccccgccctgcctgtcacgtcagtgtcccggccgtgttcatcctgaagctccacagccgcagccacccatggcagtggggagccaactgcagtatgctctgatcaaaccgtatctcatggctc

SEQ ID NO: 79687 - DNA, 138 bp, Homo sapiens
  chr16:88358687-88358825
  hypo
gatcacatccagctgcggcatactcagggtctcaagtcctcacctgcacactccaggtggtcccgacagcagctgcgacatacacagggcctcaagtcctcacctgcacactccaggtggtcgcgacagcagctgtga

SEQ ID NO: 79688 - DNA, 128 bp, Homo sapiens
  chr16:883606-883734
  hypo
ccccggcgcctctcccggagaagcagcctccccaagctgtgcctgagccgagggcaccgtccaggtcatctcagccagagccttggccgggtctaggggaggggtcacgccaacgtgatgacctcctg

SEQ ID NO: 79689 - DNA, 30 bp, Homo sapiens
  chr16:88369078-88369108
  hypo
agggccactctggcacggggtctcagggtg

SEQ ID NO: 79690 - DNA, 45 bp, Homo sapiens
  chr16:88374282-88374327
  hypo
cagaggaggcaggtgcgtggggaggagtcccgctggaacagaatc

SEQ ID NO: 79691 - DNA, 85 bp, Homo sapiens; identical to SEQ ID NO: 44820
  chr16:88375259-88375344
  hypo

SEQ ID NO: 79692 - DNA, 180 bp, Homo sapiens
  chr16:88387108-88387288
  hypo
ggcctttgcgcacaacgccctccgccagcctctcgcggctcactgctgcctgcccagagaggctcccggagcccattgggtgccttaggccttccctgctcggtgttgcttcagagcatgcgcgcgtgtcgtggtgaacggtggctcccaacaactcagtccacacgaatcctcagaatg

SEQ ID NO: 79693 - DNA, 87 bp, Homo sapiens
  chr16:88442772-88442859
  hypo
gtgtgaggggacgtccggggtgagagggggagggaagctgcagcaggcactgaaggccgctgtccctctcctcgcctgccccaggcc

SEQ ID NO: 79694 - DNA, 1179 bp, Homo sapiens
  chr16:88449274-88450453
  hyper
aacacctaggaaaagcggcgctaaaaatagctggggggagggtgcgggggcggcggagtctgtaacctaagccgccccagcctccggggggcagaccccgcggccgccggccggcgtccggccttcccagcacccggcccagggctggagctggctgcagggctggcccgcggcgacctgggcagggtggcggctgctccctctcctcccaccccgccccgaggcgcagcgcgcggcagagcggctcggtgcccggcgggcgggcggcccgggcgggcctgcggtcgggatgaggacggcgcctccgctgcagagcgctggggcggcgcgggccgggagctcgttggcggcggccggcgtggcgggcggagcgggcctcggagcggaggtgagtgcggatgcgccgcctgggcgcgcgcggtgcctggggaccccgggctggaacgcggggcgggggtgtcaccgggctgcgcgggggtctccggcccggctcccgctcctgcgccctcgggggccgctccccggcggggccggaccctcccagcgctcgcggcgcccggcccggctcccccgacctcctcctcccgggcccggacgtgcggggcagcgagcgccggggcccggcgggggccgcagccttgcccggagcggagcgttggcagcgcggggtccggctccgtgggcagtttgggaagcgcccgggcaacgtactggcgagggccgcggagcgaggggctcggggagcgggacctccgggcggggctgcggggagcggggcccgggccgccccattcatcgcggatcggagccgggggtgccccagccgtgccgccgcctcctccgggccgcccgcccgggcgtgctggccccgcggcgctccgagcgcggcataggcttgcgagtcggcggtgtcagcgccccggacgggggtgggagctttggagcccaccctgggggagaccacgccgcacccccgcccagccccgcgcacccccagaggcttttgcagagccgggaagttggctggacgtctagacccgtggggacgcggcgccccgcgtggcggcggccggaagggaaggccaatggggctcgggggactcccgcggccacccagtccttgtccctgcaccctgggccgagggcagagggacaggtccccggcgggggcgggggggc

SEQ ID NO: 79695 - DNA, 42 bp, Homo sapiens
  chr16:88460646-88460688
  hypo
gagcagggtttgacacgtctacacctgcgctgcctgagagga

SEQ ID NO: 79696 - DNA, 39 bp, Homo sapiens
  chr16:88464766-88464805
  hypo
ggatgaaggaggacccgtgagccacggatgaagggacat

SEQ ID NO: 79697 - DNA, 32 bp, Homo sapiens
  chr16:88473761-88473793
  hypo
ctcttctcagtgttacgcgaaggaaggagcaa

SEQ ID NO: 79698 - DNA, 210 bp, Homo sapiens
  chr16:88476104-88476314
  hypo
acgtgtgcagctctgcgtgaggaaaatgcaaacaaagctcggtaaagcaggccggggcccacacatgcgggcagggcatccaggcagcttgggcagagtgatcagaggtcctcgctcagtggcctgtgagcggaggcctgagtgcgacaggtgtggtggccatcttggccggggggggggggggggggcgcggggcgttccagggctctg

SEQ ID NO: 79699 - DNA, 41 bp, Homo sapiens
  chr16:88480893-88480934
  hypo
aaggtggcagcctcccgggagagagccgtgagggcagaggc

SEQ ID NO: 79700 - DNA, 30 bp, Homo sapiens
  chr16:88484563-88484593
  hypo
acctgcggccccaaccggtgtgatgccggc

SEQ ID NO: 79701 - DNA, 170 bp, Homo sapiens; identical to SEQ ID NO: 44822
  chr16:88495551-88495721
  hypo

SEQ ID NO: 79702 - DNA, 36 bp, Homo sapiens
  chr16:88497351-88497387
  hyper
gggcgggtctcgcccgggccccggcaggagccctca

SEQ ID NO: 79703 - DNA, 743 bp, Homo sapiens
  chr16:88498119-88498862
  hypo
cctttgccaggacggcgaggatgccggttccctcgagccacagctgccaaggagcccacctggcaccgctgagacggagccaggcagggctgcatcgccaccgaccttggagtcctcatccctcttcccagacctgccggtggacagattcgacccacccctctatggcagcctgtctgcgaacagggactccggtctgccgttcgcatgtgccgaccctccccagaagacggtgccgtcagatccaccgtacccctcttttttgctgcttgaggaagtatccccgatgctgcctagccattttcctgatctctcggggggaaaggtgctcagtaagacgtgtccccctgaacggacagtggttcccggcgccgccccatctttgcctgggaaggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccgtggaagcggttcaggggaggcctggggggacgtggccctgcccag

SEQ ID NO: 79704 - DNA, 30 bp, Homo sapiens
  chr16:88501699-88501729
  hypo
gaaaaaagagaaggccggaggtggcgccga

SEQ ID NO: 79705 - DNA, 207 bp, Homo sapiens
  chr16:88502150-88502357
  hypo
caagagagaccaaggcgttgggtgtgtgcaaagagtctgggagcgagcctgcggaggacagcagcagggcccacagccgatcagaggaaggtgtctgggaggagaacacgccccccttgggccccctgggttttcccgagacttccagctctccggcggacagcaccaccagcagctgcctccagggcctcccggacaacccagaca

SEQ ID NO: 79706 - DNA, 30 bp, Homo sapiens; identical to SEQ ID NO: 44826
  chr16:88502901-88502931
  hypo

SEQ ID NO: 79707 - DNA, 520 bp, Homo sapiens
  chr16:88503229-88503749
  hypo
aaagtgtgcttccagcgcttccgcagcctgggcgagctggacctgcacaagctggcccacacgcccgcgccgccgcccacctgctacatgtgcgtggagcgcaggtttggctcgcgggagctgctgcgggggcacctgcaggagaggcacgcgcagagcaaggccgggccctgggcgtgcggcatgtgcctgaaggaggtggccgacgtctggatgtacaacgagcacctgcgtgagcacgcggtccgcttcgcccgcagggggcaggcgcggaggtccttgggggacctgcccggaggcctggagggcagcagcgctgtcgcccaccttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagcaacccagacggggccgcgaccccagacagcg

SEQ ID NO: 79708 - DNA, 763 bp, Homo sapiens
  chr16:88504017-88504780
  hypo
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcctccccggggaagcagccccatcctgagtgagggctctctcccggccctgctccacctgtgttcggaggtggctcccagcaccaccaagggatggcccgagaccctagagaggcctgtagaccccgtgacccacccgatcagaggttgtgagctgccatccaaccaccaggagtgtcccccgccgtctctgtctcccttcccagctgccttggctgatggcagaggagactgcgcgctggacggagccctggagaggccagagaacgaggcttccccaggcagccccgggcctcttctccagcaagctctccctctgggggcatctctgccgcggccgggagccagaggccaagatgcggagggaaagagggctcctctcgtgttctcagggaaacgcagggccccgggtgcccgtggcaggtgtgcc

SEQ ID NO: 79709 - DNA, 195 bp, Homo sapiens
  chr16:88506346-88506541
  hypo
cctccatttgctctgcgggagaaaagcccatctctagcacaccttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatg

SEQ ID NO: 79710 - DNA, 462 bp, Homo sapiens
  chr16:88506828-88507290
  hypo
cgtgtcctctcacagcgtcgtgcctgtgaaggtgggtcaaagggtgagagggcttccttctcacccttctctccataagtatcttgaagatccatggtttgttttgctctattgtttagtttttacttgggtgcaatgtgtacgtcaaaagtttttattttgatatttgaaagagaccaaatcaggcccagaccgcctctctggaaggtgttgtaggccattcaaaacgcctccggagtgtcgcaaaccaagtgcggaggggccctgaggttgtactgtaaacatcatagtgacttgtcttttcaaatatattcccactattttcgcagaaaacctccagctgcgtgacgtctgtcctcccgccggcccccatccctggtctgcacctccctgagcctcagaacttggctcccagggtgtctgcgccagctgccactctcgggccaccgtgggccaagggcc

SEQ ID NO: 79711 - DNA, 160 bp, Homo sapiens
  chr16:88507982-88508142
  hypo
cctcccccaggtgggcgctgggcctcccctgctttccacttgttgctggcggaactcacaccgtaagggcgtctgcgaaggggcccagcgtggggagggcagcgcctgtcctcaaagccctgctctcggggtggatgtcggacaccgtcatgccagctgc

SEQ ID NO: 79712 - DNA, 274 bp, Homo sapiens
  chr16:88512417-88512691
  hypo
ccccaaaagtctcaccgtgtctcagcgtcaggctcaggcccggggccctgacatttagatagggccaggtgtggctgaggccatcgagtcattcctccggtgaagtatgcccgtgcgtcggggtgcagggcacggggtgtaggacaaatgctaccaatgcccctgtcgggaactgggaggagggtggcacatgtccgtcactgccacaggcggttccgaagcccgggccctgccccgtacagtgactgtgctgttagcccggccacctggggcc

SEQ ID NO: 79713 - DNA, 64 bp, Homo sapiens
  chr16:88534612-88534676
  hypo
cacccgcgagcccaccgcccctcaagcacccgcgagcccaccgtcccgacgcacccgcgagccc

SEQ ID NO: 79714 - DNA, 30 bp, Homo sapiens
  chr16:88548193-88548223
  hypo
ctacgtgggtgggggcggttaagggtgggc

SEQ ID NO: 79715 - DNA, 30 bp, Homo sapiens
  chr16:88550771-88550801
  hypo
tgttccagcctgcaacgctcaggccttccc

SEQ ID NO: 79716 - DNA, 168 bp, Homo sapiens
  chr16:88551406-88551574
  hypo
cctgcttggtttgttcgctcgacaagtctgtgagcgcctcctttgtgctgggtgagggtgtcaccccagggagttcccagaccgagggaatgagtgtgagggaagtgcacggggactgggcccctgggcggggcactggcaggtgatgccaggcggaggccgtggcga

SEQ ID NO: 79717 - DNA, 30 bp, Homo sapiens
  chr16:88594593-88594623
  hypo
cctgccccagcaggccgggatggcctccat

SEQ ID NO: 79718 - DNA, 170 bp, Homo sapiens
  chr16:88601509-88601679
  hypo
ggccgcagggggcagcgcccgcctggacccttggcacttaataaagaagttcagtttgatgagcatggtggtgggccagcctagttctctgagccagcaggcacacgcagccagtgtcacatccagccctgctgtgtacacaggccactgcggcccggagtggctgggcc

SEQ ID NO: 79719 - DNA, 51 bp, Homo sapiens; identical to SEQ ID NO: 44837
  chr16:88602946-88602997
  hypo

SEQ ID NO: 79720 - DNA, 80 bp, Homo sapiens
  chr16:88603696-88603776
  hypo
caaggaccctgtgaccgggacccagacctgaagtcaccccagagggccccgccacggcccggactcgaagcttagggcag

SEQ ID NO: 79721 - DNA, 30 bp, Homo sapiens
  chr16:88622299-88622329
  hypo
ccacggagcccaggacggagactcacacag

SEQ ID NO: 79722 - DNA, 205 bp, Homo sapiens
  chr16:88623960-88624165
  hypo
tgcagcctcaaggcacgggagccacggatgcctgaggcctgggaacctggaagaggccgtggggagccttccctgcagcctgcagccctgcccgtgcctcgagttccacttcatgactctgctatcagacatctggcctacggaactgtgaggcgatatgtttctgagtgtttttgttgtcactattgttgtcgtttgagacagt

SEQ ID NO: 79723 - DNA, 19 bp, Homo sapiens
  chr16:88624548-88624567
  hypo
aaaatacataaaaggcgga

SEQ ID NO: 79724 - DNA, 559 bp, Homo sapiens
  chr16:88624747-88625306
  hypo
ttcaagcgttcatcctgccgcagcctccccagcagatgggattaggagttaaagatgtgcggtgagtcccgcgtccccccatgctccgggggtgtgagtcgcgcatccccccgtcggggggtgagtcgcccgtccccccgtgctccgggggggtgagtcccgcgtccccccgtgctccgggggggtgagtcccgcgtccccccgtgctccgggggggtgagtcccgcgtcccccggtgctccgggggggtgagtcccgcgttccccccgtgctctgggggtgtgagtcctgcgtcctcccgttccctgggggtgtgagtcaggcatcctcccgttccctggtggtgtgagtcccgcatcctcccgttccctgggggtgtgagtcccgcatccccccatgctccaggggtgtgagtcccatgtccccctgtactctgggggtgtgagtcctgcatcctcccattctctgggggtgtgagtcccgcgtctcccatggaccagcgctgtaagtcccatgccctcctgtgctatggtggtgtgagtcccgtgtcctcccattc

SEQ ID NO: 79725 - DNA, 30 bp, Homo sapiens
  chr16:88627634-88627664
  hypo
aagagtagggccctacgattgtacctgctc

SEQ ID NO: 79726 - DNA, 40 bp, Homo sapiens
  chr16:88629600-88629640
  hypo
caggcgtgggccaccgcgcccggcccgtttcttttgttat

SEQ ID NO: 79727 - DNA, 95 bp, Homo sapiens
  chr16:88633091-88633186
  hypo
cacaaccaaccagcccgtatcgggacacgatcattgacttaagtccacagtttacattacagttcactcttggcgttgtgcgttatgtgggtttt

SEQ ID NO: 79728 - DNA, 397 bp, Homo sapiens
  chr16:88683701-88684098
  hypo
acctgcggctggagacggagttgtgccgctctctccgtcctagtttgccttttgaggcttacccactcctccacctgggctgttttaaaatgattagagcagaacctttcaatcaattctatcaaatgcatctgtagagctaagggggcggtcccttatgtgaaacctaatctttatagctaggccgatgggtgtgctcaccgccgaggcacgtcattacgatgctctttggctagtcattgtcattagaaatgtaaacactgattggggaccttcccgcaggagctgtctgggctgcctgctgtctccaagctattcaacttccaggtttacctttgcagctttgggtgccccttcagggcttgagcttggcaggctcctgcggtggggttgtggg

SEQ ID NO: 79729 - DNA, 53 bp, Homo sapiens
  chr16:8870353-8870406
  hypo
ccccctcccctgccccgcccccaccacccatggctccccgcagcagcctccgg

SEQ ID NO: 79730 - DNA, 54 bp, Homo sapiens
  chr16:88709735-88709789
  hypo
gcgggagggcaggtccggggcgaggtcacacgacctcgtcggtcaccgggatgg

SEQ ID NO: 79731 - DNA, 491 bp, Homo sapiens
  chr16:88722326-88722817
  hypo
ggtggtggcgcccgccgcatgggagcggttcctgagcactcaaccacgcttctgttccttcagcccccgctgaccccaggagccaagcaaagcctggatggacgccttcgctcctgctcccggcagcagccctgactagggacagaggccaccgggctgctgctccacccgccccaccccactcaccacaaggatgagcacgcggagttcaggccagtgtgactcgggggccacttgccgagcgatgctgtccttcccgtcggcctgctctcccatctgccactccacaaagcccccatacaggctccggcaggcgctgcctgagccccggcgagccacttctgagaggtcactctccacgccgtagacacgggccagggtgtaggctgcaggcatgcggattcagggagggtcctcagagctgcctgcgctgtgctccctgacagctcaccgccccaggaacgtcccacaccccacggcaaatggggatt

SEQ ID NO: 79732 - DNA, 30 bp, Homo sapiens
  chr16:88725656-88725686
  hypo
agcacaccatctgctcggttttgtgcgagg

SEQ ID NO: 79733 - DNA, 159 bp, Homo sapiens
  chr16:88757527-88757686
  hypo
tgagccatcaagcagcgaggcagcgtgcgtgtgagtctgcaggccacaggcgtgttcgtgcgtgtgtccatgggcgtatgcgtgtgggaagtcgcagtagctgctctgaggtgacatggaggctgggcatcagcgggtaagtcccgggcaccaggagag

SEQ ID NO: 79734 - DNA, 30 bp, Homo sapiens
  chr16:88760519-88760549
  hypo
ccgtaggaggggtcccggcctccccacttt

SEQ ID NO: 79735 - DNA, 30 bp, Homo sapiens
  chr16:88780737-88780767
  hypo
ggtggagccccagcccgtgtgattcacctg

SEQ ID NO: 79736 - DNA, 294 bp, Homo sapiens
  chr16:88791525-88791819
  hypo
gccaccaggaggggtcggggctgtgagtgctcccgtcttggagacaggataggtggagacagacacggacacccacagtgacgggggccgtgtggggccatggggctcagagcccatgtgcgtggacggacagtcacagggcggccatggggcctgccagacagagggtgatcatgcggacaggacaggcgggctgggagccctgtgggacgtcacatgggcacagacgcagcacacgccagcaggcacagacatgctggacacggggccctgggtgcccgactccagctgcac

SEQ ID NO: 79737 - DNA, 398 bp, Homo sapiens
  chr16:88793275-88793673
  hypo
gatgcgggtggcccccgtgacaaacaccaccaccagcaccagccagaacaggtatcggaagacggccaccttcagcatgtcaaggtaggacctgccaggccggagcgtcagggcgggcgccccggccacccctcccagaaggttccccgtggagggtgacgtggaacccacctgcagtggataaagttgggcacggggttgggctccccccgcagcggctccaggcggtcggtgttgacgccagccatgcgctgccactcctctgtgcgctcagctgagaacacctgccactgctgggaggcgcacagcagcaggagaaagtcgcctgcaggacacaggagccgccgctgtgccacacggggacccacacgaggtgggcacggcgcataaatcccacc

SEQ ID NO: 79738 - DNA, 148 bp, Homo sapiens
  chr16:88794012-88794160
  hypo
gccacttgatgagtgcggagttcatggggacggcccggctccagcgccagggataatctgggggaaggggtgtcatgtcaggaagggccgggcctgcctggggcctgagacacccggtccccacccgttgacccgagtctatcaccag

SEQ ID NO: 79739 - DNA, 195 bp, Homo sapiens
  chr16:88794566-88794761
  hypo
tgggagtcctgctgacgtggcgttctgataggaccacgtgctggggatgggagcggccggggcctgctggggagggagccgtggcactgccggcccccggccacacttcctgggaggcgtgtgaggcagggagggtcggtccctaaggactgagggcatggatgtgactccacgcatctgcgaaacccacagccc

SEQ ID NO: 79740 - DNA, 30 bp, Homo sapiens
  chr16:88797788-88797818
  hypo
cacggccgacccgcacggggcccggagagg

SEQ ID NO: 79741 - DNA, 271 bp, Homo sapiens
  chr16:88798735-88799006
  hypo
gcctcacctccagcccgaatttgtagaagaagaagttgatgaagtacttgaggcagccgagcagatcctggtccagctgctggcgggtgccgctggcaaacacggcctgggcaggcagcggggccagctggtgctgccggcggtagtgctcctggcgccggtacacgatggcctcgaataccagcagcagcagcacttgcaggtggttctgcggagggcaagggtcagggggcagccgggtactcgcccgcccagccgcccaccagccctt

SEQ ID NO: 79742 - DNA, 90 bp, Homo sapiens
  chr16:88800047-88800137
  hypo
agctccagcagccgccgcaggaacacctgcacgcgtgagaggacgtccgagaagccggctgccagctccagcagccgctcagccaccagg

SEQ ID NO: 79743 - DNA, 52 bp, Homo sapiens
  chr16:88801866-88801918
  hypo
gcatgggttcacttgcgctcacacgcagagtcacacacgggttcactagttc

SEQ ID NO: 79744 - DNA, 52 bp, Homo sapiens
  chr16:88802185-88802237
  hypo
aatgggcagagcccacgctcacacacactgtcaggggcgcaggggtggtgcc

SEQ ID NO: 79745 - DNA, 54 bp, Homo sapiens
  chr16:88802631-88802685
  hypo
gtgggcagctcagggcgcaggtccatggcccacacgtagcgtaggcagcacagc

SEQ ID NO: 79746 - DNA, 197 bp, Homo sapiens
  chr16:88803266-88803463
  hypo
gctatgggcagaacacgagggctccggcaattgggctgacaccgtccctgagcgtcagggatggccctgccagcacctgccgttctctgggcctcactttccttgaaagggtgggaaaggtggccctgaccccctttccagctctgcgcacctgaagactctcaggacccccaccccagggccgtggcttcatttgc

SEQ ID NO: 79747 - DNA, 41 bp, Homo sapiens
  chr16:88804816-88804857
  hypo
gacactggagagggccgaggggtgggcgatgcctgcggggc

SEQ ID NO: 79748 - DNA, 90 bp, Homo sapiens
  chr16:88805842-88805932
  hypo
tggcctggctgccaccggcccagtgtccccatctgtgactcgggggctctcctggtggctgaggcgccaggtgcccgggctgagaccgca

SEQ ID NO: 79749 - DNA, 30 bp, Homo sapiens
  chr16:88822251-88822281
  hypo
ctgaggagacagtggcgctcaggagtcaac

SEQ ID NO: 79750 - DNA, 50 bp, Homo sapiens
  chr16:88827020-88827070
  hypo
ggacaggcaggggcccgaggggagccacccgtcttcgaggcagcagcacc

SEQ ID NO: 79751 - DNA, 193 bp, Homo sapiens
  chr16:88827321-88827514
  hypo
ctcatctgacctacacggggcagggtcctgcaggcctggtggctgctgtgggctgggcacccaccgcacctgccacagccatctgctctcagacctgctggcgtggagagtcaggacaccctcccggacacactcagcccgcagcccctggaggggtttgcagggcagggtgggggtccgtctgtgaagaagg

SEQ ID NO: 79752 - DNA, 67 bp, Homo sapiens
  chr16:88831230-88831297
  hypo
cgtgacctcccaaaacgaggactccgccctcggcaccaggggcagacactggcgaccactccaacca

SEQ ID NO: 79753 - DNA, 176 bp, Homo sapiens
  chr16:88832651-88832827
  hypo
aaggcaggggagtgtcgcctaagggcccggaggaggaattcccaggaccgccacagagaagcccggcctgagcgcacagcctggactcgagactgcaacagcggctcttgacagccagcgcgccctgcgaacttcagacgtgacagccccacaatcgcgtgcgtcagctccttaaa

SEQ ID NO: 79754 - DNA, 41 bp, Homo sapiens
  chr16:88871924-88871965
  hypo
agtaccaggtgctggcggagatgttccgcagcatggacacc

SEQ ID NO: 79755 - DNA, 30 bp, Homo sapiens
  chr16:88875855-88875885
  hypo
caggaggacaggagacggctcttgtgggaa

SEQ ID NO: 79756 - DNA, 148 bp, Homo sapiens
  chr16:88879949-88880097
  hypo
gggctgttgggctggcgtgggaacagcaaggagccccgagtcctgcccttcaacaaccaatgtggcgctggcctctggaggaggccggccgggaggcagcgggagctgggcacctgattcttggcagctgctgagaaggtgtgaaagg

SEQ ID NO: 79757 - DNA, 39 bp, Homo sapiens
  chr16:88880594-88880633
  hypo
tcctgaggtctgaggcgccgtgggcgaggaggagggtcc

SEQ ID NO: 79758 - DNA, 33 bp, Homo sapiens
  chr16:88881413-88881446
  hypo
tataggcgtgagccaccgcgcttggcctcgagc

SEQ ID NO: 79759 - DNA, 896 bp, Homo sapiens
  chr16:88882683-88883579
  hypo
cactgcagcctgggtcgtagagaaggacccagcagcacggagtgggattgggtgtggaaggcagaaggccagggctcctccacggctggtggccctgggctcctggggccccgagactcaggggtcctgagacagggacctccctgctccaccactgagtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggctgaagtctgcagctgccgaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgagggccgcacgtgtcccatctgaaggagctgtgaagacctgccctgctgggacccacatcagctgtgctgggaaacaggcctttgcggccactgcacacgcgggatggctgggccgtccacatgccacc

SEQ ID NO: 79760 - DNA, 187 bp, Homo sapiens
  chr16:888838-889025
  hypo
tgagtcttgactgagcgtctgaggggcagctgggccccgaggctgatgggaagagccagacgaggcctgggaagatggatccgtcccagtgtggccgcgcggctgtcaggagggcacggggactgggcgcggccgtcaggaaggttcggggactgggctgctgtagcaaactcgggggcttaaagca

SEQ ID NO: 79761 - DNA, 126 bp, Homo sapiens
  chr16:88884153-88884279
  hypo
agccaggcagaggcccgggtggccggctgtggacctgcggctgccctggtgcagcgttgttctggtccccgagtcgcttggctcctgcctcccgaatcccggacgccgccgcgtgtgctctgaggc

SEQ ID NO: 79762 - DNA, 34 bp, Homo sapiens
  chr16:88898821-88898855
  hypo
ccgactggtgcttcccgaacgtgaatgttcacaa

SEQ ID NO: 79763 - DNA, 91 bp, Homo sapiens; identical to SEQ ID NO: 44857
  chr16:88931237-88931328
  hypo

SEQ ID NO: 79764 - DNA, 47 bp, Homo sapiens
  chr16:88933367-88933414
  hypo
cactgcatgaacactcgatctaagtgggaacacgggagtggtttctt

SEQ ID NO: 79765 - DNA, 30 bp, Homo sapiens
  chr16:88934321-88934351
  hypo
ctcctacccccaggccgaggccatcctctc

SEQ ID NO: 79766 - DNA, 204 bp, Homo sapiens
  chr16:88935284-88935488
  hypo
gttcgcattcgcctccggtgagcggagggtaacgttagctctgtcctttgtcccatacctgggaagataagctgctagatcacactatctgggtgggatccagcagaactgtttcagagccaagatcttgggacccacaaggaatttccctgtaagcgcgatgcgaggaggcacaggcttcttcatcttcgtggctgtccaatt

SEQ ID NO: 79767 - DNA, 220 bp, Homo sapiens
  chr16:88941005-88941225
  hypo
gaatggaggtggtgccggggccagggcaatgtctggaggacagactcgatctatcttgactttcagaacgaggtttctgttgtcagacttggttccagacggtacctgaccggtggtgacccgacaggatccatccttatgatgctcaaagaatgaatttttaccaccgtgaaagaaccaccagcaggcaaaccgctcctcccctcggggccactgttcg

SEQ ID NO: 79768 - DNA, 126 bp, Homo sapiens
  chr16:88941444-88941570
  hypo
aactcctgatagccacgcacacagatgccaggccacgggccacgccacgcgcacagatgccaggccacgggccacgccacacacacagatgccaggccacgggccacgccacgcacacagatgcca

SEQ ID NO: 79769 - DNA, 203 bp, Homo sapiens
  chr16:88941957-88942160
  hypo
gtagctgcggtggggcgatggggccgagaggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaagcagtcgagaatcaacccaa

SEQ ID NO: 79770 - DNA, 178 bp, Homo sapiens
  chr16:88943054-88943232
  hypo
tgggcagagccgccgcgcctgcggcatctgctctgctgtctaaagctcagtcgaggcttctgaggatgcttgaagagacgttgtcaggaggtctccgcgcggaatcattaggtagctgaggcaggtgcactgaatgcggttttgttggttctgtgtcttctttcggagaggggcagta

SEQ ID NO: 79771 - DNA, 615 bp, Homo sapiens
  chr16:88943442-88944057
  hypo
ccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggctgctgagatctcaccatccgcctctgctgcatc

SEQ ID NO: 79772 - DNA, 30 bp, Homo sapiens
  chr16:88944446-88944476
  hypo
gccaggcacagtccccgctccaggccctgg

SEQ ID NO: 79773 - DNA, 94 bp, Homo sapiens
  chr16:88944924-88945018
  hypo
tgcctcccaggtgcacgggcacaagcatcgtaattctcaggcctgccgtgtgcaccgggagggagccgggcgcctcggacgccacctggggccc

SEQ ID NO: 79774 - DNA, 711 bp, Homo sapiens
  chr16:88945368-88946079
  hypo
cagccaacctgggctcgagtcctggccccaccgcttcccaaggccgtgacctcagacaagctgccaaccctctcgagccctcagtttctggaactacagaacggggacatccataggacgcctcactgaaccatgtgggatctctgtgctgataaagcacagtgtgggcggggatggcgtgcctgctgcaggatgcccgtgacaactgtgctgatgccacgtggaggctcagaatcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctca

SEQ ID NO: 79775 - DNA, 445 bp, Homo sapiens
  chr16:88948324-88948769
  hypo
tgaggagcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgt

SEQ ID NO: 79776 - DNA, 30 bp, Homo sapiens
  chr16:88951851-88951881
  hypo
tctctgcccctctgccggggcccatgccag

SEQ ID NO: 79777 - DNA, 624 bp, Homo sapiens
  chr16:88952174-88952798
  hypo
gcccactggggtgtccgcccgtgcagccaccaagcctgctggccctagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgt

SEQ ID NO: 79778 - DNA, 179 bp, Homo sapiens; identical to SEQ ID NO: 44867
  chr16:88955189-88955368
  hypo

SEQ ID NO: 79779 - DNA, 619 bp, Homo sapiens
  chr16:88956093-88956712
  hypo
ctcctcctccagggacgacaccccgcgattcctcctcctccagggacacttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctccagggacgacgccgtgcgattcctcctcctccagggacgacgccccgtgattcctcctcctccaggggacgtttcaaatccctggacgatgccccgcgattcctcctcctccaggggacgtttcaaatccctggacgatgccccgcgattcctcctcctccaggggacgtttcaaatccctggacgatgccccgcgtgaatctagaacatgcctcacctccctgtagtccccgctacctgggaggctgaggtggaagattcccctgagcccgggagtgaggccccgttctttccgcgtgtccctccacgctgtctcctcaacagcctgaggatgattccattttgcagatacagaaaccgaagcacagaggaa

SEQ ID NO: 79780 - DNA, 622 bp, Homo sapiens; identical to SEQ ID NO: 44870
  chr16:88957373-88957995
  hypo

SEQ ID NO: 79781 - DNA, 184 bp, Homo sapiens
  chr16:88958295-88958479
  hypo
gaagggaatgacaaacggccgcagagggaagttggtggcctcctgaagcttggaatgaaactcctcgatcgtcaatgtcgagttctgcaggggagaaaacccacctcacatcagcaccgctcggcatgtgagccagcgccgacccacccatgcctgaggaggaggcttccgtgttggaggcagg

SEQ ID NO: 79782 - DNA, 81 bp, Homo sapiens
  chr16:88958818-88958899
  hypo
ggccattgctgaagccgttgggtgtgcacggtgcaccattgatggctgttggtgagtggctgctgccgttcatcactgcag

SEQ ID NO: 79783 - DNA, 111 bp, Homo sapiens
  chr16:88960414-88960525
  hypo
ggaggactgaagccccgcacacactcacggctggctcccgcctcctgcagaaggacacgctccctacaaagggtaccaactcccctgccctcagagcgagccctccatttc

SEQ ID NO: 79784 - DNA, 30 bp, Homo sapiens
  chr16:88961870-88961900
  hypo
tgggctccgaggaaccgaagacacacagca

SEQ ID NO: 79785 - DNA, 347 bp, Homo sapiens
  chr16:88962615-88962962
  hypo
ctcagactttccctacgggggggctgcaggattgagacatctctgttgctggggccgcgaacctccacacgctgttctgagcggctgctcccctcaaccgggcaacctgcacagggggtagcctgtctgcgcccctggcttgaacgatcttagcagcgccttcctgggctcaggatggacgcaccggccctctggagcgcgcggcaccgataacggcgtcgtattctggggctttccctcttctggggggacagtggacgctgacacaggatgcaccgagcccctggtctctcgccttctgagcctctgtccggaggaccccaccgcgctgccgagtttccctctca

SEQ ID NO: 79786 - DNA, 586 bp, Homo sapiens
  chr16:88963177-88963763
  hypo
ggggcccctgcccaccgccccggccagcctgggcctggccctcccttaggtgcgcttaccagccttgccccgggtgcctggtccttccggcggcctgctcgccctcgcctgcccgcgcactccctcccgcgctgctgggcagtctcagcagctaaagagacgccaaaaataaccccggcacaagcgctttcattcccacgacaggtgtgttcctaagttagaccgcacacgtgtccccagctgaggattgggggcacacgcgagcacccccgcggctcccccagcctcagagccttggtgggggggtcagatgcgacagaggcaccctaacgcagcccctcctgtcacccctgctccttgctgtgggggctccgggatctgggattcaccaactttgccatccataagatcacagagtggatgacaagagccactgtccaggagctgcacgccaggcgcgagtgcgtggccaggcccatcacagaataatggctgtgaaaaggacagccctgtgcaacagaaacaacgcacagttgttctgctgccctcgttcttagagccgggagtgccacgacagccacacctg

SEQ ID NO: 79787 - DNA, 105 bp, Homo sapiens
  chr16:88964508-88964613
  hypo
aagcagccatgaaaacggccgtggggcagcgtcgcaggcccgtcctctcgatctgtaagcaaaataagaagaacacgctgtcaggaggggcgtgggcaggagact

SEQ ID NO: 79788 - DNA, 51 bp, Homo sapiens
  chr16:88965028-88965079
  hypo
ctcagggacctgggccgaagccgcgtgtcctaaaagcgacctgagactcgg

SEQ ID NO: 79789 - DNA, 45 bp, Homo sapiens
  chr16:88965602-88965647
  hypo
tcagaggccagtccccggggaggagcctcccggcagggctctgca

SEQ ID NO: 79790 - DNA, 728 bp, Homo sapiens
  chr16:88966234-88966962
  hypo
gagcgtttcctcccccggggctggggtatactgcaaatttaacacagcagcggtctccctctacctatgtgggctcggtgtggtcgcaagctgcctggtagagagacggcccgtggtttgtaccagaccggagggctcttccgaagagagggaagggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggcccccagcctcagcggcagagccagggagggagccaggcctggcctatagccacccggtgctctgaggacagtcgtgacgtaaagggactgaggaagcagctctttctggcccgtcagggacccggggcaagcaggac

SEQ ID NO: 79791 - DNA, 1111 bp, Homo sapiens
  chr16:88967701-88968812
  hypo
ggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtgaaggagggggggcgtgtggccccctgggatgcggcaggcggtgggggcggcatgctggggggtgtggaccggggctgcgtcttcacctccgctggggagtccggcatcgctgaggccttagctttcctgtccactggggctgcgaccaacggagaaagaaagagtcggtgaagcaggctaagtgcaaaggccagggcccgcagccccacggttcccagcgaaggccccactgagtgtccgcccagcgctggggcagtctgccccaggtgtcctgacaggtggctgacgtcccacgtgcaggatcacgggggcagaaccaggccggaggacgggcttgggccagctcatctgaggtggccggccaggctggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaa

SEQ ID NO: 79792 - DNA, 93 bp, Homo sapiens
  chr16:88970441-88970534
  hypo
tgggccgtcatgccacggcgcaaggagtcaccacagccgtcacccaacaagggctcatggccaccacctgcgtgctcacggccaccacctgcg

SEQ ID NO: 79793 - DNA, 131 bp, Homo sapiens
  chr16:88976603-88976734
  hypo
cttccaccaggtccccgcaagtctgcctctcatcctcacacctttgctgcaggctgcctccttcccggtgatgctgcagcccgcgcggcccttcaccctggctcccctcctgtcaccggctctccctgtag

SEQ ID NO: 79794 - DNA, 204 bp, Homo sapiens
  chr16:88977918-88978122
  hypo
ggggcagggagggaacgggaacctcaggcgccctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccaccca

SEQ ID NO: 79795 - DNA, 50 bp, Homo sapiens
  chr16:88978924-88978974
  hypo
gaagccttccctgaccgcccatgtccctgcccccacgctctctgccccat

SEQ ID NO: 79796 - DNA, 30 bp, Homo sapiens; identical to SEQ ID NO: 44881
  chr16:88980132-88980162
  hypo

SEQ ID NO: 79797 - DNA, 44 bp, Homo sapiens
  chr16:88990078-88990122
  hypo
gcatcctccgcaacccggctcacacatgtcgctcctgctgtcag

SEQ ID NO: 79798 - DNA, 30 bp, Homo sapiens
  chr16:88990804-88990834
  hypo
aaaaggagagggacccggggtccaggaagg

SEQ ID NO: 79799 - DNA, 30 bp, Homo sapiens
  chr16:88992350-88992380
  hypo
aggaccagaaagacacggctgtcctgtctc

SEQ ID NO: 79800 - DNA, 152 bp, Homo sapiens
  chr16:88993078-88993230
  hypo
agctggccatggtcccgtgcgtgccagggtggggcctgctgagcctcagtttcctcggctgtaagacgggacggaggtgttcacagtgggggttgctgggaattcctcctctggattgggctggtgcctcggtgcaccgtgggctcccagga

SEQ ID NO: 79801 - DNA, 380 bp, Homo sapiens
  chr16:88994340-88994720
  hypo
ctgcccagtgtggggcgtcctctgaagtgggagccgcagggagggcctcacggaggcctctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctgtccttgttgggggcgtttctgggatcctgtggtttcggggacgctcccct

SEQ ID NO: 79802 - DNA, 71 bp, Homo sapiens
  chr16:88997925-88997996
  hypo
agaagggccgtgggccggccccgtggacgagccagaggtggagaagggccgtgggccggccccgtggatga

SEQ ID NO: 79803 - DNA, 84 bp, Homo sapiens
  chr16:88999377-88999461
  hypo
gggaaaaaaagaaagaaagaaaagaaaaatggcctcttgggccaggtcctgggagctcgagggaggtgacggcatggagccagg

SEQ ID NO: 79804 - DNA, 29 bp, Homo sapiens
  chr16:88999664-88999693
  hypo
cctcacagtgccacacgtctgcacgcctc

SEQ ID NO: 79805 - DNA, 136 bp, Homo sapiens
  chr16:89000126-89000262
  hypo
cacgcctctgcacacgtcacgtgcctctatacgcctcacacgcctcacagtgccacacgtctgcgtccccacagccatagtggccacttcatgccacgcgtatgtgacttggtgaaatccccgtccctctgctctg

SEQ ID NO: 79806 - DNA, 199 bp, Homo sapiens
  chr16:89000985-89001184
  hypo
ggacagatggggacacggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttctcggagacggagtctcgctctg

SEQ ID NO: 79807 - DNA, 249 bp, Homo sapiens
  chr16:89006347-89006596
  hyper
cccgccccttatccccggccgacccgtccgccgaggtggctgccctgggaacctcctgttcctcgtccaggagaggaaacgcacacccgggccggacgcacagaagccgcaccctggctggggccacaagcctgacagctaccgacaagcccccacccacaggagcacgcgacgtgctctcttttcaagggaaaggtttttcttcctgggccctggaatgggcctgaagtcagccggcctcagcccaca

SEQ ID NO: 79808 - DNA, 90 bp, Homo sapiens
  chr16:89006819-89006909
  hyper
tcccacagcctggctcggggcctgcccaacacagatggacgcttcccaaaggctgtgcgcgccatcgctgccacccggctgtgccgaggc

SEQ ID NO: 79809 - DNA, 481 bp, Homo sapiens
  chr16:89007308-89007789
  hyper
caccaactttgaaaacggcccgtgcgctcggcgcggctgcggcgcagatccgggaacggcagccgcgggcggagtcggggtagagcggcggcggcgcgcggggcggacacggcacttacggtcggggggtccgggggatccggcgggcggcggacggcgcacactcgcgactcggtccgggagtcgctgctccttccagcttggtccccgcctccacgactcaggggcggctgcgcgctgtcttctggcgccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgccccgcgcgctcc

SEQ ID NO: 79810 - DNA, 224 bp, Homo sapiens
  chr16:89008368-89008592
  hyper
gcccggggccacctccgtgcgtggccggcaggggtcgcgctccccccgctcagcctcccgggcgggtccgatgcgaagccctcgcttcccgcgggtcccggggccaggtcatttgcatacactttgcattcatttgcatatcgtgcgtttcatgtccacctgcagaaacgccccgagccgctgctctgccctctccgcactttctctgccggcaggccccctcc

SEQ ID NO: 79811 - DNA, 196 bp, Homo sapiens
  chr16:89010286-89010482
  hypo
ccagcgtcacctgtgcgggagacagaccacgggcgagcaggacctcggagggccacactcagggctcgggagggggcagagccgtggaggagggagctcgagggtgtgcccatggagctcccagtgtgtcgctgtctgtagaggcaggagctcaattcacttaaaagaaaccaccacggccgggtgcggtgggtca

SEQ ID NO: 79812 - DNA, 41 bp, Homo sapiens
  chr16:89015672-89015713
  hypo
gatgggttgggaggccgggcgcggcgcctcacacctgtaat

SEQ ID NO: 79813 - DNA, 30 bp, Homo sapiens
  chr16:89016452-89016482
  hypo
actctcgaagtcacacggcttccctgcttc

SEQ ID NO: 79814 - DNA, 30 bp, Homo sapiens
  chr16:89022691-89022721
  hypo
agaaccccacgcacacggagctcatggcct

SEQ ID NO: 79815 - DNA, 412 bp, Homo sapiens
  chr16:89025720-89026132
  hypo
agaggggtctccttgcgggagagagttgaagtagtcctggcgatgatggtgggctcccaggagaggtggagggaacacgcatgcacgcccagggctggaggcacgtgggtgttcagggcctgtgaggaggcccgggcaccaaggcagcacccagcgcttacagagcctgcaggtcttggacagaggtgcaggcagaggcaggaggtggcatgggtcataccacctgtaaaagccaggcgcagtagagaatgttctagaaataaatgtgatgctgcgattgcctgagagggaacccaggtgcaggagagggaaggtcccggggaaaccctccttttcctcctccttcctcccagcagctgggaaaggcgatggagagaaaacgggagcagggcagagacggtatctgggatta

SEQ ID NO: 79816 - DNA, 114 bp, Homo sapiens
  chr16:89028699-89028813
  hypo
tttccactgcatactcgtacttttttacttttacaaaagcatcaattgccaatggatatttattttccacaaataacatgagacgccatgaaccagcctcgaaggtgaatgcac

SEQ ID NO: 79817 - DNA, 81 bp, Homo sapiens
  chr16:89029708-89029789
  hypo
atcttctgccaggggcgggcgctcatcttctgccaggcttttttttttttttaagaatgttaagatcttttaaaaatttgt

SEQ ID NO: 79818 - DNA, 201 bp, Homo sapiens
  chr16:89029849-89030050
  hypo
ttagtacactgacaacgttctgcaaccagcgcctccacctaactccagagcacatcatcaacctcgcagtgaatcccggccccaggagctgtcactgtcttctccacaccctccccatggtgaccccaaatccactctgtctctgtggatttgttatcgtggacattccataaaatgggaccagaccgtatgcggcctctt

SEQ ID NO: 79819 - DNA, 163 bp, Homo sapiens
  chr16:89047584-89047747
  hypo
gaacagtgtcatgtacggaggagccttgccccggctttctggtcctgaataaggtgtggacagttggggtgagccacagagggagtgggggccgggggtggaggcaggaaaaaacctgccccgggtgttcaaggcagtgcaggtgaagcggctcatagctgga

SEQ ID NO: 79820 - DNA, 601 bp, Homo sapiens
  chr16:89055344-89055945
  hypo
tccttcccacccactcggctccacgcagggcaacgggagctcctggctcccagcaatccccttcccacccactcagtgtctcgtgcatggcacacacgtgtcctgcgggcccgctgggagctggctgctggtccctgtacgaggctgggggtctgacctcaccaccagggacagacagcaaagcagaccatgagacaggggagcaaagccgtgcggtgggaggggtgaggcgtgcggcatgactgcagggcggggagggcctcaaggggagaggcaactcggggcagcccgcatggcccaggcgtgggtcaagctctgggaggcacgctccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggagccggggccatatggcc

SEQ ID NO: 79821 - DNA, 364 bp, Homo sapiens
  chr16:89072463-89072827
  hypo
cttgagcaaaggcttcgaggtggaggttttaggtgggtgaggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctggagacaaggaactgactgcaagtggaccatttgcagggcgaccccaagggcag

SEQ ID NO: 79822 - DNA, 192 bp, Homo sapiens
  chr16:89084022-89084214
  hypo
tgaggaggtggccttcgggggagggtgaatgcccttcggggggcagttagggcaggaggctggggtccccccgatgggatcagtgccctcaccaaagaggccaagggagacccctgggagtgcacagagtgaaggcgtcacccacagccaggaagagggccctccccgccccgtcctcggacgctgatggca

SEQ ID NO: 79823 - DNA, 116 bp, Homo sapiens
  chr16:89086081-89086197
  hypo
ccggcaccaagggcacgggatggcagccactgggaaagcaccacggaagccgcatcggcaggttcctgctgccaccccttggtgccaggtacagggcaggacgcagaggggaagct

SEQ ID NO: 79824 - DNA, 37 bp, Homo sapiens
  chr16:89088526-89088563
  hypo
attcactgcacaccccgccctccgccccttggtgaac

SEQ ID NO: 79825 - DNA, 30 bp, Homo sapiens
  chr16:89090173-89090203
  hypo
ggttcccggccctcccggcccctcacccct

SEQ ID NO: 79826 - DNA, 81 bp, Homo sapiens
  chr16:89103448-89103529
  hypo
gcaggcggagaggtgcgggcaggctaggggtttgctccattctcttggccgcctgaaagtcatcaacgtggcaggttctcc

SEQ ID NO: 79827 - DNA, 30 bp, Homo sapiens
  chr16:89103807-89103837
  hypo
gtggcttcgacatgacgcagggtagggggg

SEQ ID NO: 79828 - DNA, 59 bp, Homo sapiens
  chr16:89104048-89104107
  hyper
acacccctcctgagacgctcctggtcccgtgtgcccatgatatccgggctcaggtggcc

SEQ ID NO: 79829 - DNA, 183 bp, Homo sapiens
  chr16:89105500-89105683
  hypo
atcaacaccccttcccgggaagggtggtgctcgccctgcctccttcccaaggtggaggtctgcggggcgcaggtctctgtctggggctgccatccacatacgctgtggctcatgtacagtgaccacctgctgcaggatgagacggtggcacccgccgctccctgagagcggcacttcactgca

SEQ ID NO: 79830 - DNA, 184 bp, Homo sapiens
  chr16:89107642-89107826
  hypo
aggtgggagggcaaccgagtcggcctgggttcaagttctccagagtgccggccctccactcgagttcccctgccccggggaatgccctttccctacacctgcaatcccctgagggacgggaggaggccggtagtccatgagcatctgtcactggctgtgcggctctgggcgctctgggccagtt

SEQ ID NO: 79831 - DNA, 39 bp, Homo sapiens
  chr16:89108941-89108980
  hypo
cctgccagggtgcagcgatgggcgcggggctggcctgcc

SEQ ID NO: 79832 - DNA, 211 bp, Homo sapiens
  chr16:89109448-89109659
  hypo
gccagggagaattgacgagcagtggcgtcctggaattcccgtgaggtggcgggagaagattctatgattgatccgtcatgcctgccgtggctcaggatgggaccggcctctcaagctacagatcaagaaactgagaagggagtagcctaaagtcaccatgagagtggccaggtctgggccggcctggcctccaccccgcagagaccatctc

SEQ ID NO: 79833 - DNA, 30 bp, Homo sapiens; identical to SEQ ID NO: 44896
  chr16:89110091-89110121
  hypo

SEQ ID NO: 79834 - DNA, 116 bp, Homo sapiens
  chr16:89115281-89115397
  hypo
gcccagggtgagccacgcaggcgcgtggagagggcaccccatgtggggcagactcccgctcagaggggcctcgctgtggccaccacctacagaccagaacccggggccggggtctc

SEQ ID NO: 79835 - DNA, 30 bp, Homo sapiens
  chr16:89116859-89116889
  hypo
ccttgcccagcagagcgggagaagcccggt

SEQ ID NO: 79836 - DNA, 943 bp, Homo sapiens
  chr16:89119921-89120864
  hypo
cgggcatcggggagacgaggtgttggggacagagccggcggtcatagcctccagctcctcttcctgcatggagtgacctggcgccgcgaggtggagctggtgtccgagccctgaggatgaggctgctccctccgcaaggtgggcgaggagccaggaagagccaagggagtggccaccctgccctgacggccaccaacggccaccacgtcaccctagaagacaacccaagcccgtctccccacacctcgcggatggtgcagtgcagagagaaggccgggcgggtgctggggggcccatctccccgagccttgcaaatagtgcagtgcagggagaaggccgggcgggtgctggggggcccgtctccctgtgactcgtggacggtgcggtgcagggagaagggcgggcaggtgctggaggactgagtgaggcccctccaggatggctccctgcccctccatgcgctgggtcctcgggccaggacaggttgcatctgggtcaccagccccctcacacccgctcgcctgaaggcggccgaccctggccactggtcgcctggtggcagaagcctcttctgggcattttcaggcaccgcaatgctcttcacagcgttaactttttttttatccaaccaaggacaacctcagcttcagaaagccctggaatgccccacaatggacaagcaaggaacaccctccgggacggaccgcgagactcggccctgagatgcctcaataccctggacaccccagaacctcagattgcgtggctggggctcctgcggccaccctgctccccagaacctcgtcgtcttcccggtgccctgcggcaggaacacagggctggagccgacccccagggcatggctgggagctgcgggagtgaacggggagttaacccccagggcatggctgggagctgcgggagtgaacggggagctgcctgt

SEQ ID NO: 79837 - DNA, 30 bp, Homo sapiens
  chr16:89121266-89121296
  hypo
ttccctcagcctggacgctcctcctgcatg

SEQ ID NO: 79838 - DNA, 50 bp, Homo sapiens
  chr16:89122497-89122547
  hypo
gcacgtgggagagtgcgccacccgtgtgtgtggtccgtgagcatccacca

SEQ ID NO: 79839 - DNA, 30 bp, Homo sapiens
  chr16:89131236-89131266
  hypo
gctgcagggatttgccgggagagcccgggg

SEQ ID NO: 79840 - DNA, 192 bp, Homo sapiens
  chr16:89134608-89134800
  hypo
ggctctgagaggggtcggtggcctctgtctcaactcagctcgctcagcggccctgggaagccaggggaggttctggagccaagctccagccagacccatcccatcagcattgctgcagctccccaagggctctgctgcgtgcttggaagtgaaaattgctgatggagggggtgggtccgacgagaagagagg

SEQ ID NO: 79841 - DNA, 152 bp, Homo sapiens
  chr16:89138016-89138168
  hypo
gaggaaagacagacacggcgttggctgcgcgggggcctgcatccctcccgaccttctcatttgatcctcctgccctatgcggttggtgccaacgttcatcccattttacagatgagtaaactcagcttcagtgaggccggggccttcctgga

SEQ ID NO: 79842 - DNA, 43 bp, Homo sapiens
  chr16:89139238-89139281
  hypo
gggctgctgggaggacgagtaagaaaagcgggtgaagcacaga

SEQ ID NO: 79843 - DNA, 25 bp, Homo sapiens
  chr16:89139536-89139561
  hypo
cacttacctggagtgcggtggcccc

SEQ ID NO: 79844 - DNA, 104 bp, Homo sapiens
  chr16:89139951-89140055
  hypo
tgcggacccctccttcgtggcctccagcttctatttagagagggtgtgacacgctgagatctttcacacgggtggtgacgggactgaatcgagttgcaggacgc

SEQ ID NO: 79845 - DNA, 67 bp, Homo sapiens
  chr16:89140367-89140434
  hypo
gagccatgtcatgaacgactcatgcatgcaccagtcacgtgaggacctgtcacgtgtggacctgtca

SEQ ID NO: 79846 - DNA, 30 bp, Homo sapiens; identical to SEQ ID NO: 44903
  chr16:89141923-89141953
  hypo

SEQ ID NO: 79847 - DNA, 88 bp, Homo sapiens
  chr16:89146026-89146114
  hypo
gagatctgtgccagccgcaggacatctgggaggaggtgcataaacccaacagggccaagcacagaggggcgcacgtgtgacttccttg

SEQ ID NO: 79848 - DNA, 30 bp, Homo sapiens
  chr16:89146902-89146932
  hypo
tgggctcacccccatcgtgcccatgatctg

SEQ ID NO: 79849 - DNA, 30 bp, Homo sapiens
  chr16:89156566-89156596
  hypo
ctcagtttcctcattcgtaaaacggcacaa

SEQ ID NO: 79850 - DNA, 194 bp, Homo sapiens
  chr16:891650-891844
  hypo
ctacctaccagcccccgttatccctcgaactctcagactcacttggaccagggatggcaggatgggaccagagacctgtccactcagcacctcaggcaggtgaaggaaaaaagaaccactcctgctattgcatttcgggagactggtgccctcacgagcgtgggtggcctcgggtgccccgacctgctgccgca

SEQ ID NO: 79851 - DNA, 30 bp, Homo sapiens
  chr16:89165849-89165879
  hypo
gttcaacctaaaacacgttttctagctctg

SEQ ID NO: 79852 - DNA, 402 bp, Homo sapiens; identical to SEQ ID NO: 44904
  chr16:89172134-89172536
  hypo

SEQ ID NO: 79853 - DNA, 37 bp, Homo sapiens
  chr16:89184300-89184337
  hypo
gacggcaggttccctcgggtgccggggatgctccctc

SEQ ID NO: 79854 - DNA, 81 bp, Homo sapiens
  chr16:89188334-89188415
  hypo
gaaaggtgcagtggccgcaccttgtgtggagggccacacggcgtgtcccgcctggcctgggccccccgcagtgggctgtta

SEQ ID NO: 79855 - DNA, 224 bp, Homo sapiens
  chr16:89189759-89189983
  hypo
ggactccccaccccacgctcacactcgcagacgcacttggtactttcatctgagtctcacgcagtagcccttctctccacagcatcccagaacccgagggtgcccctcactaccacggtcccggatccacgtggctcaagtgaggctgtggccgacagctgggctgtccgatccactcttgtctgtgccgaggcgtgggtcccggccagcgtccctccccagaa

SEQ ID NO: 79856 - DNA, 19 bp, Homo sapiens
  chr16:89202477-89202496
  hypo
tggccggttcttgtatttt

SEQ ID NO: 79857 - DNA, 148 bp, Homo sapiens
  chr16:89203067-89203215
  hypo
tcctccgggtcaggatgagaggagaggttgccagctttgatgccagccgctcctgcctcccccacctgcctctgtgcctacagcccgcttctgcctcaagatcacacagcgggcttgtgaggccaggggtctccgctgctgctcaagg

SEQ ID NO: 79858 - DNA, 30 bp, Homo sapiens
  chr16:89216656-89216686
  hypo
cacagacagcagaaacgcttgcttgatcag

SEQ ID NO: 79859 - DNA, 54 bp, Homo sapiens; identical to SEQ ID NO: 44906
  chr16:89219318-89219372
  hypo

SEQ ID NO: 79860 - DNA, 94 bp, Homo sapiens
  chr16:89219597-89219691
  hypo
tcagtgcagcctggacgccctggaccagcccctcctgcgcctgggccacggccgctgccttcagggcatcactggtgggcggcacaaccatcct

SEQ ID NO: 79861 - DNA, 707 bp, Homo sapiens; identical to SEQ ID NO: 44907
  chr16:89220327-89221034
  hypo

SEQ ID NO: 79862 - DNA, 179 bp, Homo sapiens
  chr16:89225868-89226047
  hypo
ccgtctgagggtgggcggagggcgctgccgcaggtccccacatacccagcgcacgctcaccccacactggaggcacctgccgggttctgacacccctcgaggtgccttcccagggttctcacacccactgaaggcagcgcgctcagcctgctttgcacatgagccgctgaggcaggcga

SEQ ID NO: 79863 - DNA, 458 bp, Homo sapiens
  chr16:89226262-89226720
  hypo
aggtgggcaaggccacggtttggccaggtaaggctgggagggcccaggatgattgtgcgttgagccaggcagatctggagaggcggagggatggggacggagcgccatgcagaggccgctcggtcctcaggagctgagcatcaccctgggagtctcaaggagggtgtcccctggccttagcgggcagccagggccagcatgtggtctgtggcagccggtctcagaggtggcctggttcgcagtcttgctggatggagatccccagctcctagggcaagggcaggtggggtggggccgcctcggtcagctgataggaactgaactgagaaggctgtgagccgctgagtcgccctaactgcagggtggtcctgcgggcagtactgagcccgccctgctgggcaccccacagcccctgtggctctccagctgccactgaggccggacgcctcatgaggagg

SEQ ID NO: 79864 - DNA, 279 bp, Homo sapiens
  chr16:89242783-89243062
  hypo
ttgcagggggaggggcggcccagctggcccagctctgaccccccggttctcggtgctccatttcatggggccccaccctgcctggagcgggtgcccccttccagcggggagctgggtgaggcctcccacgcagggtcccgctcaccagggccgactcggtgctccctccgctcgcacaatgtggggagctgttctaggtgttggtgtggcgtggccggcacacctctgtagtaggcacaggacttggtgccggctggggagtcccgtgagcctccctag

SEQ ID NO: 79865 - DNA, 151 bp, Homo sapiens; identical to SEQ ID NO: 44911
  chr16:89245291-89245442
  hypo

SEQ ID NO: 79866 - DNA, 143 bp, Homo sapiens
  chr16:89245643-89245786
  hypo
tttgcccttgtgctacgcagccccgtgtgtggaagccgccttgcgccaatgggcaccgacccgtgggctgagggaaacactgcgccccgtggcctcctcaccacccacagctcccagctgcacgctgccgcccagggctccag

SEQ ID NO: 79867 - DNA, 156 bp, Homo sapiens
  chr16:89254608-89254764
  hypo
caccatcctggaaggcgaccccgatgggcagttcaccatccgcacggaccccaagaccaacgagggtgttctgtccattgtgaaggtgagcggcccccggctggcacacagatgccggcagacgcagatgccgacacacacagatgcccacacaca

SEQ ID NO: 79868 - DNA, 603 bp, Homo sapiens
  chr16:89267222-89267825
  hyper
ctagcccagcctctgcgcacctcactgatgggaagcccaccttccccagtctgtgctgaccacgtcagtccctccaagcagagactctgccttggaaagccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcg

SEQ ID NO: 79869 - DNA, 182 bp, Homo sapiens
  chr16:89268351-89268533
  hyper
tggcaggggcgtggccgggagcgctcaggtgccctcgcggcgcaggtgcactcaggttgcccgggggcgcgcgggctccggccggcgtcccggggtggtccccgcgtggggccgggggcgtccgcgcgggcggggcgaggtcggggagggcagccgcccgccctcctcggcgctgggagctt

SEQ ID NO: 79870 - DNA, 178 bp, Homo sapiens
  chr16:89268813-89268991
  hyper
ctcgcgttaacaattcgaatgggcacgtttctgcgtttcagaacgctgttcgcttcctcacacttagattgaggtggaactcacgtcacataaaccgggtcgcaaggctcagctcagcggggcccccccaacagtgttgcgggaccagcaccttctcgggctccggaacagcttctac

SEQ ID NO: 79871 - DNA, 30 bp, Homo sapiens; identical to SEQ ID NO: 44914
  chr16:89311109-89311139
  hypo

SEQ ID NO: 79872 - DNA, 90 bp, Homo sapiens
  chr16:89313564-89313654
  hyper
tgagagcagcctctccgcgggactggcctgtgcgcgcgcgtctgcggcaccgtcggaccaggggccgcccccgagcggggagcccaggag

SEQ ID NO: 79873 - DNA, 39 bp, Homo sapiens
  chr16:89321968-89322007
  hypo
gtagaagttcagcaacgcaggcatcgcaccaggtcacac

SEQ ID NO: 79874 - DNA, 274 bp, Homo sapiens
  chr16:89323313-89323587
  hyper
cgctctgtgcaaaaccgagtcgtgtgcgggcccagggtggcgctcggggcgcttccagcgcacgtcacctcatctgcgtcgtcaccactgtcgcctccgaaagcgcattccgtcgtcaaaatacaccacgaggtcccgggtgccctcaccgccctccccttcctcgccctctcgtcgttgctgttgggacgggctctcgtcgcccgcgctggggcgcagtgactcagtgtgactcaggcctcgcccgcgctcgggctcacggagcagctgggac

SEQ ID NO: 79875 - DNA, 35 bp, Homo sapiens
  chr16:89360320-89360355
  hypo
caggccaggagcccacgctgcgtccccgctctgag

SEQ ID NO: 79876 - DNA, 121 bp, Homo sapiens
  chr16:89410313-89410434
  hypo
ggaaactacggatcacgggctgttttgggtgtgggaaatccacccacccacactcacggccagctctgaccgactgaacccaggggcacatcacagacataaatatcggtgcaggcggcca

SEQ ID NO: 79877 - DNA, 37 bp, Homo sapiens
  chr16:894468-894505
  hypo
cccggaactggaggctctcacacgccacagttagaga

SEQ ID NO: 79878 - DNA, 334 bp, Homo sapiens
  chr16:894865-895199
  hypo
accccggagcctccacgtcctggtacagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactccccaaggtgaggtgggctcgtgccagcaggtgggagccggtcgtgcacgtctgcccagctccgtgctgagtgaggacgtgttgggggcttgaatcggagatgggggcgg

SEQ ID NO: 79879 - DNA, 64 bp, Homo sapiens
  chr16:89531790-89531854
  hypo
catgaattagactggcgttggacttctctcatctttacagcagaggccacgacagagaacaggg

SEQ ID NO: 79880 - DNA, 134 bp, Homo sapiens; identical to SEQ ID NO: 44916
  chr16:89558631-89558765
  hypo

SEQ ID NO: 79881 - DNA, 42 bp, Homo sapiens
  chr16:89575654-89575696
  hypo
aggttgttgttttttcggttatttttgagacagagatctcgc

SEQ ID NO: 79882 - DNA, 162 bp, Homo sapiens
  chr16:89575936-89576098
  hypo
cgtgagccaccgcgcccggccataaaacatatttaaatgggaaaatgtttatcttgaaaggagaactctgaaagtatatacttgttaactggtttggtacctggaaatgttctacaaggagccactctctggtgacagcaggagccccgtgtctgggcagcc

SEQ ID NO: 79883 - DNA, 30 bp, Homo sapiens
  chr16:89622358-89622388
  hypo
ctgggcaggtgtgggcggtgccgtccccgg

SEQ ID NO: 79884 - DNA, 27 bp, Homo sapiens
  chr16:89637111-89637138
  hypo
acaggaggaggtgagcggggattggag

SEQ ID NO: 79885 - DNA, 29 bp, Homo sapiens
  chr16:8963909-8963938
  hypo
gggtgcggtggctcacgcctgtaattcca

SEQ ID NO: 79886 - DNA, 287 bp, Homo sapiens
  chr16:89641417-89641704
  hyper
gcttttggcgaggtccgtgccctatttttaggcagaaatcggcaaaaagagtggactgcgaggtggtttctgtccccgccgacgcctcctcttccgctgctccctcccccgggaccggtgatggggaaggtgggggagtgagttcagggcggagcgggcccaccccccacggaacccaggcctgccccgccccgccccggcctcgggggactggtgtggaccgtgccccgcggacccctcggaatcagaccgcgattcagccctcggccccccgggacggtccttcc

SEQ ID NO: 79887 - DNA, 18 bp, Homo sapiens
  chr16:89642511-89642529
  hyper
ccgggccggggctggcgc

SEQ ID NO: 79888 - DNA, 39 bp, Homo sapiens
  chr16:89642560-89642599
  hyper
cgctgaggccagtggggcgcaaggcggggccccccggag

SEQ ID NO: 79889 - DNA, 45 bp, Homo sapiens
  chr16:89650665-89650710
  hypo
catcatcactgtcaccgccattagctctcccgcccctcctggcag

SEQ ID NO: 79890 - DNA, 51 bp, Homo sapiens
  chr16:89651630-89651681
  hypo
aggtggcagaagttacgaaggtggaggcacagggctcggaaatgtgtctcc

SEQ ID NO: 79891 - DNA, 119 bp, Homo sapiens
  chr16:89655014-89655133
  hypo
tctacctgtcaggagcgggttcggggagccccggcccagcacagctcctggctcccggcccactgcaggtggccattgacttcaccgcctccaatggagacccgcggaacagctgctcc

SEQ ID NO: 79892 - DNA, 30 bp, Homo sapiens
  chr16:89657693-89657723
  hypo
tgcttggtgtggggtcggctgtgtgtgcac

SEQ ID NO: 79893 - DNA, 71 bp, Homo sapiens
  chr16:89663895-89663966
  hypo
agtgaggactgtggacgtgatgcaggggtgccaggagcctcccacatggcctgcaccgcagggagctgggc

SEQ ID NO: 79894 - DNA, 30 bp, Homo sapiens; identical to SEQ ID NO: 44922
  chr16:89667452-89667482
  hypo

SEQ ID NO: 79895 - DNA, 96 bp, Homo sapiens
  chr16:89668332-89668428
  hypo
gattctgacaccccacggtaagaatgctgggcgctgctcccgtgctcaggagatgtggctcccgggaaactgacgatgctgcgaggaagctcaagc

SEQ ID NO: 79896 - DNA, 56 bp, Homo sapiens
  chr16:89674507-89674563
  hypo
ggtgtcatctttgcacgtaactgtctctgtgtgtgtcccgtcgtcttcagctcgga

SEQ ID NO: 79897 - DNA, 170 bp, Homo sapiens
  chr16:89688129-89688299
  hypo
gtgtgtctgtgtgcacgtggaggtatctgagtgtgcgtttactcatcccgtgggaaagtctgcacatgtctgttctaggtacgcggacgtatctgaccgtgtgggcttgcgatgcgcccaggtgttctcgtctgcgatgatctgtgtgtggggggcgtgggtaggtccgc

SEQ ID NO: 79898 - DNA, 402 bp, Homo sapiens
  chr16:89702599-89703001
  hypo
actcccacaggcatgcggggggtgggctgagacctggctgcatcagctcctggcaccccctgcggcccacagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggcca

SEQ ID NO: 79899 - DNA, 212 bp, Homo sapiens
  chr16:89704484-89704696
  hypo
aggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggac

SEQ ID NO: 79900 - DNA, 87 bp, Homo sapiens
  chr16:89713549-89713636
  hypo
tgagctgcccacacacgctccttgtccccaggccacagccccaagggtaggggccacataccgatgtatggacgtccaggttctgca

SEQ ID NO: 79901 - DNA, 30 bp, Homo sapiens
  chr16:8971974-8972004
  hypo
ggatagatggacagacggcagctgctgggg

SEQ ID NO: 79902 - DNA, 17 bp, Homo sapiens
  chr16:89725803-89725820
  hypo
gggcgcagtggctcacg

SEQ ID NO: 79903 - DNA, 37 bp, Homo sapiens; identical to SEQ ID NO: 44928
  chr16:89763835-89763872
  hypo

SEQ ID NO: 79904 - DNA, 79 bp, Homo sapiens
  chr16:89778723-89778802
  hyper
cctgcctctgcaaagcggggagcccctcggccctgtaccccgaccccggaacctccgctcccctcgctgcccccttctc

SEQ ID NO: 79905 - DNA, 334 bp, Homo sapiens
  chr16:8978000-8978334
  hypo
tagtttcctccaaaccggggtgggggagccacaccacacccccacatatcaggtccccagtctccagatcccagcatctccccatctcaggtgagcaccgacagcccatgggaattgagaagccacaggggtcctggccccggggggtcccacctgcttcccgcttcccactcccacagctgtatgccggcatgtccgtggtggggacgtccatgccggtgcaggccgtgtgtccctactgtggaaaccgcatcatcacggtgacgacctttgtcccgggtgccctcacctggctgctgtgtaccaccctcttcctgttcgggtgagtggccgc

SEQ ID NO: 79906 - DNA, 92 bp, Homo sapiens
  chr16:89846148-89846240
  hypo
tggcaggcatcagagcggagtctgcacaccctgcaggcatcagagcagagtctgcacatactgcaggcatcagagcgcggtctgcacacact

SEQ ID NO: 79907 - DNA, 42 bp, Homo sapiens
  chr16:89855370-89855412
  hypo
tcctctcccaactgtcgcctctggaaccgaagaaaaagcagc

SEQ ID NO: 79908 - DNA, 30 bp, Homo sapiens
  chr16:8987879-8987909
  hypo
tcaaggtaagtgtagcgactcctctttggg

SEQ ID NO: 79909 - DNA, 420 bp, Homo sapiens
  chr16:89883924-89884344
  hypo
cagagcgagactctgtctcaaaacaaaaccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatcgc

SEQ ID NO: 79910 - DNA, 93 bp, Homo sapiens; identical to SEQ ID NO: 44930
  chr16:89884896-89884989
  hypo

SEQ ID NO: 79911 - DNA, 33 bp, Homo sapiens; identical to SEQ ID NO: 44931
  chr16:89885109-89885142
  hypo

SEQ ID NO: 79912 - DNA, 30 bp, Homo sapiens; identical to SEQ ID NO: 44932
  chr16:89896219-89896249
  hypo

SEQ ID NO: 79913 - DNA, 852 bp, Homo sapiens
  chr16:89899963-89900815
  hypo
ttcagctcaggcctacggcctgctgggcttgagaagcttcgcctttgtgcctcggtttccttctccgtgaaatgggaggtgcagcgtggtgctaacgtctgtgcagccctgggcacgcctggctccggaagcactggccagtggaggtggcagcaagggatctgcacctgtgcactcgctggacctgccttggggagcagcacgtgtgggtccaggctgcgaatcccgaccggattctcagggaggggttctgcaaggtgcacccggtgggggctgggagctcctccggggcgtgtttccctgtgacgtaaaatgacctctatccctgagccctcccatgtagaaagcgggaaggaggctggccgctgtgtgtgggtgtgggtgtgagctgggtgtgtctctgtgtgagctggggtttgtttgtagatggcattcccgatatagtctcacctctgagcaagggttacctcacaggaaggcagtcctgcagcaagactcttctctttacggagacatctgtgaacctgcctgcgctcgcggttggccgtcgtagaagcatggataagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 79914 - DNA, 38 bp, Homo sapiens
  chr16:89901552-89901590
  hypo
ctcacggttggccgtcgtagaagcgtggataagcatag

SEQ ID NO: 79915 - DNA, 30 bp, Homo sapiens
  chr16:899159-899189
  hypo
gggtcacgtggtcgccgtttctagctctcc

SEQ ID NO: 79916 - DNA, 111 bp, Homo sapiens
  chr16:89972124-89972235
  hypo
tggcagtcatgggcccgtccgcgtgtctgctgtccccactggactggacattctcatggacaggagcattttgttccctgtactgctctccaagagcgatttccagcaggg

SEQ ID NO: 79917 - DNA, 97 bp, Homo sapiens
  chr16:89972675-89972772
  hypo
tcgctgccctgcccccggtaagggagaaaggctgaaatgggagctctgtgtaagccggtcacatgcacgtcccttctgctccgggcggtccacatgc

SEQ ID NO: 79918 - DNA, 32 bp, Homo sapiens
  chr16:89985113-89985145
  hyper
aacgtaaaggagatccgcggtgtgagggaccc

SEQ ID NO: 79919 - DNA, 161 bp, Homo sapiens
  chr16:89992858-89993019
  hyper
actgccctcaaagcccggccccgctttccccaggaccccaagcgctgcgcgaggtcagcaccaaggacagcgcccgggccgagcgcctggcctcgaacgccgggttctgctttgtgtttccaggtttttgtttttggttatgagaggaggcctggctctgt

SEQ ID NO: 79920 - DNA, 49 bp, Homo sapiens
  chr16:90002280-90002329
  hypo
gagccatcttgctgccgacaccctgctttcccctcgccctagggctccc

SEQ ID NO: 79921 - DNA, 40 bp, Homo sapiens; identical to SEQ ID NO: 44936
  chr16:90037700-90037740
  hypo

SEQ ID NO: 79922 - DNA, 30 bp, Homo sapiens
  chr16:90048779-90048809
  hypo
gctgaccctggacagcggctggggctttgt

SEQ ID NO: 79923 - DNA, 463 bp, Homo sapiens
  chr16:9005341-9005804
  hypo
gagctcgtcctgctccggtcatgaaggaaaaacgcaactgcacaacactgaaaacagcgctgtcacgctccggacacatgcggtacaggacagggatccctgaagggacaaatgagagccccgtgatgggcccagctctgctgaaagtttacaggctgcagcccggagaaggcaaacccagacagagccaagaagtgagaatgagaggagctcaagggagcgggaacctgctgggcagagtagcctaaagcagaatgctgcccagaaagcgagatctggggatgtgcagtttcttccgaagctgtcagtgagaactgatcagtgaactcgaggaaattacctggggcaaggaaaagaaccagcaagaggatgaggattggggggaacaaccttcagagctcacgacaggctgggaagtctgtgttcccaccagccaccgtggaaaaaccgctgaacacctggg

SEQ ID NO: 79924 - DNA, 363 bp, Homo sapiens
  chr16:90066618-90066981
  hypo
cttgatgacgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacctatgaggagtttgtagagggcgtgggcagcctgga

SEQ ID NO: 79925 - DNA, 157 bp, Homo sapiens
  chr16:90069167-90069324
  hypo
gcagagtgacacctgcgggcactgctgtctgtgctgtagcggtctgtgcaccctgcagggacacgagccttcagcccctgtatttctcagcctgcctgcctccctccctctgccagaagggaaggtggaatggggtggaatgcgtgtacctgccagt

SEQ ID NO: 79926 - DNA, 199 bp, Homo sapiens
  chr16:9009860-9010059
  hypo
gtgtgtgtgcttctgcgtcttttatcacaactggaagaatgaggatttgctagtgattagtgatggcgcggggagagtaatcaccgcatgctgaggtctgctcaatgagaacctcgctgcacaggaggggtctggacactggagtaacaacagaagtcaccactgtacagtgactcaggaccaacgggacagccaacaa

SEQ ID NO: 79927 - DNA, 65 bp, Homo sapiens
  chr16:901765-901830
  hypo
agggctggacactcacgggtcagagccaagggctccatggagtgggccctcgaggcccccagctg

SEQ ID NO: 79928 - DNA, 42 bp, Homo sapiens
  chr16:904733-904775
  hypo
gcctgctgggactcccggcccccgacccggctcctcagcctg

SEQ ID NO: 79929 - DNA, 41 bp, Homo sapiens
  chr16:9053767-9053808
  hyper
aacatctatcccattcgtctcagagccgacactgaaacaga

SEQ ID NO: 79930 - DNA, 120 bp, Homo sapiens
  chr16:9062079-9062199
  hypo
ggattacaggcgtgagccaccacgcccagcccaaccttttctaattctggattcttatcagggaaatgggaaaacagtctacctgaaaccataaaatatcaaacgcttcaaaatccacag

SEQ ID NO: 79931 - DNA, 30 bp, Homo sapiens
  chr16:9063642-9063672
  hypo
tatagtggttggagtcgtgttcattttttt

SEQ ID NO: 79932 - DNA, 30 bp, Homo sapiens
  chr16:9106938-9106968
  hyper
aggcatgagccacaccgccccctaggcctt

SEQ ID NO: 79933 - DNA, 51 bp, Homo sapiens
  chr16:9229760-9229811
  hyper
ttgacctcttatcaccggccaggctctgtgccctgccgcaacagacaggat

SEQ ID NO: 79934 - DNA, 300 bp, Homo sapiens
  chr16:924548-924848
  hypo
tctccaggcaggcagcggccccagggccccgcggaaccctccggaacagctgtgtaaactgcgtgggaggagggaggctgctcatgccgcaactccccaacggaaggatcacgggaaccaggacaggctccgggggacggtgctcagatgggaacacacggaaccaggacgggatccggggaggcggcgctcagatgggaacacacggaaccaggacaggctccaggcaggcggcgctcagaagtctcagggcactcggctgtcacagcgcggcacaggggagtacgcagccccagccag

SEQ ID NO: 79935 - DNA, 30 bp, Homo sapiens
  chr16:925813-925843
  hypo
gggcagcacagcccacgcaggaggtgtgtg

SEQ ID NO: 79936 - DNA, 66 bp, Homo sapiens
  chr16:928296-928362
  hypo
tcacctgatgggcaccggtgccagcctccaagcagctaacgcggaaaagcccgagggagtcaggag

SEQ ID NO: 79937 - DNA, 30 bp, Homo sapiens
  chr16:929536-929566
  hypo
ggacacggggcagggcgggcggcgcgggct

SEQ ID NO: 79938 - DNA, 30 bp, Homo sapiens
  chr16:9381764-9381794
  hypo
gtgtgaccgcatgcacgtgcttcctatgaa

SEQ ID NO: 79939 - DNA, 30 bp, Homo sapiens
  chr16:939019-939049
  hypo
ccgtccatgcatccccggtgtctcatggga

SEQ ID NO: 79940 - DNA, 30 bp, Homo sapiens
  chr16:942296-942326
  hypo
atgctctaggtgcaccgtggccatgaccac

SEQ ID NO: 79941 - DNA, 39 bp, Homo sapiens
  chr16:943022-943061
  hypo
atgcaggtgaggtctcgccagcaccggtccccccggatc

SEQ ID NO: 79942 - DNA, 187 bp, Homo sapiens
  chr16:943459-943646
  hypo
ggatgagcccaaagtcggagggagcacccagtgcacacgcgtctcagccccgccccctgcggcacaaagggagccgaggcgcaggccccgtgtgtctcccacacactgcagctcgcctgctgtgaggactcctggggcacgggacaggcttccaggggcctgcagagggagccgccagcactgggga

SEQ ID NO: 79943 - DNA, 58 bp, Homo sapiens
  chr16:945674-945732
  hypo
cgtggctcaagtgaccgatgccgagagggacacgaatgagaaacggcaggggagtggg

SEQ ID NO: 79944 - DNA, 82 bp, Homo sapiens
  chr16:946275-946357
  hypo
gaggctcagccaccccgcgcactgtgaaggctgcctctggcggggccatgtctgggtccggcatcgccgtctctagggtctt

SEQ ID NO: 79945 - DNA, 30 bp, Homo sapiens
  chr16:949510-949540
  hypo
ggcctgtcagggaaacggcagcacatctgc

SEQ ID NO: 79946 - DNA, 565 bp, Homo sapiens
  chr16:962833-963398
  hypo
gctgccattgttctccgcctcagcgtggcggacaacgcgtccccaggaaagtcaataagcagcacgctgccagggcggcctcagcgccaaggtcagggccagggctctccagacagctctcacccagcaaacaccagcgctgcctgaagcgagccccaggcacccgaacgaggcggcaacacgcagggccacagcacacgctgccactgccggggagaggagccgtcctcgcccccgcctcagtgcctttcccgttgcgcagctgcacgcgctgcctgctgggcgccagcatctgcacgccctgctcttccccagggacctcccttccctttagccagggggacggctccgggagggcccctgctccactccacggctccggcgtcgtttccacctcgtgctgtgctgggccttccgggagactgagcacaccctgtgaggagcctgacgcgttctgcctgggtaacggggcagtagctcttgtggggaacattcacttccacggccgctgctctccttcctgcgacacagacagcgttggcccaatcagcggagaagctgcatg

SEQ ID NO: 79947 - DNA, 83 bp, Homo sapiens
  chr16:965804-965887
  hypo
gatgagcaccatcaccgggggccggagcaggtgagatgcaggggccggagcacgtgggacgcgggggccggagcaggtgagac

SEQ ID NO: 79948 - DNA, 30 bp, Homo sapiens; identical to SEQ ID NO: 44442
  chr16:968262-968292
  hypo

SEQ ID NO: 79949 - DNA, 90 bp, Homo sapiens
  chr16:968556-968646
  hypo
atggctgaagtgtgccgagcctccaagggactcatgagaccccagaaaagtgctggccatcgtgggctgcggggacgttgtgcccacgga

SEQ ID NO: 79950 - DNA, 30 bp, Homo sapiens
  chr16:969209-969239
  hypo
tgtggccaacaggcacgatccaccccacgt

SEQ ID NO: 79951 - DNA, 30 bp, Homo sapiens
  chr16:977343-977373
  hypo
aagggctctgcctcccggtttgagggaacc

SEQ ID NO: 79952 - DNA, 114 bp, Homo sapiens
  chr16:981729-981843
  hypo
ctgccgaagctactacgagtcttctgaatttctgcgcgacagtccaaagtgacgtgctgagccgctgcagggtcagacacaacatgaaactcaggctcacgagggctctcaggc

SEQ ID NO: 79953 - DNA, 30 bp, Homo sapiens
  chr16:982069-982099
  hypo
gcaagtggttggggacgcgggaggctggct

SEQ ID NO: 79954 - DNA, 30 bp, Homo sapiens
  chr16:983721-983751
  hypo
ggaggtcacatccaccgtcctcccggccct

SEQ ID NO: 79955 - DNA, 184 bp, Homo sapiens
  chr16:9842646-9842830
  hypo
gcagaaggaaggcagcgacttcttcaaactagagcagccgccatttcttcccagaaggctgtgggacttggcggccactggggggctcctgaagaggagcatccctagccttacctaactgcaaggaggctgcgatccagcccaggccccaagaagaagagtctctatgcgaagccaccatcgt

SEQ ID NO: 79956 - DNA, 30 bp, Homo sapiens
  chr16:9862871-9862901
  hypo
ggctgctcatcacctcgttcttctcgttgt

SEQ ID NO: 79957 - DNA, 208 bp, Homo sapiens; identical to SEQ ID NO: 44598
  chr16:9888740-9888948
  hypo

SEQ ID NO: 79958 - DNA, 30 bp, Homo sapiens
  chr16:9943625-9943655
  hypo
acttccgacatggcacggtgttcctcacac

SEQ ID NO: 79959 - DNA, 54 bp, Homo sapiens
  chr17:10101056-10101110
  hyper
ccaaggcagcacgaccgtccacgggtcatcaggctctagactccggggtggaga

SEQ ID NO: 79960 - DNA, 317 bp, Homo sapiens; identical to SEQ ID NO: 1280
  chr17:10101131-10101448
  hyper

SEQ ID NO: 79961 - DNA, 401 bp, Homo sapiens; identical to SEQ ID NO: 36377
  chr17:10102264-10102665
  hyper

SEQ ID NO: 79962 - DNA, 43 bp, Homo sapiens
  chr17:10146608-10146651
  hypo
ccgggggttggggagcggtgagaaggagagtcatccctttgaa

SEQ ID NO: 79963 - DNA, 42 bp, Homo sapiens
  chr17:10212555-10212597
  hypo
agtgcaggagctgcacgcggtcgctggcgtccagcagctcct

SEQ ID NO: 79964 - DNA, 201 bp, Homo sapiens
  chr17:10212807-10213008
  hypo
ccaggtacgcagaggcggccaccgtgctcaccttgagctggccctggaccgtgcgcagatgcttctgggtctctgccatctggcggttggagtggcccagctgaatctccatctcattaaggtctccctccatcttcttctttagcctcagggcgtcgttccggctgcggatttcagcatccagcacgctctgcagggcct

SEQ ID NO: 79965 - DNA, 30 bp, Homo sapiens
  chr17:10303782-10303812
  hypo
agcttctgtttgacccgctgcaagttgtca

SEQ ID NO: 79966 - DNA, 161 bp, Homo sapiens
  chr17:10404695-10404856
  hypo
cttcttccagcctctcgctgatctcctccagctcccgggagagatcagagcgctgcttctctgctttggcccgggaggcccgctctgcctcgatttcctcctccagctcctcaatgcgggcctgggaatggtgaaaaatattaatacgaactcaacttctt

SEQ ID NO: 79967 - DNA, 30 bp, Homo sapiens
  chr17:10558730-10558760
  hypo
gtgttgctgagggaacgtttaaaaataaac

SEQ ID NO: 79968 - DNA, 463 bp, Homo sapiens
  chr17:10632887-10633350
  hyper
ccctggtatgggactcgcttccatgaacacatccgcgtctcttagacgggggagaaagtgggggctccccaagcagaaagcccaagtcccgtcctccccactaactgtgcgcccctgcgactctgcccgctagtcagttacacggcccgctaggccagggggcggagctgggagccgggcgggtccccctcccaccgcggccgcctgacctgcaccaaggccgccagcgcgaagaaggcggccatgagtccgttgcaggcccgccacagcgctggcgccatggctcggagaacacggcgcggggcggtgagtcctgccacgtgcggggcggtgagtcctgccacgtacggtccgccttcctccttgcgcggagggaccgagacccccgcctcggtttcggtgccttggggacactgccgtggccgtcgctccgcccgggggcggggagcgaagggcgtgggtg

SEQ ID NO: 79969 - DNA, 47 bp, Homo sapiens
  chr17:1082429-1082476
  hyper
gtctcccctcccacccgatcccaccccagcaccgaacccctgggccc

SEQ ID NO: 79970 - DNA, 30 bp, Homo sapiens
  chr17:1082997-1083027
  hyper
gccccggtggctgagcggctccatcccgcg

SEQ ID NO: 79971 - DNA, 224 bp, Homo sapiens
  chr17:1083533-1083757
  hyper
aggatcctggcgatccgcaaaccaggtgccgtggggggcccgggagcccacaggggtgacatcacctcccgcccgggatctccaagcgcggcttcgcgggcgggagcggcggccgggcccctccccagccagacccgctgcgggacccacggggtgaacgtcctgcgcgccgcgggacgcgcctctctcctcccgaaccttcccccgctcgtccctttccacac

SEQ ID NO: 79972 - DNA, 131 bp, Homo sapiens
  chr17:11143519-11143650
  hyper
agggtggggactggtcgcgaaggctagagaaggcaatggcaggggaggtcagtccctgccgcgggccggctgcagagcggacgttccgccctgctcccggccccctcttcgcccgccgggttcgccgtgtc

SEQ ID NO: 79973 - DNA, 362 bp, Homo sapiens
  chr17:11144922-11145284
  hyper
gcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctg

SEQ ID NO: 79974 - DNA, 30 bp, Homo sapiens
  chr17:1129316-1129346
  hypo
cagaataatactcgccgtgtccaatgcact

SEQ ID NO: 79975 - DNA, 18 bp, Homo sapiens
  chr17:1134324-1134342
  hypo
attgatctaagaggccgg

SEQ ID NO: 79976 - DNA, 87 bp, Homo sapiens
  chr17:1136675-1136762
  hypo
ccgcgcccggcctctttctttctttctaactcggtgtgccactggcatgaatcatcccagtgtttgtcttcacgccagactgctatg

SEQ ID NO: 79977 - DNA, 45 bp, Homo sapiens
  chr17:11461634-11461679
  hypo
gccggggctgctgggcgtggcagagcagagcgggggccgggaggg

SEQ ID NO: 79978 - DNA, 97 bp, Homo sapiens
  chr17:11501937-11502034
  hyper
cgcctgggagcgttgcgcggggagtgctgaggcggagcagctgctccaggccttcctgggccgcgatgctgccgaggggccgcggccgctgctggtg

SEQ ID NO: 79979 - DNA, 30 bp, Homo sapiens
  chr17:11507618-11507648
  hypo
gtgagccgccgcgcccgtcctcttcccaac

SEQ ID NO: 79980 - DNA, 158 bp, Homo sapiens
  chr17:11572707-11572865
  hypo
gatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcac

SEQ ID NO: 79981 - DNA, 30 bp, Homo sapiens
  chr17:1163513-1163543
  hyper
ccctggggcgcctcccgacgcgtcccggcc

SEQ ID NO: 79982 - DNA, 165 bp, Homo sapiens; identical to SEQ ID NO: 44999
  chr17:11637555-11637720
  hypo

SEQ ID NO: 79983 - DNA, 192 bp, Homo sapiens
  chr17:11672352-11672544
  hypo
tgttctgaaatgcttcggaacgccgctggtgcatctgtttctccctagagcccacccttggcaggcttattgtgctcccattccaggcgtgtttggtgcacacgagtgagaccatccgtgtgtgctacttcatggagcggttgatggcgcggcagcggcctgtcatgctggtgggcacggctggcactggca

SEQ ID NO: 79984 - DNA, 89 bp, Homo sapiens; identical to SEQ ID NO: 36326
  chr17:1174273-1174362
  hyper

SEQ ID NO: 79985 - DNA, 171 bp, Homo sapiens
  chr17:1174384-1174555
  hyper
cgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatgggccatcc

SEQ ID NO: 79986 - DNA, 30 bp, Homo sapiens
  chr17:1180688-1180718
  hypo
gtggctaggggctaccgaattgggctgggt

SEQ ID NO: 79987 - DNA, 16 bp, Homo sapiens
  chr17:11808260-11808276
  hypo
agagaataggctgggc

SEQ ID NO: 79988 - DNA, 32 bp, Homo sapiens
  chr17:11820735-11820767
  hypo
agtgctgggattacagacgtgagccaccacat

SEQ ID NO: 79989 - DNA, 40 bp, Homo sapiens
  chr17:11836966-11837006
  hypo
aattacaggcgtgagccaccgcgcccggccttcttcaggc

SEQ ID NO: 79990 - DNA, 40 bp, Homo sapiens
  chr17:11838965-11839005
  hypo
caggcgtgagccaccgcgcccggcccgaaagatatttttt

SEQ ID NO: 79991 - DNA, 30 bp, Homo sapiens
  chr17:11866757-11866787
  hypo
aaaaaaagaagacaacgaccacatagatgg

SEQ ID NO: 79992 - DNA, 30 bp, Homo sapiens; identical to SEQ ID NO: 44946
  chr17:1193094-1193124
  hypo

SEQ ID NO: 79993 - DNA, 97 bp, Homo sapiens
  chr17:12150178-12150275
  hypo
ggttaactttaagagcgaaggattaaaacaaagaaacaaacaaacaacaaacctctgttaaaaaaccctgagaactttttttttttttttttttttt

SEQ ID NO: 79994 - DNA, 66 bp, Homo sapiens
  chr17:12568725-12568791
  hyper
atttccaaattgccccgcgtgaactgtcccgcgggcgcgcacgccctttcgcgcagcctttgcagc

SEQ ID NO: 79995 - DNA, 230 bp, Homo sapiens
  chr17:12569172-12569402
  hyper
ggaccttcataaaggcgtggtggcgattctccgcaatcgccggcagcctatgacatcagacaggaacgcctgggatgccgcgctgctcctggccaacctccgaggaggaggagggtcccgccggctaagagttaattagccccgcacggcgaggggggaggcgccagttttctggggacactggctgccactgtactcctacccaggggagctcacggagagttggatga

SEQ ID NO: 79996 - DNA, 297 bp, Homo sapiens
  chr17:12693203-12693500
  hyper
ggcaggtaggtcacccgcgggcaccgctgtcggtgcgcgcccgcgaggctgcatccgcaggggcgcgcaggtgatggagcccgcccagcctccagtcctccttgcctcagtcctttcccctgcaccagctccctccaggcgccgctcgcaggcgcgacccctcctccctaacttcccagaccccggagctcttctcactcgccgccttctgctccgggctccggttgccaagcgcaaagtgtgacgcatcctttacctgcgtccccggctgccccttcgcttcgtcctccctgcctt

SEQ ID NO: 79997 - DNA, 48 bp, Homo sapiens
  chr17:12877698-12877746
  hyper
aggcctcttggatttcgtcgtttcccatgcccccgcccccatttctaa

SEQ ID NO: 79998 - DNA, 30 bp, Homo sapiens
  chr17:13400298-13400328
  hypo
tcctcgtgtattaaacggagaataataata

SEQ ID NO: 79999 - DNA, 103 bp, Homo sapiens; identical to SEQ ID NO: 36383
  chr17:13503842-13503945
  hyper

SEQ ID NO: 80000 - DNA, 576 bp, Homo sapiens
  chr17:13504194-13504770
  hyper
cgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgc

SEQ ID NO: 80001 - DNA, 655 bp, Homo sapiens
  chr17:13505001-13505656
  hyper
cgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggcctgacttccacccaagacgccactagcttggtgaggggccccagagctctccaccgcagctcagccctccgcagccctgaccct

SEQ ID NO: 80002 - DNA, 30 bp, Homo sapiens
  chr17:13791939-13791969
  hypo
ttttctttttaagttcgttcaaatgattct

SEQ ID NO: 80003 - DNA, 196 bp, Homo sapiens
  chr17:1387714-1387910
  hypo
gggacatgagcatgacgggtgcggggggcctgggtgctgagggcctgggtgtggtgggccgggtgcggaaagccgggtgtggagggcccgggtcccagtgtggcagcagagggatcaccgaggctgcgggcacagaacagagacaacatgaaccacttgggactcggacacagggcatggacgcaggcaggaccag

SEQ ID NO: 80004 - DNA, 73 bp, Homo sapiens
  chr17:1412390-1412463
  hypo
agacccaggctcactcgtgggggttagtgggggttagcgtggggcagagggcggggaacggtctgccagaccc

SEQ ID NO: 80005 - DNA, 362 bp, Homo sapiens
  chr17:14200545-14200907
  hyper
tctcatccctgcagtcggcttggccagcagcagccgcggggctgcgccagtgcccgcctctggccaggggttcccgcgcctcgagcagcgccctgggcccttctacgggaagaggggatcgcggcgcccgcgacacccaggagctcggacgaccgcagcctcaccactaacccccaacaaaggtacagcgggagtccaggccgagataaagttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggc

SEQ ID NO: 80006 - DNA, 278 bp, Homo sapiens; identical to SEQ ID NO: 36388
  chr17:14200930-14201208
  hyper

SEQ ID NO: 80007 - DNA, 326 bp, Homo sapiens
  chr17:14202945-14203271
  hyper
gcgggcggcggctcccggtgagtcacttcgtgagtgacactcagccccgggggtcgcgctggggtcggagccggaaggaatgttctgtccccggaaccgcttgcagccaggagttggaggccctctggccccgcagaggctgggttgcaggcatcgaaaacttcctgaacacgaccagtaagaatttgatctcgagcttccgaactccaaacgcctgggcaagaattcagcaaagcgcagcaccgctcacccgcacttcccccagctagcggttgctgtttcttggaagacgcgtttatccgccccagtcccgggtgggtgggtca

SEQ ID NO: 80008 - DNA, 30 bp, Homo sapiens
  chr17:14203695-14203725
  hyper
ctaatctcagttaaccggcaggccaagcta

SEQ ID NO: 80009 - DNA, 231 bp, Homo sapiens; identical to SEQ ID NO: 36390
  chr17:14204011-14204242
  hyper

SEQ ID NO: 80010 - DNA, 332 bp, Homo sapiens
  chr17:14204502-14204834
  hyper
agagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcg

SEQ ID NO: 80011 - DNA, 1203 bp, Homo sapiens
  chr17:14205175-14206378
  hyper
agagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccggtgagtttccctgccaggggcagggtctccatcgtcgattcagaccctgagctaagggagacatggcgtatgatagggaattggcagggttacagcttcggaccacccggggtagggcagggaaactacggcagattgcgcagcgcatcctgtccgggtgcggtgagggttgcgctccgcttggttctcgtcacaacccacagaaagttctcgcggagcactggtgcccttgaattcatcaggcgacctcgccgcaaagaagaagggcagcgactgagaccgccctcagcaaagcgagccaccctctaaccatgggggtatccgactcgaatcgtattttatgactcgttttaaattttttcctcccggagcccgagacgctgggaatgttctgagcccctttggtcggtctccgccctcaaggaacttctagagcagcttctgcttcccagatggggagagggggtgggggccgcggcgtcccggcgaggccgcagagtctgttaactttttgttacagtccgcctggttaccggaaccccaagggtgtcagacccgcctcgctcgcgagccgcctgggctcgggagggtgagccgggcgggtggcccggcgcctccgcctggcgggcgggcggcgcgcggagcgtggagctgtgctggtccctgtcgggcaaaggcgcgcactgcaaccggctggagcggcgcgaggctttgaaggcgtccgggcctccgggcaccgccgcccgtttccgcctccctgccctcggtgctgggatagggaaagcaaggacgcgtgtctccgcggggcttttacacgtccggagcaaagaatattcggggcccattgattgagaaatgagggttgcttcgaggtcgcggcttccggaaattctgttctcgagtcgggttgcgggtcaggttccaaagggacagtggccccggggtcacaatcactacctctgcccactgctttccgcagctgctggtct

SEQ ID NO: 80012 - DNA, 98 bp, Homo sapiens
  chr17:14212588-14212686
  hyper
cggagacagatggcggagcttcccagtgcgggggcagggctggcagccgagactggggccgcctcccccgcccctaggctggccgggtagtcctccgt

SEQ ID NO: 80013 - DNA, 18 bp, Homo sapiens
  chr17:1471448-1471466
  hypo
acccggccactctttcat

SEQ ID NO: 80014 - DNA, 30 bp, Homo sapiens
  chr17:1472708-1472738
  hypo
ttccgagggcctgggcggggtcttggggcc

SEQ ID NO: 80015 - DNA, 18 bp, Homo sapiens
  chr17:1479669-1479687
  hypo
gcccggcccaggaactct

SEQ ID NO: 80016 - DNA, 186 bp, Homo sapiens
  chr17:14861051-14861237
  hypo
tctaggcatggggcacggtgccctgatgctggggtgagtgaagtaaaccaagacatggacagaggatggcagggggctaccaggacctctggcctcaggagaaccaaggtgggactaagtcacccagaaaggacatggggcctgcagatagactaggtgtgtaccggctgccgcagacacagagga

SEQ ID NO: 80017 - DNA, 17 bp, Homo sapiens
  chr17:14914268-14914285
  hypo
tataaaacccgatgtcg

SEQ ID NO: 80018 - DNA, 38 bp, Homo sapiens
  chr17:1501153-1501191
  hypo
aaaagaaatgtgatgtgctcacacgtgcccaggcacgc

SEQ ID NO: 80019 - DNA, 20 bp, Homo sapiens
  chr17:15149034-15149054
  hypo
gagccacaggccgggcgcag

SEQ ID NO: 80020 - DNA, 63 bp, Homo sapiens
  chr17:15164652-15164715
  hyper
acccaactctgccagcgtagaggaacggtcctggccccagctcagcctcgcgcagactctggc

SEQ ID NO: 80021 - DNA, 41 bp, Homo sapiens
  chr17:15164923-15164964
  hyper
aacaagcctgagctccggtctgggtgcggtgggacaggagc

SEQ ID NO: 80022 - DNA, 895 bp, Homo sapiens
  chr17:15165949-15166844
  hyper
gcgtgtgcgggagggcgggactcagggaggagagggggcaggagagagggagggcaggagacagtcacttggccttaaatgcgcctcaagaaaaagtcggtccctgcaaaaccgcggcgacttttactcgaaaccagaggcggctgagctttctcacctcccacctcccttctcccctggccccgtggagacctagtgttgaccgagaaactggctcctcagcccactctgggaagacccagccaaatgtagctcagcggatgcccagggctgggcttctgggcccgccgacgccgaccgcgcccgcgcggggctgaggctggattcctttcccactaatagagggcagcgggcgcttgagcgctggaagaagtccctctcctctcgggtcctggagcccctgccctgtcctggcgtcttagccggacacacctgccccgcgccggtccccgctattactgtctgcacctacgaagcatgccagcttcctaggattggcggggattgatctagcgggctcctcttgggtgcgaattaggggaagaaaagtccggccgactactggatagcatggtctgggattgggctcctcctagcctaggcaaaaccagactaccaccgaataagctctaggcaaagtgttcctgcagcagtcgggcttggctgtcagccttggctggagtcctggccatggggtttggcgggcgggtgcgaggtggccatttgaggtggggttggagcagccaaggaaatcagctgattcatagcctcctaacgtggcccgcccagcgttacagggagagaggctagcccccttcagtctcggcttggcagaggcgcgcccaactgagactcccgtgcgcaggccagccttgaggcacgggacagggagcag

SEQ ID NO: 80023 - DNA, 25 bp, Homo sapiens
  chr17:1520973-1520998
  hypo
cacacccagccgatatgcacctttc

SEQ ID NO: 80024 - DNA, 295 bp, Homo sapiens
  chr17:15244291-15244586
  hyper
ctgcccaaacacaagcgaaagctttgcagccaagctaaacagaaacgactttgggcggtgagagaacagctttgatctgaatttaaggagctcggtctacaagaccaggtgattgaactctcctccccgtggctgcagatctgaaggctcggctattgaagcagagggggacgaggaacagcgtgcggggcggccagcaccgcagtggaaaggcacagcgctgctaacgggtaattattagaattaagaaattaaacgaattagcacagtgtcgggggttcggatgccccttccc

SEQ ID NO: 80025 - DNA, 277 bp, Homo sapiens
  chr17:15244987-15245264
  hyper
cggccgccccggccggctcgccggagctgactggccagttataggagaggcgggagctgtcaggccaggagggaaacccgtcgggcggcggttactatggacgcgctcacgcttagtaaccgaggctccccgccctccgggagacctccttggtttgggaggtgaaaggggtgaagagtagcccaagggagaggcctcggtgatttcccgacctctcctgtgaagcctgattcggaactcttccagctgcgaagaacttggccgattctaaggcaca

SEQ ID NO: 80026 - DNA, 23 bp, Homo sapiens
  chr17:1536225-1536248
  hypo
atatccaggatatgtcgttaagt

SEQ ID NO: 80027 - DNA, 40 bp, Homo sapiens
  chr17:1543656-1543696
  hypo
ggagggtggtgctctcggagagagccgctgagctgagggt

SEQ ID NO: 80028 - DNA, 49 bp, Homo sapiens; identical to SEQ ID NO: 44952
  chr17:1543917-1543966
  hypo

SEQ ID NO: 80029 - DNA, 386 bp, Homo sapiens
  chr17:1544223-1544609
  hypo
cccagccagggcaggcgagtcaccaccaagctctgagtcccatttgcgaggtctgccaggccttccctcctgctcttttcacttttcctttttccacactgagccgtccccaggtctggcatgaatgggactcagtagtgtcttctaccccatcacacgaaatgcaaaaaatgtaaagtgttttcacccaggggtcctcaaaccctgggccatggactggtactagtccgtggcatgttaggaactgggcgacagcgtagagatgaccagcaggggagcctgaccgcctgagctccgctgccagccagatcagtggtggcctcagattctcataggagcgccagtcctattgtgaactgcgcacgggagggtccaggttccatgct

SEQ ID NO: 80030 - DNA, 21 bp, Homo sapiens
  chr17:1545300-1545321
  hypo
ccaccgcgcccagccagggat

SEQ ID NO: 80031 - DNA, 139 bp, Homo sapiens; identical to SEQ ID NO: 44955
  chr17:1546311-1546450
  hypo

SEQ ID NO: 80032 - DNA, 15 bp, Homo sapiens
  chr17:15820731-15820746
  hyper
ggcgccaggctgagc

SEQ ID NO: 80033 - DNA, 253 bp, Homo sapiens; identical to SEQ ID NO: 36399
  chr17:15820777-15821030
  hyper

SEQ ID NO: 80034 - DNA, 146 bp, Homo sapiens
  chr17:15847860-15848006
  hyper
agcctcgctgggaggcggccggagggggctgcagcccccgagggctccttgcagtccggccccgcagcctggagacagctccggtggtgctgcgctgcccgagactgctgcacgagcggggactgcggcctcggctccctgcctgc

SEQ ID NO: 80035 - DNA, 312 bp, Homo sapiens
  chr17:15848567-15848879
  hyper
gctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggc

SEQ ID NO: 80036 - DNA, 68 bp, Homo sapiens
  chr17:15849143-15849211
  hyper
ggggagtgcggtccccggcgcccggggaggcgccgtggaaaccccggggaaagcgtcacccccgggga

SEQ ID NO: 80037 - DNA, 30 bp, Homo sapiens
  chr17:15855838-15855868
  hypo
aaggactgcacaccccgaggtcacccccaa

SEQ ID NO: 80038 - DNA, 38 bp, Homo sapiens
  chr17:1589533-1589571
  hypo
aaagaagccgggcaccgtgactcatacctgtaatccta

SEQ ID NO: 80039 - DNA, 24 bp, Homo sapiens
  chr17:1608003-1608027
  hypo
tttttttttttgagacggagtctc

SEQ ID NO: 80040 - DNA, 80 bp, Homo sapiens
  chr17:1623392-1623472
  hypo
cctgccacactggtccgcagctggtgcactacttttctccctgccggattagcaagagctgaccccgctcaacatgggct

SEQ ID NO: 80041 - DNA, 32 bp, Homo sapiens; identical to SEQ ID NO: 44956
  chr17:1623703-1623735
  hypo

SEQ ID NO: 80042 - DNA, 34 bp, Homo sapiens
  chr17:16255661-16255695
  hyper
gagcagccaggagggcgagcggcagggagcatta

SEQ ID NO: 80043 - DNA, 97 bp, Homo sapiens
  chr17:16256941-16257038
  hyper
ctgcctgttcagtcccgcaggcagaggggctgcgcctgggcctacgctcgcgatacccagaatccactcgcacctgcgaaggcgcccctgccctgtg

SEQ ID NO: 80044 - DNA, 142 bp, Homo sapiens
  chr17:1627248-1627390
  hypo
tcacagagtgtgttgcgagggccaaatggaatgtgactgttgaagtacttaggaaagttaaaaagctccttcctatggaaggtggcatggaggcgccggggggattccatgtcaaaagtcccagttctggccgggcgcggtg

SEQ ID NO: 80045 - DNA, 316 bp, Homo sapiens
  chr17:16282207-16282523
  hypo
cttgcacaacaagcacgtcaatgggagcaggatcagctactttcttgtaggtgaattcccgtttttgaagtggggtttcggctccctaatctgcacttttttttttcctaccagtttggagaaacagctgggaagaactggatttgcaggtattgctggagccagagcgaagcccggccactgtcaccatgggctccagcctcgcctctctgggcctggtggtgagcggcttcagcaacaggtttccggtccccgcagagggtcccactctgaactcccgatttacagactgttctcgggccgtgatgaggattaa

SEQ ID NO: 80046 - DNA, 23 bp, Homo sapiens
  chr17:16283522-16283545
  hypo
tccgcgcccggccaggggcgcgc

SEQ ID NO: 80047 - DNA, 277 bp, Homo sapiens
  chr17:16310319-16310596
  hyper
ctggctcaccgctccagagcgcgctcccgggtcggcctccgccctccaagccggagggaaatgctgtggtcccgccgtccgcctgcatcctccagttcctttggagggcaggggagtggagcccacaggctctgacacccttacagtccagctctgtgacttggggaagggagtggcgcatgaggagggcgaagctggagtccaaaggaaggtccttccgttcccgcccccgacccgggatccgccgaagcgactgcggaggcgggtcccaggcctg

SEQ ID NO: 80048 - DNA, 159 bp, Homo sapiens
  chr17:16432126-16432285
  hypo
gactgagggaattagcgttgacaagtagaaagaactcctataatttgataaagactctgcttgaccaaactttagtcaggctcctgaaacttgtcctgggctcatctgtgcggttacttgtaaatctagttttagcaaagaacccggccaagtccgttc

SEQ ID NO: 80049 - DNA, 30 bp, Homo sapiens
  chr17:16440314-16440344
  hyper
ttagaaggttataggcgcacaatcaaggaa

SEQ ID NO: 80050 - DNA, 812 bp, Homo sapiens
  chr17:16471976-16472788
  hyper
gtttacaaggccctgcggaggtgatgcgacagccttgccttgcctcctgtcgcctccccttcccggccaagtccctctgcctcttactcctcttcagccgcagggtcgaggtcgagggcagcgggggagtcggggaccgtgcgacgcgcaacgctgggactgggcccacagcagcctccaccccgtctttgccctcccgcaagccacgagcacgggagcccgcgcgtggacgggctcgggctgtcactgatcgcgcggacactcgcgcgctgcgcccggacatcaatacctgtcgctgggacccggccgacgggcagccggagcggccctaaggccacaggcaacaatggcgacgctggcacaggcgcctgcgtggcgggctcagtcccgagcggcagcggatcctcgggctccgccacttcccttccccgcaaagcacagagtgtcccggccaggagctgcacgttccagcccggtcctgagaagcccggcccagaaaccccggcgcctctgcttagccgcgacctcgcctcggcgtcactgcgcatgtgcgccagaggaacgctgcgcgcccgcagagccaatcggagcccaagctgccgcctccccctcccgcgcctctggccctggacctgtctccatggcaacctcctccacccatcgctctgacttgcttgtcagcctgcgaggttccgaagggaacttcaaagtttccccgggcagacgcaggtctggtagacgtcttggaggccagggaggtgccagtagctggaggagcgccgggagttgaagccccgcgccaactacgcaga

SEQ ID NO: 80051 - DNA, 109 bp, Homo sapiens
  chr17:16492360-16492469
  hyper
ggagcgccggtctcccggtcccgccgggctcacagggacggagcggcctgggattccgcccacccccttcccgccgtcagcgattcctcctcctcggagggtctgggga

SEQ ID NO: 80052 - DNA, 111 bp, Homo sapiens
  chr17:16570208-16570319
  hyper
cgtggagggagcgatgcccccgcccgggactcctggtgggtgatggcgccgggaggccttggctgggacagatcggggcctcccggtcggtcagcgactcgcgcccggctg

SEQ ID NO: 80053 - DNA, 193 bp, Homo sapiens
  chr17:16570360-16570553
  hyper
cgcctctcggggtccgctcccccggactggccctgcccacggagcgcgggtagcagccggcggccaggagccagtggcgggagccaccggtgggaaaaccggcaggaggctgcgctggaccccgctgggcagcgccaatccctaaggcagccgggcgggtgagctaacggcggcgggggcggctgagaggctg

SEQ ID NO: 80054 - DNA, 280 bp, Homo sapiens
  chr17:16570673-16570953
  hyper
aggcggctgaggggctgaggctggtgaggggcttgaggggccgagcggataaggcggctgacgcggctgaagggactgaggggctgaggtggctcaggggctgacgcgggtgaggggctgaggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctcggtgtcctttctta

SEQ ID NO: 80055 - DNA, 30 bp, Homo sapiens
  chr17:1675342-1675372
  hypo
tccttctcggtgtggcgcacttcaagggtg

SEQ ID NO: 80056 - DNA, 39 bp, Homo sapiens
  chr17:16830521-16830560
  hypo
gcaggcaggtgctagcggggagaccggggtgggagctgg

SEQ ID NO: 80057 - DNA, 16 bp, Homo sapiens
  chr17:1696340-1696356
  hypo
agctgagaccacaagc

SEQ ID NO: 80058 - DNA, 30 bp, Homo sapiens
  chr17:16993611-16993641
  hypo
ggcagaagggtcttacggccccaacccgtc

SEQ ID NO: 80059 - DNA, 59 bp, Homo sapiens
  chr17:17062602-17062661
  hypo
cctagatggtttcctcgttctgactcccgatggcaggaggggcgcgagcagggcaaggc

SEQ ID NO: 80060 - DNA, 30 bp, Homo sapiens
  chr17:17067369-17067399
  hypo
cagaactgggaggcccgagtgttactaacc

SEQ ID NO: 80061 - DNA, 30 bp, Homo sapiens
  chr17:17090124-17090154
  hypo
tacagaaggaacattcgggaccccgctgtc

SEQ ID NO: 80062 - DNA, 30 bp, Homo sapiens
  chr17:17100986-17101016
  hypo
cccatcggtgctgatcgcagccagcagccc

SEQ ID NO: 80063 - DNA, 105 bp, Homo sapiens
  chr17:17123888-17123993
  hypo
ggcaagccctgagcccgaaaccccatactgcgcatgcccagcacacctgcgtttccagctctcacaaaggcttcgacagacctggctcttcgtgctaaaaagctc

SEQ ID NO: 80064 - DNA, 84 bp, Homo sapiens
  chr17:17146203-17146287
  hypo
aaacggactgtgagccgatgagtagcatttactgcatgggttaattccagagtataaatttgcccttggaggccgggcgtggtg

SEQ ID NO: 80065 - DNA, 67 bp, Homo sapiens
  chr17:17204144-17204211
  hyper
tctgagttggcggggcgggagttccccagatgccgctgcagttgccctgctgcggctctggcccagc

SEQ ID NO: 80066 - DNA, 30 bp, Homo sapiens
  chr17:17250180-17250210
  hypo
cagctgcagcccccccgccgcaggctgcac

SEQ ID NO: 80067 - DNA, 100 bp, Homo sapiens
  chr17:17395947-17396047
  hypo
aagagcagttctctccgttgcctctcgaggaggaggtgcgaagtcctggagtattgtttgggtctcggaatgggcgcataacctgcgctgaccagtttag

SEQ ID NO: 80068 - DNA, 531 bp, Homo sapiens
  chr17:17398606-17399137
  hyper
cttcttgttccgcagcgccttcttgtgcagcacgtcgcagtactgcaccgagaccttgcggtgcaggtctgggctcatctcgctgggcagcttggccatggcgaagagcgcgcggaacatctggtccaggctgctgttcttcttggccgagatctcgaagtaggcgcagcgctgggggtcgtcgcccaccagctgctcgatctcgcgctggtccacctcgcggtagaagtcgcggtcacccttgttgccgcagatgaccaggggcacgtccacgttctccttggttttgttcttgaggcaagacttggtgtcgaggatctgctgcctgagccgctgcacctcctcgaaggagtcgcggttgtccagactgaacaccaggatgaaaacgtctcctagagggggcacagagagcagaaaaggagaaggtgagggtggccgcccaggggacaagtcgggctgactttgaggccgcgcggggcgcgctagcctctctaagcgcgaagcgcactactcggcgcgcggcagccggac

SEQ ID NO: 80069 - DNA, 153 bp, Homo sapiens
  chr17:17399419-17399572
  hyper
gatagcagttcttggccgggatactcagctccgagtcgctcgggcacatcttcttgatcatcgcggccagtttcattgggcagaggggccgcgagggcgggcgcggggccgagagaagggcagagagcggctgagggtcgctggggtggcacg

SEQ ID NO: 80070 - DNA, 30 bp, Homo sapiens
  chr17:17466959-17466989
  hypo
gggtggcaggcaaagcgacaggtgtactgg

SEQ ID NO: 80071 - DNA, 198 bp, Homo sapiens
  chr17:17579330-17579528
  hypo
ccatccagttttcatcgcagaggaggcggggcggcagcgtgggcaggagctcaggccaggagaatccctactctaagtatgactgtgtgatcttgggcaagtgacttcattccctaagtgtgtttcctcatctgaacaaggaggctattgaaatgcaggtgagacctagtgagacagcggctgcgggaatcacctggc

SEQ ID NO: 80072 - DNA, 39 bp, Homo sapiens; identical to SEQ ID NO: 45009
  chr17:17592178-17592217
  hypo

SEQ ID NO: 80073 - DNA, 30 bp, Homo sapiens
  chr17:17612465-17612495
  hypo
gagggcctagtgtgccgggcactgtgctga

SEQ ID NO: 80074 - DNA, 46 bp, Homo sapiens
  chr17:17687009-17687055
  hyper
tcctcgcccccgccccggatctggtcctggccggggcgcccggtga

SEQ ID NO: 80075 - DNA, 36 bp, Homo sapiens
  chr17:17700921-17700957
  hypo
aaggggcgtgccaagcgacgacgacagcagcaggtg

SEQ ID NO: 80076 - DNA, 183 bp, Homo sapiens
  chr17:17717969-17718152
  hypo
gcacagccgctcagccgcctcctcatcccgccgcagccagtggatcaccacagctgtcagagaggcccaccacttggccaccgggtctacgcctgcagaagagggagggtcccctgaaccctcagtcacgctgcacgggggagctgagaagggagccaggacaggggccggggactcaccggt

SEQ ID NO: 80077 - DNA, 30 bp, Homo sapiens
  chr17:17750275-17750305
  hypo
gcctgcagggaccctcggtgccaggctcgg

SEQ ID NO: 80078 - DNA, 114 bp, Homo sapiens
  chr17:17891258-17891372
  hypo
caacattgagaccatcgaggggctggacacactggtgaacctggaggacctgagcttgttcaacaaccggatctccaagatcgactccctggacgccctcgtcaagctgcaggt

SEQ ID NO: 80079 - DNA, 40 bp, Homo sapiens; identical to SEQ ID NO: 45011
  chr17:17910311-17910351
  hypo

SEQ ID NO: 80080 - DNA, 38 bp, Homo sapiens; identical to SEQ ID NO: 45012
  chr17:18070928-18070966
  hypo

SEQ ID NO: 80081 - DNA, 48 bp, Homo sapiens
  chr17:1811643-1811691
  hyper
tcgcccgggacttcccgtcctccaagcctgcgtcggctgtgccaggtt

SEQ ID NO: 80082 - DNA, 142 bp, Homo sapiens
  chr17:18127894-18128036
  hypo
gcttggcagccgcctcgggctcagaggtcagctcctgctccctggacacagctggtggggttggggcctgtcctacctgccccacctaagcttctaggacctcccgcagccccagccctgagccaggcggcctatcctcagc

SEQ ID NO: 80083 - DNA, 38 bp, Homo sapiens
  chr17:18157976-18158014
  hypo
ggttggggatggtgtcgatgctacgggtggggagcagg

SEQ ID NO: 80084 - DNA, 261 bp, Homo sapiens
  chr17:18163093-18163354
  hypo
cagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 80085 - DNA, 222 bp, Homo sapiens
  chr17:1819556-1819778
  hypo
tgctgggagaggggacgtctcttccgtggaaaagcagcatctgtaatggagtccttagcaatggcagagggaggggtgatgtggggaaatgcacaaagctgagcgtgaagtgtaaatatgatgattgttgtctctttcttgggaggtaaataaatcagctcgatgtagatttgagaggtggctggtgatgctgtgtactcagcgccccgaactcggcctctt

SEQ ID NO: 80086 - DNA, 30 bp, Homo sapiens
  chr17:1824581-1824611
  hypo
ccaggtgggaggcggcgttgcggaggagcc

SEQ ID NO: 80087 - DNA, 30 bp, Homo sapiens
  chr17:18267413-18267443
  hypo
gacggagcgagacaacgtctcaagaagaat

SEQ ID NO: 80088 - DNA, 196 bp, Homo sapiens
  chr17:18314944-18315140
  hyper
ttctcctctcccaatcgtcttctttcccagcctcttctccattttcttgccgcctccatatccccaccttcttctcgcagcagcgtcttcctgccgcgcttttctctcccctcaccatcttctcttcctcttccccaccgtcctctccccacgccctcttctcctcactgtcttctccccgcgccttccccacaac

SEQ ID NO: 80089 - DNA, 86 bp, Homo sapiens
  chr17:1832993-1833079
  hypo
tgtcccacactaggctgcatgagactgcacaagggagagaggcaggacgccgtgccagagaggcatgtgcacgtgtgtgtgcaaaa

SEQ ID NO: 80090 - DNA, 43 bp, Homo sapiens
  chr17:1835919-1835962
  hypo
gcggcaaggttgccacggtcagaaaccacgtgcctatggacag

SEQ ID NO: 80091 - DNA, 34 bp, Homo sapiens
  chr17:18538112-18538146
  hyper
cctcagcccctcagccgcctcagcccctcagccc

SEQ ID NO: 80092 - DNA, 93 bp, Homo sapiens
  chr17:18538206-18538299
  hyper
ccacgcctctgctcgctcacccgcccggctgccttaggggtcggcgctgcccagcgggctccagcgcagcctcctacccggcatcccaccggc

SEQ ID NO: 80093 - DNA, 120 bp, Homo sapiens
  chr17:18760619-18760739
  hypo
cctggacaacagagcgaaactccgtctcaaaacaaaaaactaacaaacgaacaaaaaactgatcatttattatacacccagaactgtgcttttagcacagttttgttttgttttgttttg

SEQ ID NO: 80094 - DNA, 30 bp, Homo sapiens
  chr17:1887214-1887244
  hypo
aaccctgctccctcccggctgggacatgta

SEQ ID NO: 80095 - DNA, 296 bp, Homo sapiens
  chr17:1901493-1901789
  hyper
cctttgggggaggggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttccctctcgcgggagccgccggccggggatctgcgcaccccacgcgccccgctcgggtcgggcctcccctccc

SEQ ID NO: 80096 - DNA, 157 bp, Homo sapiens
  chr17:1901813-1901970
  hyper
cgctgcccagcgcgcaggtccctgccggatccccggcggctttcctgcccccactttacagacgtgaacgctgaggcggagggtgggggacgtggggccggctcgcctcctcctgggctcgccgggatgtggcctccgaggtcgccgcggcgctttc

SEQ ID NO: 80097 - DNA, 30 bp, Homo sapiens
  chr17:19211734-19211764
  hypo
tagttgtccatctgtcgacctgtgcatgca

SEQ ID NO: 80098 - DNA, 34 bp, Homo sapiens; identical to SEQ ID NO: 45015
  chr17:19230161-19230195
  hypo

SEQ ID NO: 80099 - DNA, 41 bp, Homo sapiens
  chr17:19230676-19230717
  hypo
tattcatataaagttcggaaaatagggacttggcatggtgg

SEQ ID NO: 80100 - DNA, 300 bp, Homo sapiens
  chr17:1927406-1927706
  hyper
gcaccaactttgccgcgctccgtaccgggccgggctgctggggcgtctagctacggtggtcgcgaagccagctgtcctcaagttgagctgtgcaccggtcgcgcacactggcggcacggctttcgcgtccctccgctcccagcataatgaaagtttgaggaactggacatcaggcgctggccgctccccaccctcagccgctgggtgcccagagcccatccctagcgatcagagcagaactgcagagaagacgtccgcgtccgggccccgtctggggagctagggcgcgcggggagcgcc

SEQ ID NO: 80101 - DNA, 290 bp, Homo sapiens
  chr17:1927990-1928280
  hyper
ccagcagcagcccctcggcgggtgcgcccggcaaaacccaccagcccgccgggggctacttcccagaccgggagccccggcgccgggcggcgcccgggctcgcggctctttccggagcgcattcaacttcaacttgcccctgcggctccaactcacctttgcgaagcatgttggccacggggccgccgctccgaggtcggcctaggcgcactccctcccggggtccagattcaaatccctgggcgccagctgcagctaatccgagcgcgtcgaggcgggggcaagccggg

SEQ ID NO: 80102 - DNA, 844 bp, Homo sapiens
  chr17:19436820-19437664
  hyper
ctctgggtccttccacgccaggtcattcagaacctgaaacccccagcggaggtggagagccggggtgagtcctggcgtccgagacgtggaggacccagcccccggagcgcgttccgttagtttacagagctttttcaaactttgccttccaagtgcaggagttccttggtctttgcaagacccgcaggcgtccgcagtggtgcagagagaggtgcaaggggcgcgcccaaggtcgcaggctgcctggctgcgcgctcagtcgggcccccgggcgccaggcgcggggcgggctctgggcgggcggccggggcggggactgcagagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcggtgagtaaggtggcctcagtggcaggccggtaccggcgggctggggacctggtgatttctgcctccgcgggtgactttggcgggctttggggaccgagcgagctgtccgccggcgggctccggggagcatcgtgccaggagccgggcgggcaccccagctcctctgcctgcgtcccggccgctttccgctccgcaccacccgactgggggccccgcggggcactgcgggaacggctggtacgcgcccgggcgcatgttggctcggagaggccggcgg

SEQ ID NO: 80103 - DNA, 30 bp, Homo sapiens
  chr17:19482865-19482895
  hyper
aagcatgccagaaagcgccagccctgtgct

SEQ ID NO: 80104 - DNA, 312 bp, Homo sapiens
  chr17:19483115-19483427
  hyper
cctgggcgtctggagcgggtccgggacggggaggggcggggctgggtgggatcgggtcgcccccctcacccccacaccgcgctgcggtcccgcgcccgcgccgccgccagccgctcccagcctccgcatggaggcccctgcggccgccgacgccccggtccccgccgagctccccgccgccgccaaggaccggcccccatagcggctccgggccctcggatggcgtgacggcttgtggggcctgcggggtgcgctgcccccggacctgcggggggaggcggctgagctggcggcgctcgcgggcccagtggt

SEQ ID NO: 80105 - DNA, 262 bp, Homo sapiens
  chr17:1956915-1957177
  hyper
atccagaacatggggcggactcaggcagcggcgggaatcaggcggactcgtttggaccgaagcctccgccaggcaccgaagccgtgaagtcgcctgcgcagcaaagggagcctccggggggcgcccgagaccttggtgtcgctcgggggccgctggtagccgcgcccgctgcccctcgcccggtgactcagccggtacctctggcggggccatgggggccagaggacagcgcggggggcggcgagcgcggttgctaagctct

SEQ ID NO: 80106 - DNA, 115 bp, Homo sapiens
  chr17:1957480-1957595
  hyper
ttctcccagaagagacgtcacccacacaaacctgaccttcacgtggggcgcgggaccttgcggggtcccagccgcaggcgcccctgttgtttccttcgggcgggtgggttggaga

SEQ ID NO: 80107 - DNA, 132 bp, Homo sapiens; identical to SEQ ID NO: 36334
  chr17:1959132-1959264
  hyper

SEQ ID NO: 80108 - DNA, 198 bp, Homo sapiens
  chr17:1959436-1959634
  hyper
gggccccgaccgagggttgacagcccccggccagggcggcgccagggcgggcaccgcgctcccctcctccgtatcacttcccccaactggggcaacttctcccgaggcgggaggcgctggttcctcggctccctttctccctacttgggtaaagttctccgccctgaatgacttttcctgaagcggacattttactta

SEQ ID NO: 80109 - DNA, 30 bp, Homo sapiens
  chr17:19611097-19611127
  hypo
agagaaggaggaagacggtctgtgcaaact

SEQ ID NO: 80110 - DNA, 49 bp, Homo sapiens
  chr17:19618412-19618461
  hypo
caagctgggtactcacggccaccgcgagggtcaccgatgccagctccac

SEQ ID NO: 80111 - DNA, 228 bp, Homo sapiens
  chr17:19622428-19622656
  hypo
actgcacacaacagacggatcagcagctcactctcaggaacagggctgccaatcccctagaatatacaagcaagtccgggcgatgctggaccctttcccttctcagctgatcacttgtttccaaggcccttatttcctggggcacatggcctatgacattctcccgatgccagttgccgtgtcagccacgttctctgatggaaacagtagaaacgaactgggatcatg

SEQ ID NO: 80112 - DNA, 177 bp, Homo sapiens
  chr17:19648102-19648279
  hyper
cgggggcgcgcggggcgcggcggaggggagggcggtgcgcccagtctccgcgaccgaggggccaggtggccccaagtccttcctgaacctctctgggtcgcactctccccagcccctccccccacgccccatcgcatggccccgacactggcagaaggcggccgcccagcctgagca

SEQ ID NO: 80113 - DNA, 95 bp, Homo sapiens
  chr17:19769817-19769912
  hypo
ctcaaaaataaataaataaataaataagaaaagtagcattacttcatccgataagcaacaaagtcagcccacttttaacacgccccttgggcaac

SEQ ID NO: 80114 - DNA, 470 bp, Homo sapiens
  chr17:19770389-19770859
  hyper
ccgcggggtgggccccgggcacacaggaggatcagcagcagccggtcggtaggcggagcgctgccagaggcttgggcctcacaacaaccctcacaggaccaaaacaaacggcgagacgggctgcgcgcacaatagcatacccgggcggctagccgagtcgggggtctcggctcgcggctgcgccaagtttcagaaccacctagccccgtgcctgccgcccggggcccggcctcgccccggccggcgctcacctggcggtgccgcccccggaagaccacggcgaaggccccgtgtcccacgagatccctcttgctgtactcgaagtcacccaccacctccatggccgcgcccccggggcacacagcggacgggcgggcggcgcagtgcggcgcaggtatcagcaccgcggctccgcgggcccggagcgcgccagcgtgcggcgggtctggggcagccgcagccccgggccc

SEQ ID NO: 80115 - DNA, 135 bp, Homo sapiens
  chr17:19771274-19771409
  hyper
ccttgaaggccgcagcgccagccggctccctccgccggggaaaggagtgcggccagggcttggcgcccgcagctgggcagatcctcggccgctcctgaggcggggacgaagggcgcgacccgctgcggccacagc

SEQ ID NO: 80116 - DNA, 118 bp, Homo sapiens; identical to SEQ ID NO: 45018
  chr17:19771594-19771712
  hypo

SEQ ID NO: 80117 - DNA, 150 bp, Homo sapiens
  chr17:19890251-19890401
  hypo
cagccccagtccatttttaaataaggaaaggaatgtgagctggggccgtagcatgcctgggcatgtagtaaaatcagaaagaaggaaaaggagaagaaaggcggggggtggtacttggaattagagaataagaagcggatcagcctgttt

SEQ ID NO: 80118 - DNA, 41 bp, Homo sapiens
  chr17:19925117-19925158
  hypo
ggattacaggcgtgagccactgcacccggccatcccaaggc

SEQ ID NO: 80119 - DNA, 30 bp, Homo sapiens
  chr17:19985359-19985389
  hypo
gccgttctgggcctccgccatccaccgcca

SEQ ID NO: 80120 - DNA, 189 bp, Homo sapiens
  chr17:19995800-19995989
  hypo
caggtgtgtttccctcgcttctttctctctttcacatttccaagtgaaaatagtcttctctgtgtagaagagtgtgttccttggatctgatatgtctgtctgcctcctgccctgaacacacatttaattgacccatcactgtgtgctgctgagtcagaaggcagagcagcgctccgttgaacaccatca

SEQ ID NO: 80121 - DNA, 34 bp, Homo sapiens
  chr17:20008373-20008407
  hypo
acaactctagagatacgccaactgctttctcttt

SEQ ID NO: 80122 - DNA, 30 bp, Homo sapiens
  chr17:20014279-20014309
  hypo
agctgggaagagcctcgcccagcagctgtg

SEQ ID NO: 80123 - DNA, 30 bp, Homo sapiens
  chr17:20108333-20108363
  hypo
gtcgccagatgcttccgactttgagcacat

SEQ ID NO: 80124 - DNA, 30 bp, Homo sapiens
  chr17:2015149-2015179
  hypo
tgcagcttgcacacccgctccatgcagttt

SEQ ID NO: 80125 - DNA, 30 bp, Homo sapiens
  chr17:20218717-20218747
  hypo
atctggtggctctgccgtgttcttctgggc

SEQ ID NO: 80126 - DNA, 30 bp, Homo sapiens
  chr17:20516049-20516079
  hypo
acaagcagtctgggccgagacagcatgagc

SEQ ID NO: 80127 - DNA, 241 bp, Homo sapiens
  chr17:20747219-20747460
  hyper
gacgacctactgcttcgacgccttccctaagtgagcggcccgggcggggacggaggcggggcggggacggaggcggggcggggcccgggccgggcgctaagtctcacccgctccacgcccctcccgcagcatcgagaaggtgtcctagatcacgtcgcccgtgctcatcatccacggcacggaggacgaggtgatcgacttctcgcacgggctggcgctctacgagcgctgccccaaggcg

SEQ ID NO: 80128 - DNA, 183 bp, Homo sapiens
  chr17:20755766-20755949
  hyper
tcaccgagcgcacctcgcaatctctgatcttcgaacccactgaaaaagcacaaggcatggggagtcctgttggttcacgccccgggtgcgaataccaaaagcaactcccgctggaaagcctgcaggaaactcgagacaaagacagaggcaaacgcaacgctgggaagagccaggggtgctgcc

SEQ ID NO: 80129 - DNA, 196 bp, Homo sapiens
  chr17:20755950-20756146
  hyper
tctgcaaaagcagagacgcgtctcccttcgggcaaagtgactgctacaaagtctgttccctcctgcgcagggacagagacatttaaaggcctgaacggacgtcagcaccagtagagctcgctgggtgagcgccaggcctccccgccccaaggatagcgcgcacagggcgatctgctgctcgcgaggtagaaagtgg

SEQ ID NO: 80130 - DNA, 198 bp, Homo sapiens
  chr17:20771771-20771969
  hypo
cagtccaggaacctccgtgggcattaccgcagtatataaatgatgctgaagcggaaacacgttttttcaagttcctgtatttttatgtggagttgctcactgcccaacgtagaggactaggaatcaggagtcggtggccgtatgctggaggctggagccgcgggagcgcggctcgcctcgctgcggttgttggcagtg

SEQ ID NO: 80131 - DNA, 78 bp, Homo sapiens
  chr17:20813557-20813635
  hypo
aacaatacactgtaacgatgatgacagaataatataaaatgagacccctttctgctctaatcatatgaaaatagcaca

SEQ ID NO: 80132 - DNA, 39 bp, Homo sapiens
  chr17:20817539-20817578
  hypo
agcccagcaatgaaccgagtcagtgacattacagacttc

SEQ ID NO: 80133 - DNA, 39 bp, Homo sapiens
  chr17:20817878-20817917
  hypo
aaaaaaaaaaaaatgtgactctttcgaaaaaaaaaagag

SEQ ID NO: 80134 - DNA, 114 bp, Homo sapiens
  chr17:21104001-21104115
  hypo
atgtacctgaagctccgaatgtgcctgacaggaactagcttcctttcatggctaacgagaagcacagccctcagtgtgcacagacgcgaaggtcccgtccgcccagcctgtcct

SEQ ID NO: 80135 - DNA, 145 bp, Homo sapiens
  chr17:21147453-21147598
  hypo
aggcatctgggacctcggtgtgctgcaggtccacgatccgcttgcccacgtactcatagagcaggacggcccggtcatgacatcctgggggttgtggagacaggtaagcctatgctgactcccatcccagcggactcaggcacca

SEQ ID NO: 80136 - DNA, 64 bp, Homo sapiens
  chr17:21150794-21150858
  hypo
ccatcccactaaacacgattctcacagccccatgtacagatggggaaaccgaggcccaggaggg

SEQ ID NO: 80137 - DNA, 27 bp, Homo sapiens
  chr17:21168792-21168819
  hypo
acctgaggctcttaacgattctctgga

SEQ ID NO: 80138 - DNA, 30 bp, Homo sapiens
  chr17:21178051-21178081
  hypo
ggactctgcaacctccgcctctcggattca

SEQ ID NO: 80139 - DNA, 196 bp, Homo sapiens
  chr17:21859901-21860097
  hypo
gcaaaacttttcttgcgcatttctgcgctggaacgcctacccgctccgccaaaccaaaactttactatcacccttagtgccgtgtcctgcactttcttggagatttgtaccaggcgctggagactctcccacctggtccatgcccgccgcccggtgagcactgagacccaaccttgtgcaccgccagtcttgttat

SEQ ID NO: 80140 - DNA, 37 bp, Homo sapiens
  chr17:21911061-21911098
  hypo
tcaggcctgccaggacggtgttcgggtgagtctcccc

SEQ ID NO: 80141 - DNA, 30 bp, Homo sapiens
  chr17:21953249-21953279
  hypo
acaaagatcatccatcggacatctggtcgc

SEQ ID NO: 80142 - DNA, 120 bp, Homo sapiens
  chr17:2207847-2207967
  hypo
tttaaaaactagatacgatatagttggaatcgtgtggaaggaagtacatcaggaggcatataagtccatttgggacctgtaatcccggcgactcggaacgctgagacgggcggatcgctt

SEQ ID NO: 80143 - DNA, 36 bp, Homo sapiens
  chr17:2208027-2208063
  hypo
gtctccaacagagcgagactccgcctcaaaaaaaaa

SEQ ID NO: 80144 - DNA, 86 bp, Homo sapiens
  chr17:2220973-2221059
  hypo
ccgggataacggagactccatctcaaaaaaataaaaaataaagatgcacatgagatatttaagaggtaaatcgataagatttggtg

SEQ ID NO: 80145 - DNA, 39 bp, Homo sapiens
  chr17:2237982-2238021
  hypo
gcaaataggtaggcccgccgatctcgaaaagcaagatgc

SEQ ID NO: 80146 - DNA, 30 bp, Homo sapiens
  chr17:2250051-2250081
  hypo
gccagtggagggtggcgctaggagaatgga

SEQ ID NO: 80147 - DNA, 66 bp, Homo sapiens
  chr17:2264699-2264765
  hypo
tgtgtgcgcaccaggcgagggagagggacagcttggcatgtcaaagctcttcgccccgggcaggag

SEQ ID NO: 80148 - DNA, 36 bp, Homo sapiens
  chr17:2270585-2270621
  hypo
tagcggccagccgcgcggcctcggtggacgatgatg

SEQ ID NO: 80149 - DNA, 148 bp, Homo sapiens
  chr17:2298883-2299031
  hypo
cagcccagccaggcacgggggaaagtgccgggggcacagcagtgaacaaatcaagcagacctgttccccgccaccagggaatagtaggacagtcacgggggctgacagtcacgggggctgacagtccgggctgcgggcaggacaggcg

SEQ ID NO: 80150 - DNA, 44 bp, Homo sapiens
  chr17:2495626-2495670
  hypo
ttaaaaatcaagggtcggctgagcacggtggctcacgcctgtaa

SEQ ID NO: 80151 - DNA, 44 bp, Homo sapiens
  chr17:2529816-2529860
  hypo
atgacaaacttgaaccggcatcacctttcttccccccccccccc

SEQ ID NO: 80152 - DNA, 30 bp, Homo sapiens
  chr17:25309119-25309149
  hypo
ggacggagaccacgacggccgaagccggga

SEQ ID NO: 80153 - DNA, 148 bp, Homo sapiens
  chr17:2538042-2538190
  hypo
ttgcttgctcagcttcgtcctgagtcatcacccgcaggtggcaatacttgtcacattattcacgctgttttaattgccttcttggccgatgcttccagtagactgtaacttcttgaatgtaaagaccaagtccagccaggtgtggtgg

SEQ ID NO: 80154 - DNA, 40 bp, Homo sapiens
  chr17:25432176-25432216
  hypo
tattcggccatcttggctcctcccccgtggagattttttt

SEQ ID NO: 80155 - DNA, 142 bp, Homo sapiens; identical to SEQ ID NO: 1616
  chr17:25620573-25620715
  hypo

SEQ ID NO: 80156 - DNA, 163 bp, Homo sapiens
  chr17:25676870-25677033
  hypo
gggctgtcacacccccgcctggtgtgcgcatgctaggggcagtgctgacacgctccactggtttcagatcaactttggagaatttggcgatagctagttaaagccgaagatgtgcatgcactgtgatctagcaaccatatgcctcgcaaaacaggccgggcgc

SEQ ID NO: 80157 - DNA, 18 bp, Homo sapiens
  chr17:25680258-25680276
  hypo
cctgtaatcccagcacgt

SEQ ID NO: 80158 - DNA, 30 bp, Homo sapiens
  chr17:25825913-25825943
  hypo
ggaagaagcaaagggcggcatgaggcactg

SEQ ID NO: 80159 - DNA, 30 bp, Homo sapiens
  chr17:25879017-25879047
  hypo
accttctcctttgctcggtagactctaacc

SEQ ID NO: 80160 - DNA, 160 bp, Homo sapiens
  chr17:25907710-25907870
  hypo
gaagaacagatattgcgggagggaggagggaggcagggcttgtgcaatacaggtgcgtcagtcccttctcacaggctgtaaagaaatacctgaaactggattggttatttatttatttatgagacggcctggagtgcagtggcgcgatcttggctcactg

SEQ ID NO: 80161 - DNA, 60 bp, Homo sapiens
  chr17:25928294-25928354
  hypo
ccctgcctcccaagccggtacctgcaattccgctcctccctcctgcgttggccgttctgt

SEQ ID NO: 80162 - DNA, 201 bp, Homo sapiens
  chr17:25931558-25931759
  hypo
ttgccatgctatccacgcggcctttcccctagccaggtgtgagtcagagtaagtacctttgtctcagatctctcccgggagtccccgctagctgagagcagagcggtgttcctcaaggtctccttgacaaaccttgtttactcttaggctcgatgaccagccgaaagcagatgtgttggaagctcacgaagcggaggtgag

SEQ ID NO: 80163 - DNA, 30 bp, Homo sapiens
  chr17:25936581-25936611
  hypo
ccctggctgttcacccgcttggccaaggaa

SEQ ID NO: 80164 - DNA, 30 bp, Homo sapiens; identical to SEQ ID NO: 45035
  chr17:25957285-25957315
  hypo

SEQ ID NO: 80165 - DNA, 39 bp, Homo sapiens
  chr17:25977721-25977760
  hypo
tgttgctgagatgcacggctgtcgcgcagggcacagagc

SEQ ID NO: 80166 - DNA, 30 bp, Homo sapiens
  chr17:25982331-25982361
  hypo
tgggagtcatggagccgctgctgccagaaa

SEQ ID NO: 80167 - DNA, 30 bp, Homo sapiens
  chr17:26078326-26078356
  hypo
tccctgtctgtctgccgggcacccagagct

SEQ ID NO: 80168 - DNA, 102 bp, Homo sapiens
  chr17:26085974-26086076
  hypo
tcagggtgtgggccacgtcccgggccatgcgcacatccccgcaaacatagaggtggcctggctccttgtggagcacacggagcacctcgctggccagctgct

SEQ ID NO: 80169 - DNA, 389 bp, Homo sapiens
  chr17:26120462-26120851
  hyper
tctaaaagaggaaaacgcttttagtaaaccctcaggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcagagcagcctgcacagccggggcccggcggcctcgcacgccgcgcccagcccctcgcgcatggcccggctccttaggcgcagctccgctggctccacgcgcctcccagcgcccgcgctttatcgctcggagcctgcagcccccgccccgggggcggggcgagccgagcagcggcgggggctcttcacccacg

SEQ ID NO: 80170 - DNA, 15 bp, Homo sapiens
  chr17:26120901-26120916
  hyper
cgggacccaagcacc

SEQ ID NO: 80171 - DNA, 36 bp, Homo sapiens
  chr17:26125647-26125683
  hypo
ggaattctgagtcatcggtgccgacagggcatgggt

SEQ ID NO: 80172 - DNA, 31 bp, Homo sapiens
  chr17:26263183-26263214
  hypo
aacaagaagaatggccgggcgcggtgactca

SEQ ID NO: 80173 - DNA, 145 bp, Homo sapiens
  chr17:2627439-2627584
  hyper
gacggcgagtcctctcggtagagaaggtgcccccgctcggccccgcggaggaactctcgcgcgaggagagggctcgaagctttggaaacgtcgggaagtacaaaaggctggcggttcggggatttggggggagccggggccgcct

SEQ ID NO: 80174 - DNA, 524 bp, Homo sapiens
  chr17:2627798-2628322
  hyper
cgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccagaggtgac

SEQ ID NO: 80175 - DNA, 45 bp, Homo sapiens
  chr17:2628323-2628368
  hyper
gtctccccctggcttggaacagaacctgcacggctcagagctccg

SEQ ID NO: 80176 - DNA, 40 bp, Homo sapiens
  chr17:2628710-2628750
  hypo
actcctccccacgtccccacctgcacgtcctaccgcgctc

SEQ ID NO: 80177 - DNA, 177 bp, Homo sapiens
  chr17:2634225-2634402
  hypo
tccagaactgcctggcggcactggaggcaggctcggcagtggctacttaccagtctggacacttgcttttcactattttgacagccagtaccgctgagcctgtgttattacctgaacatcagcgctgccccttcccaagccccagttgcgccgtattccccacggcagggagaaggg

SEQ ID NO: 80178 - DNA, 170 bp, Homo sapiens
  chr17:26346789-26346959
  hypo
atttacagtcccagccgcagtatattcatgagtggctgatttccctataaaaaaatcaacaccggattttaacagtatttttcatttggccaatctgatacagaaaaaatggaatctaagtattgttcaaatttgcatgtctttgatcactactacggctaaacttttgg

SEQ ID NO: 80179 - DNA, 23 bp, Homo sapiens
  chr17:26420105-26420128
  hypo
accgcacccggcctagtggcttg

SEQ ID NO: 80180 - DNA, 215 bp, Homo sapiens
  chr17:2652439-2652654
  hyper
agaaataaaggtgtgcgtggcgggaggtggcggggctcgacctcgggccgctctggacgcccggcagtgccaggcagggcccgggtctgggcggtggaggacaacttctgccagcagcccgccgcgagtcctgtccgcctcccgcgcgctgcggtgcccagccccgcgccagccctcccgggggagctggagcttggccgcgctgctcccccctg

SEQ ID NO: 80181 - DNA, 253 bp, Homo sapiens
  chr17:26554500-26554753
  hyper
tcctggtcactcagccgtcgtgagcgcaggcgcggggcgggcggagcgggacccctggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctc

SEQ ID NO: 80182 - DNA, 348 bp, Homo sapiens
  chr17:26554791-26555139
  hyper
cgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcggcgtctgggcagggttcgggtactgcagtcccgcgtctggatgcccccgccccctgagctgcagggctgtgtgtggtccttccctggtcccaaaataaagagcgaattgcacagaaacggaatgtgtgcctttgtattttctttcctttctccttcgtggaggtggcgtc

SEQ ID NO: 80183 - DNA, 357 bp, Homo sapiens
  chr17:26578290-26578647
  hyper
gcacctgcagcccctcgcccagggcgccctccggcggcagcagcacccacacgaggccggccacgaccagagcgcatgagcagcgcagagcccgcgtctggagggggcagggcggacagagccgcgggcggtcacgtgaccccacggctggggtcggcgcgatccctgacggtagcttgcgggtgttccgcgccgtgggcagcctggcgtgcaggggcgctcagccgagggacgtggctatttctgggacacacaccagtgcacggacgccctaagggacatcctggtgcccaggggaatggtgcacacctggacatgcccggtgatgcacgcagaaagcatcgaggtaaaaatgaa

SEQ ID NO: 80184 - DNA, 38 bp, Homo sapiens
  chr17:2658821-2658859
  hyper
gttctgcggggccggcgctgacccggctccagccgcct

SEQ ID NO: 80185 - DNA, 540 bp, Homo sapiens
  chr17:2659210-2659750
  hyper
ccccaccaccccctccggtccccaccaccccgcgtccccgcgccgggtctctgcggctctccaaagagatgggcgacggggaccctgtgcgagccgtcaggctttgggggaaccccgtccccctcccgcgggggcgccctttccctgcacttcacctttcacgctcgcacggggcttccgccttccccttcgcccccttcaggtttcccatttgtgcctccctccgttccttctgccacccggggcagggctctggacttgggccccgagaaggcaccacccacagcccccaacccctgcgtggaaaggggtgctttagccccgaaacacaggagcccctgggggtgtgcactctggggacagggcgcagagaagggggcctaggagaccagggcaggggaggggtccccgtgtagcggggcagtcgccctttccccctccgcagtcctggcccgctgggaagtcagagcctgcggtgtcaggttaccggactgcaagctcagagggtttcagacgcagcgctgtcgagtcacctgatct

SEQ ID NO: 80186 - DNA, 38 bp, Homo sapiens
  chr17:26634205-26634243
  hyper
ggccgggaagcctggcggccgcccgaacaccacccaac

SEQ ID NO: 80187 - DNA, 30 bp, Homo sapiens
  chr17:2666440-2666470
  hypo
caaacatattttctacgttaacaagttgga

SEQ ID NO: 80188 - DNA, 315 bp, Homo sapiens
  chr17:2680183-2680498
  hyper
gactgaggtgcccttcgctccgggtccagaggcagccgcgcgccaggcggcgcagaaggtcagtggccccggggctgggattccgcagccagcctggatcgggacgtgagtcctggtgtgactgacggggaatcggagcgtgtgtggagtgtgaacgcgtgtgtttgcagacagacatcggcacgtatggacggcgcgagccggtactgcgttccggaggagccatccggcgtcacaggctgtgctggggaggtggggtgaccgtcctcagaaacccccgcgggcggggcgctgcacacacgtccacctataggg

SEQ ID NO: 80189 - DNA, 30 bp, Homo sapiens
  chr17:26897238-26897268
  hypo
tgaataggggctgggcgcggtggctcacgc

SEQ ID NO: 80190 - DNA, 48 bp, Homo sapiens
  chr17:26926767-26926815
  hyper
agtaaacggcagagccgctcttcctccctgtcccgccagctcctgcct

SEQ ID NO: 80191 - DNA, 22 bp, Homo sapiens
  chr17:26927142-26927164
  hypo
actggatttcaaacacgtcgta

SEQ ID NO: 80192 - DNA, 133 bp, Homo sapiens
  chr17:26961803-26961936
  hypo
agctcctcaattttgcgggcaggcaacaactccccatgctgcttccgaagggcggccactttagcatccagtagctgtagtcttttggcactctccttactttcatccttcatcagctcgtagttatcatgaa

SEQ ID NO: 80193 - DNA, 23 bp, Homo sapiens
  chr17:27038663-27038686
  hyper
cgtcctgacccacatcgctctcc

SEQ ID NO: 80194 - DNA, 285 bp, Homo sapiens
  chr17:27038906-27039191
  hyper
ggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaaccgcacactcccgtcccgctccccgccccaccgacccttgggaacccagccgcagccccgcctctgcccgctggcgagagagc

SEQ ID NO: 80195 - DNA, 33 bp, Homo sapiens
  chr17:27039851-27039884
  hypo
aagttatggccatatcgacgacattccatgcac

SEQ ID NO: 80196 - DNA, 163 bp, Homo sapiens
  chr17:27044581-27044744
  hyper
cgtctggtgggggccgggcccgcgcagaccctacgattacgcggggccggatagttcctacgattacgcggggccggatggttcctacaataacccggggccgcggagacccgacgtcatctcggggctgaggctgccctaccattacagagcggcccggggg

SEQ ID NO: 80197 - DNA, 2 bp, Homo sapiens
  chr17:27044880-27044882
  hyper
cg

SEQ ID NO: 80198 - DNA, 24 bp, Homo sapiens
  chr17:27056401-27056425
  hypo
ctccctctgtcaccccggctggag

SEQ ID NO: 80199 - DNA, 24 bp, Homo sapiens
  chr17:27056845-27056869
  hypo
gagccaccgcgacaggccagaagt

SEQ ID NO: 80200 - DNA, 30 bp, Homo sapiens; identical to SEQ ID NO: 16185
  chr17:27074858-27074888
  hypo

SEQ ID NO: 80201 - DNA, 30 bp, Homo sapiens
  chr17:27085505-27085535
  hypo
gagctgccgcacagtcgaggggtgcacctg

SEQ ID NO: 80202 - DNA, 20 bp, Homo sapiens
  chr17:27170162-27170182
  hypo
tttttttttctgagtcgaag

SEQ ID NO: 80203 - DNA, 76 bp, Homo sapiens
  chr17:27181283-27181359
  hypo
gaggctacaaaggatgaagagggctcaaggcctcaaacagagcaaggtaaatgagtttctccggctgctagagcgg

SEQ ID NO: 80204 - DNA, 30 bp, Homo sapiens
  chr17:27271675-27271705
  hypo
aaaacaaagacaatacgacatacctagatt

SEQ ID NO: 80205 - DNA, 30 bp, Homo sapiens
  chr17:27299598-27299628
  hypo
ctctccacccaggcacgtttgggcggaggc

SEQ ID NO: 80206 - DNA, 367 bp, Homo sapiens
  chr17:27332366-27332733
  hyper
tagaggccctggaaccggcggcaaagtcgagcgaagtttggcgggcggcaggggaagcgggaccacgggccgccagctggaccgtcccgactcactgccttgcgccccccggcacgcgccccagcaccctgagatgcctagagtgtggcgaggtagcgcgcgggtgagcgcgtgtgtgcggggagtgggtggcgtgatgaattgcatcagagaaatcccattagatctggggagatgattaaagacgaggtctcggccgggcgcgaatggcgggagccgcggcagcttcccgcccgcgaagcccgcgccccgcccggcttggccggcgccgggggcagcgcagccggcggggcgcggtgcttggact

SEQ ID NO: 80207 - DNA, 100 bp, Homo sapiens
  chr17:27333101-27333201
  hyper
ggggcgcgggaggagcggcttaccgtaaagtctcatgcaaaggcgcagagacccaggggcaggagcccaggctcccgctccaccgcgactgccctactca

SEQ ID NO: 80208 - DNA, 30 bp, Homo sapiens; identical to SEQ ID NO: 16187
  chr17:27411663-27411693
  hypo

SEQ ID NO: 80209 - DNA, 321 bp, Homo sapiens
  chr17:27419250-27419571
  hypo
tgtcacaagtcctgacgtggagggacctgtctagggtgaagggagccacagaggcagctctattctgcctcagccccccgagctctgccccgggcaccttggcccctcaccgctgtcttggctttggcgatgtcatcaatctgcaggtgcaggtcttcgatctccacctccattgctttccgtgctttcacggctgccgcacaggtgaactctgactcctccagctggacacagaccacccccgccccagggagagatgtcagccattccttgggggcaggagggctgtacaggaaagagggagctcggatgccctccttc

SEQ ID NO: 80210 - DNA, 30 bp, Homo sapiens
  chr17:27426754-27426784
  hypo
gccaaggtgcccgcccggaagaacacctgt

SEQ ID NO: 80211 - DNA, 30 bp, Homo sapiens; identical to SEQ ID NO: 36425
  chr17:27466437-27466467
  hyper

SEQ ID NO: 80212 - DNA, 30 bp, Homo sapiens
  chr17:27467405-27467435
  hyper
atgctgctctggctccgttagcagctcaaa

SEQ ID NO: 80213 - DNA, 333 bp, Homo sapiens
  chr17:2756268-2756601
  hyper
cggccaggcccgggtgggcgcggggagggcggagtggggggcgcccggcccgccaggaggaagcggggtcgccgtgaagttggttattgaacccatgtggagtcaaactcccagggccgggagagccagtgttcgcggggagccgaccccagcccactctgcatcccagctcggcgatccttgcgccgactctgcggggaggcgggggcagaattccgcctcgttcctcccatccgcaagctcccacccggggacccgggcccgggagctgcgagccggggcgggcgccgggctcaggtgccccctgtaagcgctgggcggccgggaggggac

SEQ ID NO: 80214 - DNA, 120 bp, Homo sapiens
  chr17:2757584-2757704
  hyper
ggaccttggcggaatcggagggccgctgggagggcgcatcggggtggatccctgacggagggaccccaagtccgtcgcccccagaccctttgcagaccgcgaccccgttccccaagcctg

SEQ ID NO: 80215 - DNA, 88 bp, Homo sapiens
  chr17:27716046-27716134
  hypo
catacactgtatacacggattgcttaggtctgatcaacatgctccttccttggagcacagatctactatggccagcctggtctcgaac

SEQ ID NO: 80216 - DNA, 120 bp, Homo sapiens
  chr17:27716194-27716314
  hypo
gccaccgggcccggcccagagttaatttttattcatgaaactcatataacaggtttatttatttcagtcgttttgttggttaaagaaccaagattttttatgactacactttgtgtacac

SEQ ID NO: 80217 - DNA, 28 bp, Homo sapiens
  chr17:27716614-27716642
  hypo
gagccaccgcgcccggccttacactttt

SEQ ID NO: 80218 - DNA, 30 bp, Homo sapiens
  chr17:27909175-27909205
  hypo
agtgtgcagtgaatacgcatgtgcgtgagg

SEQ ID NO: 80219 - DNA, 196 bp, Homo sapiens
  chr17:27940142-27940338
  hyper
ggatccaggcttcaccgcggagttcagactctccccaggcattgacggggagaacttggtagggtctgggctccgccacgaccaggtgggggccaggacgccgcgggactgaccgcctccactagagggtggtggccgcgggccgccctggagcctccacgccgtgtcccggccccggccggtgggtgggtgcgcc

SEQ ID NO: 80220 - DNA, 321 bp, Homo sapiens; identical to SEQ ID NO: 36427
  chr17:27940590-27940911
  hyper

SEQ ID NO: 80221 - DNA, 696 bp, Homo sapiens
  chr17:27949432-27950128
  hyper
gtgcccttcaaggcgcgtctgcggccccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggtt

SEQ ID NO: 80222 - DNA, 23 bp, Homo sapiens
  chr17:27950259-27950282
  hyper
cgatcggccgggactgcgggact

SEQ ID NO: 80223 - DNA, 30 bp, Homo sapiens
  chr17:27956058-27956088
  hypo
gtcaatcctcagtaacgtggacatcaacga

SEQ ID NO: 80224 - DNA, 99 bp, Homo sapiens
  chr17:2801121-2801220
  hypo
tggtgctttctcccacggctgctgctctctgcatccgtgaaccctgggattgaagtaggggtggggattgccattttgcaatttctgcggagtcttttt

SEQ ID NO: 80225 - DNA, 171 bp, Homo sapiens
  chr17:28088129-28088300
  hyper
gagcgttcgcggaggcggagggcgcgcggcggactcacagctggttgatggcgttctgcgagatgaccgcgttggcggagaagtaaggaatcatgtcggggccaccgaggctgcaggtgcaagcgaggggcgccttcctcttgcgggccaacgtgctcagggtcatggggc

SEQ ID NO: 80226 - DNA, 67 bp, Homo sapiens
  chr17:28088606-28088673
  hyper
ggccccaagacactgctgcctcggtaagggagtgaagctactcaagggtggacgagaaaggcttgca

SEQ ID NO: 80227 - DNA, 105 bp, Homo sapiens
  chr17:28089170-28089275
  hypo
ttacaggcgtgagccagggctcccggcaagattttttttttttaaacagttgaagtaatggtcaaacaaacaaaaaacaatttagattgtcgataacatctacta

SEQ ID NO: 80228 - DNA, 35 bp, Homo sapiens
  chr17:28112487-28112522
  hypo
atgtttgaatattggcgtttcattttttttttttt

SEQ ID NO: 80229 - DNA, 18 bp, Homo sapiens
  chr17:28299358-28299376
  hypo
gcccggcccaggcatttt

SEQ ID NO: 80230 - DNA, 30 bp, Homo sapiens
  chr17:2831027-2831057
  hypo
gccctgggtcctcatcggtaaaatgggcat

SEQ ID NO: 80231 - DNA, 30 bp, Homo sapiens
  chr17:2844357-2844387
  hypo
gagagttttaagctgcgaactgatctcacc

SEQ ID NO: 80232 - DNA, 465 bp, Homo sapiens
  chr17:28562551-28563016
  hyper
ttctatccccctccccgaggcggggaagaaggtctggaaagaaacgtgggttcgaggcggagaggaaaagcggacccacctgccaggctgcgcggggaggctggtcccgggctgggcaggcgggctggcctcgcgccctcgaggcacccggcggcgctggctgtgcggaggggcgccggcgcggccgtatttgtacccgcgggccctcacatggtctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 80233 - DNA, 61 bp, Homo sapiens; identical to SEQ ID NO: 36431
  chr17:28563999-28564060
  hyper

SEQ ID NO: 80234 - DNA, 272 bp, Homo sapiens
  chr17:2859276-2859548
  hypo
tgttagacgtggaatcgcgtgtcagaggtccgtgtatttaacatgttgattgcttctgttgcattatcctcctcctgttcatctttctatccgtattgattggtataagctctttacgtctgctaatcctggtctcctaagcctggagatggtaagaatgccccgcgtgggtggtgcatgtgcacctgagcaagttggaagaggaggtttggcatctggatgtttggcggctcacttctggtcaagggagttgggcgcgggtgccctaagcc

SEQ ID NO: 80235 - DNA, 175 bp, Homo sapiens; identical to SEQ ID NO: 36432
  chr17:28705281-28705456
  hyper

SEQ ID NO: 80236 - DNA, 102 bp, Homo sapiens
  chr17:28715707-28715809
  hypo
gcatgcagccccagccgtgccccctgggagcctgtggcgggtggctcctaatcctcgctgggcctgggccagtgtctgggccaggggcgacattgccacaag

SEQ ID NO: 80237 - DNA, 30 bp, Homo sapiens
  chr17:28836503-28836533
  hypo
atgaaaccttgacttcgtagcatgaactta

SEQ ID NO: 80238 - DNA, 30 bp, Homo sapiens
  chr17:28894952-28894982
  hypo
ccagccgcgtcttcacgtccagcaggatct

SEQ ID NO: 80239 - DNA, 33 bp, Homo sapiens
  chr17:28902754-28902787
  hypo
agcccgcaggttccacgccggcagctcctgcct

SEQ ID NO: 80240 - DNA, 206 bp, Homo sapiens
  chr17:28973624-28973830
  hyper
tccccagccccttcccgacctcgccgctcaggctgtgatgggaaggtccctgggagtggggaggagggcaaatttaaacccggaggggatcctgtagcccagttctcctcggttccctaaacctccaggaaagcggagaaagtcacattgtggtggcagcagcgggttttttttttaatctgttaataaaacgcaagtgaatcaaa

SEQ ID NO: 80241 - DNA, 25 bp, Homo sapiens
  chr17:28988903-28988928
  hypo
aaagagagaggcggccgggtgcggt

SEQ ID NO: 80242 - DNA, 205 bp, Homo sapiens
  chr17:29020865-29021070
  hyper
cactgcagaagaactcgggtgggcgcccccactttcccgcaagctcgcagagagcatcctccgcccacccggcaagcaccacttcatcacgccaccgccagggtgtcaggcggggctgagcggttgtcatttctctctaacccgtcagaactctgcacttccttgacagttcgctggctggcctccgacccgtagctgatttctt

SEQ ID NO: 80243 - DNA, 30 bp, Homo sapiens
  chr17:29032502-29032532
  hypo
gctgtgtgtttgaggcgtaaatggaaggaa

SEQ ID NO: 80244 - DNA, 185 bp, Homo sapiens
  chr17:29033276-29033461
  hyper
cgaaggtctgaggtgcgccagggctctttacgcggcccccagcctctccgcaccctttgtctcctgagcacgccgctcacaagtccaggagacatggatcagatggaggctggagagccgatcccagctgggaccagtggggtttagagggtctagaaaggggtgaggggcgagggtgagggggt

SEQ ID NO: 80245 - DNA, 23 bp, Homo sapiens
  chr17:29232244-29232267
  hypo
aggtttgtcttaggccgggcgcg

SEQ ID NO: 80246 - DNA, 27 bp, Homo sapiens
  chr17:29234370-29234397
  hypo
cgcctggccaaccgtaaggaattgaac

SEQ ID NO: 80247 - DNA, 482 bp, Homo sapiens; identical to SEQ ID NO: 36434
  chr17:29249457-29249939
  hyper

SEQ ID NO: 80248 - DNA, 70 bp, Homo sapiens
  chr17:29298080-29298150
  hyper
gcctgttggccatggcgggcctgggcctgggctccgccgttcccgtgtggctggccgaggacgacctcgg

SEQ ID NO: 80249 - DNA, 327 bp, Homo sapiens
  chr17:29335342-29335669
  hyper
ggaaaagcaaaatcccgggtccctcagacaaaagggcgggtggaggaggagaagccgagagtcctgctccggcgccgccggagcaccgcctgcctcagccgaccagcgccgtcgactactgggcctagcccagacgagaggagggaaaggccgcagaggccgcgaggatgctgcggaggcgcgggcggccggctgccgcctagttgtgcagcccagaccaaggaaagagaagtgggaggagcggggagctcggcgtcccgcgtcctccgcggctcaggacgactacgctcggcacgtccgggaccctccggccgtggcggttgcagc

SEQ ID NO: 80250 - DNA, 89 bp, Homo sapiens
  chr17:29335670-29335759
  hyper
ccaaaagctcgggcctcagcccctgacgctgtggtgactccgccgcgcctcgccgtcgcccctgtccccgtcctgcccgccgcctccgc

SEQ ID NO: 80251 - DNA, 41 bp, Homo sapiens
  chr17:29396500-29396541
  hypo
gctcaaaaaacacaccgtaacggcagtccatggctgggtgc

SEQ ID NO: 80252 - DNA, 157 bp, Homo sapiens
  chr17:2952123-2952280
  hyper
tctcgaatacctccccgcccggctgccactggatggcgcgcgcaacctgcggaaccacagggcgacatccagctgcgggcggcgaagggaattggagcgtggacctctccaggcttttcattcgctggttctgccggtgtcccgccttttccatctc

SEQ ID NO: 80253 - DNA, 427 bp, Homo sapiens
  chr17:29718113-29718540
  hyper
ggcggaggtgaagaacggagtccagagccctccagagatggcagcgaatcccggccctgcctcttgccagctgtgtggcctagagtgagtccgacctctctgggcctcagcttcctccgggatgaatgcagtcacggaacgcgccaatgcaggaggcccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 80254 - DNA, 469 bp, Homo sapiens
  chr17:29718778-29719247
  hyper
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtca

SEQ ID NO: 80255 - DNA, 32 bp, Homo sapiens
  chr17:29805337-29805369
  hypo
aacgtctgccttccgcgcgtgttgggagcctg

SEQ ID NO: 80256 - DNA, 276 bp, Homo sapiens
  chr17:29886452-29886728
  hyper
ccccggccaggagttcgaggggctcccggaacgtcggggcgcgggccccggctagcggctatggcccccgtgcccaggcagcggtgcgggctcggccttgcgggagggtgcggcctgctgcgagaggtcggccacggctcctgccccgcgccccgcgcccctcgcccgccgagctgagcgcaggtaaccgaggcagagcggagctgggcctcgcaggcgcggcgtgggagcgtggcgaagtttctcggcgcataactcttgcgccccactcgggag

SEQ ID NO: 80257 - DNA, 235 bp, Homo sapiens
  chr17:30243754-30243989
  hypo
gcacagacttaactacgatgtaactaaaacgccactctacagttaactccctctattccttagatttcattcccggggtcacctctttggcctaggtgcacacaccgcgggctccgctctaggtggggcacaggccttcgcccgccgcatgcaccctgggctgcgcagccccagccagcccgacccgggctcagcgacccctgcccccgggaccccgcaccggggctgagcgctc

SEQ ID NO: 80258 - DNA, 43 bp, Homo sapiens
  chr17:30244921-30244964
  hypo
gaaaatacttttccccgccgggcgctgtggctcatgccggtaa

SEQ ID NO: 80259 - DNA, 36 bp, Homo sapiens
  chr17:30250325-30250361
  hypo
taaagctctatattgcgggcagatcgcaaggtcagg

SEQ ID NO: 80260 - DNA, 30 bp, Homo sapiens; identical to SEQ ID NO: 45052
  chr17:30333112-30333142
  hypo

SEQ ID NO: 80261 - DNA, 32 bp, Homo sapiens
  chr17:30334317-30334349
  hypo
ccgactcaatgctcccgcgctccccctagcgg

SEQ ID NO: 80262 - DNA, 17 bp, Homo sapiens
  chr17:3036557-3036574
  hypo
ctcgccagttcccaggc

SEQ ID NO: 80263 - DNA, 180 bp, Homo sapiens
  chr17:30389685-30389865
  hyper
gggcaaatttaaacccggaggggatcctgtagcccagttccctaaacctccaggaaagcggagaaagtcacattgtggtggcagctgcgggttttttttttttttaatctgttaataaaacgcaagtgaatcaaatccgccctaagggaaggtgggggggcgcggcgaggcagaggccat

SEQ ID NO: 80264 - DNA, 144 bp, Homo sapiens
  chr17:30622364-30622508
  hypo
gggggagggtgctttcgggtgaagagacctgaatgaacgcctctgctcaggccaaagaggaccattggtacatgctgcttaccttgtctggcttgccccaggcttcgatcttacagggctaaggagcagcgggatggctgtcat

SEQ ID NO: 80265 - DNA, 28 bp, Homo sapiens
  chr17:30710928-30710956
  hypo
aacaaaaaaacatcgactagagcagtgg

SEQ ID NO: 80266 - DNA, 78 bp, Homo sapiens
  chr17:30822187-30822265
  hypo
atgtggttgaacagacgccaccaggtctctggctggggctgaggaccaagcccctgggtccttcggtgtaccagggct

SEQ ID NO: 80267 - DNA, 176 bp, Homo sapiens
  chr17:30846483-30846659
  hyper
ctctggcggcggcggcgggggcggaggctgcggcttcgagcgcgacgcggtcgccaaggcaacgccggccccagcgcccgcggctgaaacgaagccgctgcccgagcccgagcgccagcgcacacgccctccttgcagccccccgcagccccggccggccgcgcttctccgcctcg

SEQ ID NO: 80268 - DNA, 66 bp, Homo sapiens
  chr17:30954269-30954335
  hypo
ggattgagggagggccgagggagtgagtaggctagcgcacaccagcacaggcggtgccagacgtca

SEQ ID NO: 80269 - DNA, 36 bp, Homo sapiens
  chr17:30986312-30986348
  hypo
ttggttcttttgtaccgcatgcgggccagggtgccc

SEQ ID NO: 80270 - DNA, 45 bp, Homo sapiens
  chr17:31144850-31144895
  hypo
agaggtagtaggggccgggcgcggtggctcacgcctgtaatccca

SEQ ID NO: 80271 - DNA, 30 bp, Homo sapiens; identical to SEQ ID NO: 45056
  chr17:31162054-31162084
  hypo

SEQ ID NO: 80272 - DNA, 155 bp, Homo sapiens; identical to SEQ ID NO: 45057
  chr17:31214020-31214175
  hypo

SEQ ID NO: 80273 - DNA, 27 bp, Homo sapiens
  chr17:31370236-31370263
  hypo
tcggcacatccccgttttactgatgag

SEQ ID NO: 80274 - DNA, 30 bp, Homo sapiens
  chr17:31372520-31372550
  hypo
tgggctttggagttacgcaggtgtggcttg

SEQ ID NO: 80275 - DNA, 118 bp, Homo sapiens; identical to SEQ ID NO: 1281
  chr17:31618291-31618409
  hyper

SEQ ID NO: 80276 - DNA, 2037 bp, Homo sapiens
  chr17:31618410-31620447
  hyper
cggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggctttcccggcccctggtcttcctggaggatgcccggcgcccggcactacttctggaggggtcccactgggagccgcctctccagtccctgggtgctgcgcccgccttccctcgtcctggacctcgggggaccctgagccgagtcccccctgccccgcctaaccccagcttttacgctggtcctgggagaagggccactcggccaccatgcctgatctggacatccccagggaccccaccagcccggcccgtagcccagcggtgctgggacacgggagagaaggcgccaaggaacgagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 80277 - DNA, 184 bp, Homo sapiens; identical to SEQ ID NO: 45058
  chr17:32237066-32237250
  hypo

SEQ ID NO: 80278 - DNA, 82 bp, Homo sapiens
  chr17:32239182-32239264
  hypo
tgtgaatcactatgtcctaataaactaataaactttataggtgattctggcaggatgtggtggctcacgcctgtaatcccgg

SEQ ID NO: 80279 - DNA, 23 bp, Homo sapiens
  chr17:32239704-32239727
  hypo
attatagactagggccgggtgag

SEQ ID NO: 80280 - DNA, 30 bp, Homo sapiens
  chr17:32257150-32257180
  hypo
agtctgttaggtaaccgaggctgcaaacat

SEQ ID NO: 80281 - DNA, 109 bp, Homo sapiens
  chr17:32275435-32275544
  hypo
gagatcacacaatcacgggctcagagagttgaaagggaccttaaggtcacctaatcctccagatggaaggcttctgccctgggatgcccactcccgccaggatcacagg

SEQ ID NO: 80282 - DNA, 32 bp, Homo sapiens
  chr17:32478151-32478183
  hypo
gtagagtaggaaaggtccgtgagtaaagggtt

SEQ ID NO: 80283 - DNA, 221 bp, Homo sapiens
  chr17:32483992-32484213
  hyper
tgggggatgtcagggcggccacgctgatgcactgcggtcgggcgcagcggcacagccttcagagccgccgccgctcggttccttttcccatgatgttttggactccgaatgccgtttctcgccgccggcctccgtccctcctctcctcctcctccaggcccccttttgtgggcagaattccaaatgccagcggccgctgctagcaccggggagaggaggca

SEQ ID NO: 80284 - DNA, 112 bp, Homo sapiens
  chr17:32905966-32906078
  hyper
gccccggacccatcccgcacgaagctgagccccagagcccccgcggcccgagaggagctgggcacagcagcgaggctgattcccagccagtgcccagcgaactctgggggtg

SEQ ID NO: 80285 - DNA, 252 bp, Homo sapiens
  chr17:32906304-32906556
  hyper
aggggcgagcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccgga

SEQ ID NO: 80286 - DNA, 421 bp, Homo sapiens
  chr17:32906598-32907019
  hyper
cgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgcaagctgcgcaggtgccggctgccctggcccctggcgccgcgcccgcgtctcaccgcccgcagcccggactggcgcggcgatccgctcgcccaaactgactcggagggagcgggagccgatgcccggcagcatcgagacagcgggcgaacgggcgtccggggacagggtgggggcggcggggaggaggcgtcggagactctgaacc

SEQ ID NO: 80287 - DNA, 481 bp, Homo sapiens
  chr17:32907224-32907705
  hyper
attagccggctttctcgctccctcgcttctccaagccccatctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggggacaaacatctggccgcccgcctcgggcatccggtctgggcgtcgcctagggtggtggcgaccggcgtcgccagtttcagcaccgcacggaaacttttccttctccagatggattaaagttgtctggattttctctttctttgagaaagacagcattcatttgcacctgacctgggatttttatgctgggctgctgcaggggcttggaggaagaaagcggcgctatccatgtgcggttactaccgaaaccgaggaaactggggattgcgttggaagtcggcaccctc

SEQ ID NO: 80288 - DNA, 99 bp, Homo sapiens; identical to SEQ ID NO: 4394
  chr17:32907706-32907805
  hyper

SEQ ID NO: 80289 - DNA, 274 bp, Homo sapiens; identical to SEQ ID NO: 4395
  chr17:32907873-32908147
  hyper

SEQ ID NO: 80290 - DNA, 976 bp, Homo sapiens
  chr17:32908170-32909146
  hyper
cgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcgggcatacgggtggggggcagcgggtttttgaacagcccccaagaatgggaaatcagaccagagggaaggaggctgcagcgggccttccgcaagctggagacgctccaggaggcgaggggagcagaccgaggtgggagggagagagctccgaaaggagagtggagaagcggggccctctgctccctcctaacgtgaaaccagccgacctgggatacat

SEQ ID NO: 80291 - DNA, 205 bp, Homo sapiens
  chr17:32953266-32953471
  hyper
cccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtc

SEQ ID NO: 80292 - DNA, 30 bp, Homo sapiens
  chr17:32953682-32953712
  hyper
ccccagcccccgctgcgccacccacggccc

SEQ ID NO: 80293 - DNA, 64 bp, Homo sapiens
  chr17:32965239-32965303
  hyper
gagattgcatagaggcgccagccggagtagcagggacccccccccccaacggggtcagctcggg

SEQ ID NO: 80294 - DNA, 211 bp, Homo sapiens
  chr17:33102688-33102899
  hypo
ggatttgccttgctgcgtgggagcgggcagggatggggaggcttcatgcctcagaaccccttccccagcacctcctggcagggaccctgcttctccacatatctcctctgtcagtctcttccctaaaaacagaacctgaaaattggtctgggaggacctcagccacaacggccactgatagaaataattatagatgcggagtaagcacttc

SEQ ID NO: 80295 - DNA, 30 bp, Homo sapiens
  chr17:33124973-33125003
  hyper
cctccccagcctcctcgcctttccttgtgc

SEQ ID NO: 80296 - DNA, 30 bp, Homo sapiens
  chr17:33179323-33179353
  hypo
tgcgtcagacaacagcggctggccagttcc

SEQ ID NO: 80297 - DNA, 28 bp, Homo sapiens
  chr17:3338320-3338348
  hypo
gagccaccgtgcccggccacacactgtg

SEQ ID NO: 80298 - DNA, 100 bp, Homo sapiens
  chr17:33447192-33447292
  hypo
acaatgaaaaggaatcgcagaaatcacatcattacagattatacgacaggtgtcaagaagcagcaaagcatccagagggcacctgcgtctatttttcaaa

SEQ ID NO: 80299 - DNA, 27 bp, Homo sapiens
  chr17:33601404-33601431
  hypo
atggctgaataggaacggctccagtct

SEQ ID NO: 80300 - DNA, 220 bp, Homo sapiens
  chr17:33672862-33673082
  hyper
gagaaaaaaaaaagacgcggaactgtcttcagggccctcagaagtggtttaaattctccgcaaggaaaccgaggcgggtactgaggtcggtctcgccctttccagggcgcgcagtgaggtcaccccgggaacggctgtcaccgcgggaggagagcagcccagggaactaaagacgagtccagttaccagggaaatgtcctgaacacgtgtggtcatccct

SEQ ID NO: 80301 - DNA, 320 bp, Homo sapiens
  chr17:33673302-33673622
  hyper
ctgcactacagcctgggcgacagagctagttcctgtttcaaaaaagaaaaaattcctcaaatgttaattatgaaatatttcagaagtacgaaaaagtgtaccaccaccggcgctaccacttccaccttggcaagtgaagccccactacaatggaagcgtcgggcgtatcctcccgggcctctttccctccctccccggcccttccctcttccgatttccctcccgccctttcccctccctcccctcctgacctcgacttccttcccttctctgtctaaggggcagggcggaagatcgagcctcaacgctgccccacaccc

SEQ ID NO: 80302 - DNA, 34 bp, Homo sapiens
  chr17:33688778-33688812
  hypo
tttgagacagagtctcgctctgtcacccagactg

SEQ ID NO: 80303 - DNA, 904 bp, Homo sapiens
  chr17:33700472-33701376
  hyper
gtgctgctcccttctcgaacctggcactcgagttacagcccgacgcggattcggctgggctagaccctgaagcacgggtagaaacgcaactccggagtcccaggctgggggcaaggaccctctctgacctctcaagctccagcgcttccgaagcccccttagcgtttccctggaggcgcccaggtcgagtccttatatactagcgggttggcgccatcccacgcacatcccacgcaggagatgcaagagccaatgggcgggtctgctaagcccgcgaactctgccgcgttaaattgcctagaagctcccacccttctgactgttgccacgtagttcttagtttccgggaatttggggattttttcctcccccttcttcccacccttcctccgtctcctcgctccctccatccatctctccctccctatcatctatctattcatctatctggattacagcaaaacaaagaataaagattatgaagaaagagaagaacttcccaggcccaagcagctgtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtca

SEQ ID NO: 80304 - DNA, 30 bp, Homo sapiens
  chr17:33701582-33701612
  hyper
cccgggcggctctgtcggaggcccacttct

SEQ ID NO: 80305 - DNA, 120 bp, Homo sapiens
  chr17:33718792-33718912
  hypo
gtagacctgccttctcgggccctacacaccctataaatggcctctgcgccctcccaaccgctaccatatttcctgcccccccccatacctgccgccacccagaggcgctgcatccaagtg

SEQ ID NO: 80306 - DNA, 30 bp, Homo sapiens
  chr17:33772552-33772582
  hypo
ggcccgtataactctcgccctctcttggtc

SEQ ID NO: 80307 - DNA, 444 bp, Homo sapiens
  chr17:33775327-33775771
  hyper
tctgcctgtttgttccgcccccgcggaaaccgctgctcgctgggcaggggctttctgttttgcagccggaacaggaacacagatagcccgccaagccgccggcgacaccttccaacccctttagctctccgcaccgtccctccccaccgccccgcctccacccgcgccgcgatcaagtcctcatagccttttagggaatttgctcagcaaactagccgaaccccaaaggcaggggagaagcacgcaaataccccgactccaccggctggccggagctggggggcgggggttgctctcctagcttgctccccatccgagtcaacgccagtccagggtcgtgccggactagaccctagggcgtgggtacaaacgggagctccgcagtccccgtaggagcagggaccctctcttacctctcaagctccagcgcgtcaagctccagga

SEQ ID NO: 80308 - DNA, 17 bp, Homo sapiens
  chr17:33877286-33877303
  hypo
aggtgcagtggctcacg

SEQ ID NO: 80309 - DNA, 38 bp, Homo sapiens; identical to SEQ ID NO: 45062
  chr17:33917230-33917268
  hypo

SEQ ID NO: 80310 - DNA, 30 bp, Homo sapiens
  chr17:33933196-33933226
  hypo
agtagtggagactgccggagtttctacttt

SEQ ID NO: 80311 - DNA, 30 bp, Homo sapiens
  chr17:33991634-33991664
  hypo
ataaatttatatttacgaaacattcattca

SEQ ID NO: 80312 - DNA, 112 bp, Homo sapiens
  chr17:3438826-3438938
  hyper
cctcctcccagactccgcaccgggcgggggcggcacccaccgaagtagaagccttcgtgttggtacttggggttgaagaaggcccccttggcgtgcgcgttgacgtcggcgc

SEQ ID NO: 80313 - DNA, 1 bp, Homo sapiens
  chr17:3439029-3439030
  hyper
c

SEQ ID NO: 80314 - DNA, 30 bp, Homo sapiens
  chr17:34400013-34400043
  hyper
tgtggtcatcccttccgccgcccaccggct

SEQ ID NO: 80315 - DNA, 399 bp, Homo sapiens; identical to SEQ ID NO: 36457
  chr17:35014243-35014642
  hyper

SEQ ID NO: 80316 - DNA, 30 bp, Homo sapiens
  chr17:35042671-35042701
  hypo
gtgctggctccaccccggcttccagagagc

SEQ ID NO: 80317 - DNA, 41 bp, Homo sapiens
  chr17:35054437-35054478
  hyper
ttggttatgaaatgacgcttgccggtcgagaaagccagatg

SEQ ID NO: 80318 - DNA, 445 bp, Homo sapiens
  chr17:35060232-35060677
  hyper
agactgcagaaaccccgaaagaggggaggcacaaaccgttcagctcagctgggaagaaatcggctcaagcccatcagagtgacagatacccggggaggctgggcgtgccaagctggaccggtccggccaggctggaagcccagctgcccgctttttctcagtgcctggagaccgcccgccttttcagcaccacggtcagcggccttttcgcaggcgcgcgccccagccccgccccgggttgggctggcatccagcctcccggcccttctgcgtgtccctcggcccaccggcatcccgggctggaggtgtgggtggggcaggcgaccggggtatgagaggcggtggggtgcctcctccgcgcgtctctgcgagtatctgtctcccccatgcgtccgctgctcctcatagaggcgtcgggagagtgtgttcgcgactttctcgcaca

SEQ ID NO: 80319 - DNA, 189 bp, Homo sapiens; identical to SEQ ID NO: 45063
  chr17:35061647-35061836
  hypo

SEQ ID NO: 80320 - DNA, 424 bp, Homo sapiens
  chr17:35078532-35078956
  hyper
gggggaggtcagggacggaaataaacaggcggtttggtcttctctttcttccctggcagccttaattgctacttaagcgtgggccctgcacttaacatccggggggcaggcccggtgcgtggtgcacgccgggcgcgctgtgcacagtctccggaggccgccagtgcgaccccgccccacccgcgcacccccgcccggagggccccagcgcgcatgcgctcgccgcagggcggcctgcggggctgtggacgcgaggccagctcgtagggggctgggcggtcagcggggtcaagggacagccacgctgggacggaggacggggacaggggagcccctgcggcgccacttcttcctctccgagtcctgtctgcccttgatggagccactggtggggttacttgctggcggtcggccactttcgccc

SEQ ID NO: 80321 - DNA, 536 bp, Homo sapiens
  chr17:35165308-35165844
  hyper
gtgtccttgccttgccgtctcccgcattcgggccgctccccgcatttccaccccgctcccactgctgggtaaatgttcatctggacggggacaggatcgggaaccgccgggcagggggtctgcgcggcggcgtcctcccctccccgcccggctctcccgctccatccccgcggcctggccaagggcagcgccaagggcgcccgcggagggcgcagctgccccggacggagcccccgccacccccacagccgcgcgggtgctccagagcatccaacttcatttccacttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 80322 - DNA, 297 bp, Homo sapiens
  chr17:35165845-35166142
  hyper
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttgtcctgtgccttgtccatgccattacattcatcctcccaagaaccctgagaaatgaggagatcgtcagagaaggggaaactgaggctcagagaggcgacagtactcgccc

SEQ ID NO: 80323 - DNA, 181 bp, Homo sapiens
  chr17:35242096-35242277
  hyper
gagaaggcaagggggcgggagcgggaggggtggccccgctccacgctcagctgcttctgggtgcagatggagacagaatggaagggggaggggctcagctcttcctcccgggcccctcctcaccctcagctctcctccgacaagcagagggcctgccggaccccagcgatgggctagcctg

SEQ ID NO: 80324 - DNA, 30 bp, Homo sapiens
  chr17:35248683-35248713
  hypo
gcccctgggtggatacgcccatgcacaggt

SEQ ID NO: 80325 - DNA, 358 bp, Homo sapiens; identical to SEQ ID NO: 12667
  chr17:35285437-35285795
  hyper

SEQ ID NO: 80326 - DNA, 432 bp, Homo sapiens
  chr17:35289269-35289701
  hyper
gatatcggcagtgaccgccgccattaggtaaggggagagagtcaattagtgagaggattaattactgtgaggcacgagccccgtttgtcttccttactgggtgttcagacagaggaacacgggcacgcacccaaatacacattgttgtcacgccgtcttagacgttttatttatttgttggattcctgcccagagccgcttttccacgggcgcagagtctcccaccaaacacgctgcctctttctctcagcacgcactcgcctgtcccaaagccgcacacccccagacccgcgggacgccccctccgtgcctgcagggccctcggctccgcgcccgtccccgcggccttcttcgtggcagggtctctctctgggtctaatttctgtttcttttcctccacttctccccgcatttccccgacagatctttcct

SEQ ID NO: 80327 - DNA, 48 bp, Homo sapiens
  chr17:35290025-35290073
  hyper
aggccaggcacataccgtgacgccccggcctgccggatgctgcccttt

SEQ ID NO: 80328 - DNA, 775 bp, Homo sapiens
  chr17:35290334-35291109
  hyper
gtgaagtactgcacacgagtagatcatttccatgagagagtgatgggtgagattaaggcaatttgagtccggagagaactagacgggaaggagaggcgggagaccttggcgctcagatccgagcgaccttatccacgcagttccctgcgtggcattactgcggcctcaccgagtctgggcggagtttgcgtggcctctgggaccggcagagtccaggggtgctccgggctggctatttcctccctcctccgggatgggtgtagcagggtgtgtactccgcatggggtaacctcctagagccggctacgccccaggcgcctcctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagggtccctctggggctgatcgtcaaggagcttctcaagaaaagaaacctggactgtgaaagtcacctcctaggccctctggggccgtatccgggggtgcctgggaggagggtggaaaggattctgcagtcaccgagctatgggcgaaaatgatccccgcggaccctggtccag

SEQ ID NO: 80329 - DNA, 579 bp, Homo sapiens
  chr17:35291320-35291899
  hyper
ctctccatgtccctgcgaccgattatgttttaaaacaaaagctcaatggaaacgaaaacaaaacaaaacccaccatttgtctaatgtgctgtccccgtggaggagttaaatctggactccaaacctagaatctggagccaagaggcgcactttgagttgcgctcctggccccccttgcagagacgccagggttggctcctgcggacctgtttactgagccatctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaagggg

SEQ ID NO: 80330 - DNA, 741 bp, Homo sapiens
  chr17:35291920-35292661
  hyper
cggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttccccgagcat

SEQ ID NO: 80331 - DNA, 35 bp, Homo sapiens; identical to SEQ ID NO: 36469
  chr17:35292896-35292931
  hyper

SEQ ID NO: 80332 - DNA, 812 bp, Homo sapiens
  chr17:35293669-35294481
  hyper
gacaatggcaacagccgctgaattgcaaagcccagcagtgcaggggagccgcctgggattccggacccggctgcaccccaaccttccacaaggctcggtcttggactacccccactctacagcagaactctggcctccgcctgcgcctattcccgctctctctctgtccctcccatcgaaacccacgccttaccggagcaggagggggcccaggcacggtgctgcccgccgtccgcgccgcgcggggccgcgggtgccgccgccactgatcctctaaacgcggtctccccgcactctcccgggccgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgc

SEQ ID NO: 80333 - DNA, 9 bp, Homo sapiens
  chr17:35294482-35294491
  hyper
gggctgtgc

SEQ ID NO: 80334 - DNA, 2654 bp, Homo sapiens
  chr17:35294492-35297146
  hyper
cccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgagtactttcctcccacgcctctgctgctacctccccgcgggcccttcccggccagcttcggatcagaggttagcgtggcctcgctgcccagttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 80335 - DNA, 1064 bp, Homo sapiens
  chr17:35297147-35298211
  hyper
cgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcgggtgaggccccaattcctggctggctaggtgcaagcgggtcctgggggaggaaggctcgccaaggccccggctcatctgtcctttccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 80336 - DNA, 292 bp, Homo sapiens
  chr17:35299152-35299444
  hyper
attattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccc

SEQ ID NO: 80337 - DNA, 366 bp, Homo sapiens; identical to SEQ ID NO: 36477
  chr17:35299600-35299966
  hyper

SEQ ID NO: 80338 - DNA, 453 bp, Homo sapiens; identical to SEQ ID NO: 1287
  chr17:35300260-35300713
  hyper

SEQ ID NO: 80339 - DNA, 333 bp, Homo sapiens
  chr17:35300812-35301145
  hyper
cgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggta

SEQ ID NO: 80340 - DNA, 592 bp, Homo sapiens
  chr17:35303075-35303667
  hyper
atgcaatcactggatcggcttgtttttacctttttagcatttatacacattaaatcctagctaacttattcattatagcctctactccctagccccctttaaagacattcatttaaatgaactgcgctcactgggaagctgcattttcctatcaaggctgctgaattatttagcagctttattgtggaatcggggtatttgataagaagcgttttcgagttgggcacacgatgtggattcgattcttctaacaacgtggttgtggcgcagtctctcccctcgtcgcgggattcagaatcctggcgaaaacccgaacaggtggcaacgctcagcagtcaaatttggagccgaaggccccaaggaggaggcctggaaatgtcagggcctgttctccttcccatcagtgctgtgccgcccacctctggccccgaggtgcggggacgtgcggcaccatacctaggcggagctcccgcaggaggcgcagcaggagggaagcgccactgcagtcccctctcgcctgggagggcagcctggtttctccctgtggccatcttaaagccaccacctctgtgcctctcgccacctgccttca

SEQ ID NO: 80341 - DNA, 42 bp, Homo sapiens
  chr17:3541067-3541109
  hypo
agccaattttagtcccacttgacaatgcgtgctttacatctc

SEQ ID NO: 80342 - DNA, 81 bp, Homo sapiens
  chr17:3585002-3585083
  hypo
tcctcccactgctgccgaggccgaatccggttctgtagagcatgtactcagaacacttctcctccccgggccctccagccc

SEQ ID NO: 80343 - DNA, 30 bp, Homo sapiens
  chr17:35870444-35870474
  hypo
gtcctcatagcccaccgaggaggcagcagt

SEQ ID NO: 80344 - DNA, 105 bp, Homo sapiens
  chr17:3599635-3599740
  hyper
gcagccccccggatgcgcaggaccgccctgtgctgttgcccagctgaaagcagcgatcgcggaggagaggaagtgaaagggggaagggctcctttttattttatt

SEQ ID NO: 80345 - DNA, 49 bp, Homo sapiens
  chr17:36102031-36102080
  hyper
cacggagaaaggcaccggtcccgaagagggcctgcggccattgtgtccc

SEQ ID NO: 80346 - DNA, 1007 bp, Homo sapiens
  chr17:36102282-36103289
  hyper
gagaaaggccagctccggccgggagccggggaccgggaagcgcgcagtcccgaccttcctcccctgcctttctcttccaggaggtttactagaactccaggaactccaaaacgcgacttttctttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctcc

SEQ ID NO: 80347 - DNA, 745 bp, Homo sapiens
  chr17:36103290-36104035
  hyper
cgactcacaccttccgcctcgcggaactctcttgcaggagttctctcccggtaggggagaaatcacctccgggcgggagagcgacgagggaagaacctcaaacctatgaattataccaaagtgtgtttggggaaaaaaaatctacaagttcccctgattgttttggctagagggcaaaccgccaggccctcggagcacaaattcaaatgcaaggtcatatcccaccccaaaccgccgctgcggacgtgcggccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 80348 - DNA, 334 bp, Homo sapiens; identical to SEQ ID NO: 4411
  chr17:36104217-36104551
  hyper

SEQ ID NO: 80349 - DNA, 707 bp, Homo sapiens; identical to SEQ ID NO: 36486
  chr17:36104643-36105350
  hyper

SEQ ID NO: 80350 - DNA, 270 bp, Homo sapiens; identical to SEQ ID NO: 36487
  chr17:36105458-36105728
  hyper

SEQ ID NO: 80351 - DNA, 30 bp, Homo sapiens
  chr17:36149200-36149230
  hypo
agtgtaaatgtgtgccgatagtgttgctat

SEQ ID NO: 80352 - DNA, 94 bp, Homo sapiens
  chr17:36204447-36204541
  hyper
gcagtagccagtccccgagggcccatcttccagccctgaagcggtaaacgcctcacctctagtggcgagtgcgaggaaccgcaccctagcccgc

SEQ ID NO: 80353 - DNA, 144 bp, Homo sapiens
  chr17:3658786-3658930
  hypo
taagctgacccaggccgagtcctgttgcctggtctgtattcaggggaacaactggatgtttgagcacacagaaaaaagcgacctcctgtcatcaatatggccacccttttgttgcagtgagccgagactgcaccgctgcactcc

SEQ ID NO: 80354 - DNA, 143 bp, Homo sapiens
  chr17:3658990-3659133
  hypo
taaaatcgctcttttacaggaatcaccacaggtagggcagagccctggatgggaggcaggagtccctgaatcctaggtgtcctgggcccctcaccaatgggcaagcctgcctggtgctgagtcagccacgtacctcatccagg

SEQ ID NO: 80355 - DNA, 161 bp, Homo sapiens
  chr17:36714931-36715092
  hyper
ctgcatggctgtggccgcgagcaggggtggtattgcagggggaggagggcaaggttaagttctggggaatatgaggcaggagaaggggttgggaatatttgcgggacagggtgtagccctatgtaggtccctgccgacagtgcggccgcatggctatggct

SEQ ID NO: 80356 - DNA, 177 bp, Homo sapiens
  chr17:36729010-36729187
  hyper
tcccccggccgcctccgcagccgcggccgccgccgccggtgccctttgctgcaatgcgagagccgccgcggccgccgccgtgccggcccgggccccagtcgccccggtaaccgcgactccacctggcgcggcgctgcgcgccgccgtgcacatcccctctcgcggccccctccctcg

SEQ ID NO: 80357 - DNA, 74 bp, Homo sapiens
  chr17:36829977-36830051
  hyper
gtaacaccaaagtttcgaccggcggatcagacgatcgaaatgttcctggcggagatctccgggtgcggccggag

SEQ ID NO: 80358 - DNA, 90 bp, Homo sapiens
  chr17:3686092-3686182
  hypo
gtttagtgactttttcgtctctaaatacactgagtaaacacgatataaggaatgacatttgacatcgcactctcacgggaagacacactc

SEQ ID NO: 80359 - DNA, 30 bp, Homo sapiens
  chr17:36868552-36868582
  hyper
agtccagccatgtgccgcctagtaagtgct

SEQ ID NO: 80360 - DNA, 30 bp, Homo sapiens
  chr17:36874946-36874976
  hypo
gtgtcttgggatcagcgcttacggaggtct

SEQ ID NO: 80361 - DNA, 458 bp, Homo sapiens
  chr17:36875921-36876379
  hypo
aacccctgggggatacgggagaagggccagaggagcctggagtggtcgggtcgactgaacccaggttccctctggccgcaggtcccccatcagcagcctccccgcactcttcgaccagacagcctctgcaccctgtgggggcggccagttagacccggcggccccagggacgactaacatggagcagcttctggagaagcagggcgacggggaggccggcgtcaacagtgaggaggggtggcgccggtcgggacgcctgccctagggccctaacagtcacctttctccccgaggtccccaagcttctttaaggttccgcccttaggccccgccccagccttgactctcggccaccccgggcctcacctcccatccctgccaggccacacgaccggccctggtccctcagcgccccacctttggccttcgtggcctccgggccccgaccttaccaaacc

SEQ ID NO: 80362 - DNA, 40 bp, Homo sapiens; identical to SEQ ID NO: 36491
  chr17:36905467-36905507
  hyper

SEQ ID NO: 80363 - DNA, 30 bp, Homo sapiens
  chr17:36996160-36996190
  hypo
cacacacacaaatcccgaagatttgctcac

SEQ ID NO: 80364 - DNA, 30 bp, Homo sapiens
  chr17:37006691-37006721
  hypo
tatgactttcgttgtcgaatgaccactgct

SEQ ID NO: 80365 - DNA, 32 bp, Homo sapiens
  chr17:37010814-37010846
  hypo
cctttcacagcttcagccgccccttattctct

SEQ ID NO: 80366 - DNA, 84 bp, Homo sapiens
  chr17:37011083-37011167
  hypo
aaatataaatagtatcgcttctcggccttttggccaagatcaagtgtaaaatataaatagtggccgggccttgtggctcacgct

SEQ ID NO: 80367 - DNA, 30 bp, Homo sapiens
  chr17:37161944-37161974
  hypo
gattttctcatcacacgttgatgctactgc

SEQ ID NO: 80368 - DNA, 144 bp, Homo sapiens
  chr17:37183463-37183607
  hyper
aggtgtcataaaggacggggcggggcgcgcggttgtcaggggcgcaagcgtctcggggctgccagaatggctccggctcagggcgcggcgccagcgcctgtcatgtcccagctgcgcctctgggtcccacggcacctcctcagg

SEQ ID NO: 80369 - DNA, 40 bp, Homo sapiens
  chr17:37192161-37192201
  hypo
gattatagacgttagccgccacccccgggcagtaactggc

SEQ ID NO: 80370 - DNA, 30 bp, Homo sapiens
  chr17:37211142-37211172
  hypo
ttgtctgagataatgcgccccagagttctt

SEQ ID NO: 80371 - DNA, 6 bp, Homo sapiens
  chr17:37307508-37307514
  hyper
ccccct

SEQ ID NO: 80372 - DNA, 222 bp, Homo sapiens
  chr17:37307531-37307753
  hyper
cgtccacacctgcccatgcccacacctgactgcccgtccctccccgcccccggcccacccgggccggctcccgccagtcctacctgctccgggctgggggctcagcgcccgggcagcctccctgagcaccagcaccaggagccagagctcgcctcgcatggtgggtgcccggacctgcccccggcctgcttgctgccccggtcctgacgagggagggggccc

SEQ ID NO: 80373 - DNA, 35 bp, Homo sapiens
  chr17:37307992-37308027
  hyper
tgccctcagccctaacggagcgctcccctagagct

SEQ ID NO: 80374 - DNA, 473 bp, Homo sapiens
  chr17:37321152-37321625
  hyper
atttgaatgccagaccgaggagccgcagtactaggaaggtccaagcagcgtgcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcc

SEQ ID NO: 80375 - DNA, 121 bp, Homo sapiens
  chr17:37321787-37321908
  hyper
cgccgggacccaagaggagcaggcagggacgggggcaggggaggccgcggggcagtcgaggagcgcccatatacgaccctcggagcccgaggtccccccgtgcgtccgaccacagatcaga

SEQ ID NO: 80376 - DNA, 55 bp, Homo sapiens
  chr17:37331238-37331293
  hyper
caggcaggtaaaaaccgacagctggggcttaagggcctcccgggagctgggatgg

SEQ ID NO: 80377 - DNA, 625 bp, Homo sapiens
  chr17:37366040-37366665
  hyper
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggcttgggggactgcggggacgaggctgacctcggatgggtactgagccctcccagacccccggcacgcccggtctcggagggcacctctgggtgggcaagatcggcctcgacggccctggcgcgcaggagcatgtccgcccctgcgcgactcaggtgcacatggaggcggaaagtgaccgcagccccaagccgtttccctccagcgtccccagacctcctcccactttcctcaggtccccttttggctctccccagaccccaccctcctcgggctgctggaggaaagggatgaggcctgggacccctgccatgttgccgcctgcccagcacc

SEQ ID NO: 80378 - DNA, 216 bp, Homo sapiens
  chr17:37369107-37369323
  hypo
cctttctttctaacccgctttcccctcaactgccaagatcagcctcctcctgcagagcatttacccccgcaccgcagcctgtctcccccgcccactccctccctccgccatagggcctgggctgggcctcaggcactcacctggttctccttgaggctcatgtaaccctgttccttgttcccggagaagggttggcagcagcgccaaacattctcg

SEQ ID NO: 80379 - DNA, 631 bp, Homo sapiens
  chr17:37380799-37381430
  hyper
caggagtctgggctccgcctgccttcgcggggagtaatttattcatggtgactccctcaggagtaacaatcatccataattagggttaatgatgacattcattaattacgatgacttctctttttgcttctacccgctccccctcctctggtcccgctcccgtggtggggcgcggggctgcctgtctttctggtctggagccacaaccgcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggc

SEQ ID NO: 80380 - DNA, 157 bp, Homo sapiens; identical to SEQ ID NO: 1291
  chr17:37381570-37381727
  hyper

SEQ ID NO: 80381 - DNA, 593 bp, Homo sapiens
  chr17:37381825-37382418
  hyper
cgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctacgccgctcccccgcgcagccctgcaaatcaggctctcagctattggctgcctcggtggccaggagggcgaactgggcggagtcttggggggctcgacacgatggggcggggcttggcggggaaagaagcggaggagggagtttcacactgaaaaacccgggatggaggggcgtgaccagattgag

SEQ ID NO: 80382 - DNA, 92 bp, Homo sapiens
  chr17:37388387-37388479
  hyper
ctcccttggggttaacgcctggggagagatcctgtggcgggggagtctagacccagctgaagcagcctggggacctgcggctggcctgggcc

SEQ ID NO: 80383 - DNA, 204 bp, Homo sapiens
  chr17:3741592-3741796
  hypo
ctcaaggaatgctctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaagcaagggcgtgtttctgacttg

SEQ ID NO: 80384 - DNA, 30 bp, Homo sapiens
  chr17:3755004-3755034
  hypo
tcctgagaccacacacgctctgctgtgatc

SEQ ID NO: 80385 - DNA, 38 bp, Homo sapiens
  chr17:37606487-37606525
  hypo
tcactgctcccggcctcacctttcgacctctgctccaa

SEQ ID NO: 80386 - DNA, 62 bp, Homo sapiens
  chr17:3769760-3769822
  hypo
gaggggaacagctgccgcagcctggctctctgcctttgtccctcctccgtgacaaggacggt

SEQ ID NO: 80387 - DNA, 30 bp, Homo sapiens
  chr17:37725131-37725161
  hypo
tgctgctgttggaggcgttcctgccaaatc

SEQ ID NO: 80388 - DNA, 131 bp, Homo sapiens; identical to SEQ ID NO: 36499
  chr17:37752808-37752939
  hyper

SEQ ID NO: 80389 - DNA, 361 bp, Homo sapiens; identical to SEQ ID NO: 36500
  chr17:37753021-37753382
  hyper

SEQ ID NO: 80390 - DNA, 365 bp, Homo sapiens
  chr17:37755352-37755717
  hyper
ttaaccctccccctgcgccgcgccccagcctcggcctgggagcccggccgagcgcgagttcgctgcaagcgggatccgctctgagcccggccggccggcagcctccgcggtattcccggcgcgggcccctccaggggctcccctgcggctcctgggggcaggggtaccctgctgccctccaagactgaggctggatgtggcatctgattgggaagtgggagagatgaagggaagagagaaagccccagtgccctcactcccattctcgggctgttcccaagggagaaggaaaaaactatgtgagtccgttgtgccctcctgcctccgcctgcggtcaagaaagggggcaccggctcaggcttgag

SEQ ID NO: 80391 - DNA, 214 bp, Homo sapiens
  chr17:37756190-37756404
  hyper
agcgtctccacccaacgctgtgccccagctccctgggcatggccggcgcctagaggttccctcttctcctcccctcggagcgccccagcttcccttccctgccctagggaactaaggtgactccgctcctcgcatctccctcctgaaatccgttgccctccttcctgtgaacccagccccggtcttggccttcttctcacgtccacactcccag

SEQ ID NO: 80392 - DNA, 184 bp, Homo sapiens
  chr17:37757101-37757285
  hyper
aagcaggcacagccccgtggagcttccagagtatcagggttttcctgccactgatcctcctgggggtcggtgtcccgcagtgatttatcgggctgtctccccgagtcacaaaatcagggctgggggttcactgggggtccatagctcactgtccgagtcatggctggaacgcagctcaacaatg

SEQ ID NO: 80393 - DNA, 679 bp, Homo sapiens
  chr17:37760128-37760807
  hyper
aggaaggtaaaattgcgtgtgtgtgggtgagtgtgtgggtgtgtcgcctgtgggattgcatttttgcatcgtgtatttggatgcctgatcccctgcctccggtgggcagagggtctccttttgcccctttttgggggaacctccagtaggagccctcagacctctccccgcccacccaccagctaaagccaagaggactccttggaccaaaaaatactctctccagacaccggaaatcgccaggtggcacccaccgaggcacagtccgggcaggggtggggctgcccccaggtctccatccccacccctcaccccaggaggggacagaatggccgcggggaggaggagccggcgagctcacctccttctgccccccggacgccggcgccgggcctgcttgtgcgtgcggtgtggtgtgcgtgtgtctttcatgcaaaccctccctccccaaaccgaccccccaacagtttgccattccatacaaatttggaaacaggtttttaaaaaacagcatgacgcacaacggggacggggcgggggagggcagtggcactggggccccaaatctccgagtcactgattgtaagaacctggggagggggagggggcggcgcgggcccccacttcaccaaagtgcacagatccgcgctcgggcggggcggcccgcaggccgggcggg

SEQ ID NO: 80394 - DNA, 1660 bp, Homo sapiens
  chr17:37761179-37762839
  hyper
ggttgggggtgagggcgttccaggcccgggctccggcgccctaacttctaccctcttcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgcgccgccaccgcctgccgccgcatacagcgtctcgtaggcggcgcagtagccgtgggtccgcagggcgtgcgccgcgccgccgcccaggccgccggccgcctggcactgtgcgcccgccaggcgcgagcacgggtacgggtaggggtgcatggcgaacgggccgcccgagccgtggaagcggccggcaccgtcggcgccttgctccgtgaggaagttgcgagagttgagctgcagacagccggccaccagattggtggtgggctgcgacagacccttgcacagagtctgcacgtaggacactaggtctggccgcttgccggagcgcaggatctccgagagcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttcgccgtcgccccagctggcgaacttgggcacgtccgagagaaggccgggctcgctgaaca

SEQ ID NO: 80395 - DNA, 30 bp, Homo sapiens
  chr17:37763142-37763172
  hyper
ggtcagggcagggaccgggtgggggtttta

SEQ ID NO: 80396 - DNA, 49 bp, Homo sapiens
  chr17:37763437-37763486
  hyper
ctcctctagccgatgcgtccccagctcccggagccggctctgggcggcg

SEQ ID NO: 80397 - DNA, 210 bp, Homo sapiens
  chr17:37763928-37764138
  hyper
gcccctcctcccaaccggcgggtcagatctcgctccctttcggacaacttacctcggagaggagtcaaggggagaggggaggggagggggggagggggcaagagagagaggggggagaagagggatcttctcgcttatttcattgttcccccatcttcagggagcgggggcagcggctcctcaaggcggcgggcgccggcgtcttcagag

SEQ ID NO: 80398 - DNA, 44 bp, Homo sapiens
  chr17:37764263-37764307
  hyper
cgtctgcactgggggagagccggctcccccgggacccgccgcca

SEQ ID NO: 80399 - DNA, 30 bp, Homo sapiens
  chr17:37768957-37768987
  hypo
gggcacgccagatggcgtggctgagaatgc

SEQ ID NO: 80400 - DNA, 590 bp, Homo sapiens
  chr17:37783185-37783775
  hyper
accggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacacccaggccggggagcgcgagggagcgaggcacagacctggctcagcgagcgcggggggcgagccccgagtcccgagagcctgggggcgcgcccagcccgggcgccgaccctcctcccgctcccgcgccctcccctcggcgggcacggtatttttatccgtgcgcgaacagccctcctcctcctctcgccgcacagcccgccgcctgcgcgggggagcccagcacagaccgccgccgggaccccgagtcgcgcaccccagccccaccgcccaccccgcgcgccatggaccccaaggaccgcaagaagatccagttctcggtgcccgcgccccctagccagctcgacccccgccaggtggagatggtaaggggcccgtgccccaccccggcagcgtacccgacacaccccgcgg

SEQ ID NO: 80401 - DNA, 177 bp, Homo sapiens
  chr17:37794035-37794212
  hyper
tctcctggttttcttcgtaccgctctgacagtcggtcaaagtcccgcttcacgttttcctctgtcgcccaacccctcgctctgtacactgaatctcagtggtcttattttcccccacggcttcagctttacaccaactaaatacccagatccacatcttcagcgcagcccttccctg

SEQ ID NO: 80402 - DNA, 147 bp, Homo sapiens
  chr17:37823798-37823945
  hyper
gccctcacccgggtccggcgccgcccccgaagtggcgggaacaacccgaacccgaaccttctgtcctcgggagcccccagataagcggctgggaacccgcggggcccgcaggggaggcccggctgttccgcccgctaagtgcattag

SEQ ID NO: 80403 - DNA, 314 bp, Homo sapiens
  chr17:37856412-37856726
  hyper
cccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccc

SEQ ID NO: 80404 - DNA, 219 bp, Homo sapiens
  chr17:37857048-37857267
  hyper
tgctcctgcttctggcggggtcgggtgtgtgtgtgtgtggtggagtggagggtggcatagcaacctgtcccaaccagagccggggaggaaagggtggcccggagggtggcctcttgctggggtctgggttgggggcgggggagacgtttgctttgaacagattcttggggccagcttagggactgtgctctgtgacttttggagcgcgtggaccatgga

SEQ ID NO: 80405 - DNA, 121 bp, Homo sapiens
  chr17:37879785-37879906
  hypo
cccagctggtggagccgctgacacctagcggagcgatgcccaaccaggcgcagatgcggatcctgaaagagacggagctgaggaaggtgaaggtgcttggatctggcgcttttggcacagt

SEQ ID NO: 80406 - DNA, 19 bp, Homo sapiens
  chr17:37887184-37887203
  hypo
tttttttttttgagacgga

SEQ ID NO: 80407 - DNA, 17 bp, Homo sapiens
  chr17:37887620-37887637
  hypo
cccggtgctgatggcat

SEQ ID NO: 80408 - DNA, 73 bp, Homo sapiens
  chr17:3792191-3792264
  hypo
ggaccagggtggtggcgtgtgtgtgtgtgtgtgtgtgttgtgggtccccacacaggagcgcactgcatggaga

SEQ ID NO: 80409 - DNA, 30 bp, Homo sapiens
  chr17:38179243-38179273
  hypo
gaggcaactctgaggcgaggcattccgggg

SEQ ID NO: 80410 - DNA, 44 bp, Homo sapiens
  chr17:38179589-38179633
  hypo
ctgtctgctgcagcacgtcggcacacatgcgctccaggatcgag

SEQ ID NO: 80411 - DNA, 26 bp, Homo sapiens
  chr17:38237916-38237942
  hypo
cctttaaaataaaggcgaggctgggt

SEQ ID NO: 80412 - DNA, 349 bp, Homo sapiens
  chr17:38264389-38264738
  hyper
agaagcaggataaagcgcaaggagacaagaagggagccccgcgcgctttccctccttcctcatcttgcctcctgtttctctggcccacggaggaaggggcccagtgtgtttgtgccggctcgaggctcacgcgggctgccggggtcacatggcccgggcatgtgcagcctgctccatttctaccacaacaactcgctcataaacagcccggctgctgcggcggtggcggtggagacatgtgcaagcgagggggtggggcacgtggccctgcccgagccaagggaaggcgctcgctcagcactgcctccacccctccccagcactggcgctgcctcgtcacaggaaattc

SEQ ID NO: 80413 - DNA, 152 bp, Homo sapiens
  chr17:38347464-38347616
  hyper
cgccctcctgcctttcgctcctcatcgccttgcactgccatcttcccacccactcccctcaccccctggcgccctggccgcccctccgctgccgtgggtgcagctggagttcgtggactacgtgttccacggggagcgcggccgccgggaga

SEQ ID NO: 80414 - DNA, 265 bp, Homo sapiens
  chr17:38347753-38348018
  hyper
cggccgtcggcgggatggggggccggaggccggaggcccgcgccgccgcccgcccctgaccccgcctcccacccccgcagctgcaagcagaaccaggacctgctgtctttctacgccgtggtcatggggctggacaacgccgctgtcagccgccttcgactcacctgggaggtgatgagacccctcccgttcctacctgggaatctgggcatcccgggctccccgaagtgcgtcctcccgggacggccgccggcctggagggagt

SEQ ID NO: 80415 - DNA, 30 bp, Homo sapiens
  chr17:38357434-38357464
  hypo
ggggaaagtattgaccgtgaaggggcatga

SEQ ID NO: 80416 - DNA, 212 bp, Homo sapiens
  chr17:38445259-38445471
  hypo
ggtaacttgttattgcatcgctcaattggttaagaacttgggctctggcaccagatgcccggggttacattcctgtttttctgtgactttgggccactgtttatctcagttttctcatgtgtaaaataaaggctaataatagtacctactcctaagatcgttgttaaacgagttggtacctaaagtgtttataacagcgcccttccacgtag

SEQ ID NO: 80417 - DNA, 264 bp, Homo sapiens
  chr17:38478595-38478859
  hyper
gaggccagtagatgccggagatgaacctggaggctcaggacagggcaagagtggggcacgccggggctgggtcctctggctgttccctctccccacagagttacttgaggtcaggcagtctccatgtgtcactgtaccccgcaggcagtgtcaccgtgacccactcgctgtgtgtctgtgtgtacacacctaccttggagtggctttatcccggccctccccccggagcctctgtcccctgggtcctaccgcaggtcctcagcc

SEQ ID NO: 80418 - DNA, 133 bp, Homo sapiens
  chr17:38497512-38497645
  hyper
aggagacaccttgggcggggctttgctcgccggaagcacgcagagcgtggggaggagggccccctctgcctgtgtttgtgccaacagcacccgcgctgccgcgtcgggttccggcggccggagtcacacatga

SEQ ID NO: 80419 - DNA, 48 bp, Homo sapiens
  chr17:38498548-38498596
  hyper
ggaggaggaagtgctcgttgacccccagccccgcgctgatcccgcccc

SEQ ID NO: 80420 - DNA, 30 bp, Homo sapiens
  chr17:38604410-38604440
  hyper
gctgaaacttctggtcgggatggctgggcc

SEQ ID NO: 80421 - DNA, 227 bp, Homo sapiens
  chr17:3866983-3867210
  hyper
ctgctagctgataagcggcaccttcctgggcgttttctggagccctcaggggagaccctggggccagctgggaggccgagcctgagtctccggccgtccctcgcccgccggtgtctgcgctgcacctgcaggatgccagcgggagcggcgcggcgttggggtggaatacggtccaggatggggtggaataacgcttccagggtggacggggccggagtggaggtggg

SEQ ID NO: 80422 - DNA, 30 bp, Homo sapiens
  chr17:3907085-3907115
  hypo
tgtgtcagactctgtcgggctggaacaaat

SEQ ID NO: 80423 - DNA, 180 bp, Homo sapiens
  chr17:39682549-39682729
  hypo
agaataggctacaaaatatcagaggggatttctcttagtatggtgagaattgtgtcacccatttgtgtgtgtgcatgtgcacgcacacacacacacagaggtgagaaaaagaatgcgtaagggtgcgtagtaaaatgtacttattgtcgcaatttttttttttttttgatacagggtctc

SEQ ID NO: 80424 - DNA, 30 bp, Homo sapiens; identical to SEQ ID NO: 36515
  chr17:39683809-39683839
  hyper

SEQ ID NO: 80425 - DNA, 30 bp, Homo sapiens
  chr17:39705165-39705195
  hyper
tcctttgtccctaggcggggtgcagcttcc

SEQ ID NO: 80426 - DNA, 180 bp, Homo sapiens
  chr17:39768846-39769026
  hypo
agatgcggctggagccgcccccgatgccgcctccgatgccgcaggagcccttcatggagctggaggaggtgaactggcggctgcaggtggtcatggtgccaaggagggaggtgagcgagtgagcagttggctgaaagaaggaaaggtgctcaggaaggctgagagcgtgctgtggctgcc

SEQ ID NO: 80427 - DNA, 30 bp, Homo sapiens
  chr17:39788206-39788236
  hypo
gggcccatctgcatccggcagagacccacc

SEQ ID NO: 80428 - DNA, 36 bp, Homo sapiens; identical to SEQ ID NO: 45073
  chr17:39803800-39803836
  hypo

SEQ ID NO: 80429 - DNA, 20 bp, Homo sapiens
  chr17:39834139-39834159
  hypo
acccctctgataaaacgaga

SEQ ID NO: 80430 - DNA, 30 bp, Homo sapiens; identical to SEQ ID NO: 45074
  chr17:39855665-39855695
  hypo

SEQ ID NO: 80431 - DNA, 144 bp, Homo sapiens
  chr17:401156-401300
  hypo
cacccctcctggttgcgtgggtggggtggtcctgaagccccgtggcttcctttatttctgccttctctgtagaattcaaacatgaaccctgcagggctagaccaagacacaaatatcaatttctaaaaacacccctttgagggt

SEQ ID NO: 80432 - DNA, 384 bp, Homo sapiens
  chr17:40332806-40333190
  hyper
catgtccaggagatccgagacggccccgaggatacttgccccccagctcgaacctcaagccccgacctccgtcccactcacgcgttccgtcaaaacgggtggcgatggtgtccaggaaggtgttttgcggggccagcaaccccttcatgaccggcatggccccggggcgtgggttcaaggcgcggcgctggggagctttcagcgcggccgggccggagggggcgcgctgtcggaggggccggggcgccccatgcgccctcctgcctcctcccctccctcttactgccgctgccgctgccgctgcctctgctccgaaccccgtagctctcggctcggctcagcgccgtttcggtcccccccacctccccacgggccaggttcttc

SEQ ID NO: 80433 - DNA, 205 bp, Homo sapiens
  chr17:40400826-40401031
  hyper
ccaaacagaaagcagcgaattcttgccaacttcccctcctgcttctgcagctagtacgcaatagcatttagtttccagtaaagctccagataaaaacaaagcaaatgtgagacccagaatctacacaatgtcagtgtctcgcttgactgaacgaagggcagtaagatcatatggagctacgctttttcaacgtggtggaagtgtt

SEQ ID NO: 80434 - DNA, 30 bp, Homo sapiens
  chr17:40427458-40427488
  hyper
acaagtgtttgcaaccgcctcttgctccgt

SEQ ID NO: 80435 - DNA, 334 bp, Homo sapiens
  chr17:40464190-40464524
  hyper
aaaaagcaggggactcgaggtttggggaaatgatggagatgggcgcgggtgggcagaactctgacccaggcttctccttagcagctgctgctcccagcagcctcgaagctggcggctgagggcccggcgccaagatgcttctcaaccctcggggccaggggcagtcccagagccgcaacaaccgtcccatcctcctccttcccagagaccagcaggtggcaccacgcggctgcgctgttttcagctggctgccggcgactgtgcgaggcggaggtgcagcaagcgggaccggctcgccccggctggacccccgcactgccggctgcagccagtc

SEQ ID NO: 80436 - DNA, 39 bp, Homo sapiens
  chr17:40477850-40477889
  hypo
attacaggcgtgagccaccgcgcccggccaatcaatttc

SEQ ID NO: 80437 - DNA, 24 bp, Homo sapiens
  chr17:40536417-40536441
  hypo
gattacaggcgtgagccaccgcgc

SEQ ID NO: 80438 - DNA, 84 bp, Homo sapiens
  chr17:40573790-40573874
  hyper
gctgcgcctggcccccgcccccgcaggcatgcggggtgattcacctcgcccagactgcgcccagaccgccggaccccgcagggg

SEQ ID NO: 80439 - DNA, 350 bp, Homo sapiens
  chr17:40574086-40574436
  hyper
tggggaggaggttggcggtcgcgttccccgcttggcacagcccccgctggtgcgtgcctgagccctgaatcacccgctatatcaggcccgcaggcgcagaggccccaggcccgggccccgcagccagtgtccgcttacagcggaccccaacgatcgcgagggacccctgactttcctagaaacttcccccaagtaggaagaagtttgacagagccaattagggagggagcggtctgcgaggggcagcgtcctcgagtccacccgctaattcggttctgctacaagtttgggacccgagggaaggatctgagtggggaggtgcgaggtgcagagcgcgcccctctacgcgc

SEQ ID NO: 80440 - DNA, 84 bp, Homo sapiens
  chr17:40669654-40669738
  hyper
cctcctggcaaaatgcggctgtgcgtccaggatgcctggatcttccctgtggcccaggactgcaggaggcgttctgagctgtgg

SEQ ID NO: 80441 - DNA, 46 bp, Homo sapiens
  chr17:40689596-40689642
  hypo
tatggcgggagccaccgtaggtgttttcacccgccccccagcatgg

SEQ ID NO: 80442 - DNA, 123 bp, Homo sapiens
  chr17:40705905-40706028
  hypo
gtgagtcaacacccccgttccccgaaccctcttaactctgacctagagacgccgagcaccctgtcctgcgggagccgctctggggcgatctccctggccctctctgcccggctcacattagct

SEQ ID NO: 80443 - DNA, 24 bp, Homo sapiens
  chr17:40801969-40801993
  hypo
ctccctctccgaaaaaaaaaaaac

SEQ ID NO: 80444 - DNA, 152 bp, Homo sapiens
  chr17:40831916-40832068
  hyper
acgcgcagcgcacgccggcgctcgggccccctggcggccagcagcgtgcggcccagaagcgcgtagcaggctaccatgacgcccagcggcagcgcgaagcccagggccacctgcgccacggcgctcgcccccttcaccgtctgcgtgaggcc

SEQ ID NO: 80445 - DNA, 15 bp, Homo sapiens
  chr17:40893475-40893490
  hypo
cggcctgctcccaaa

SEQ ID NO: 80446 - DNA, 143 bp, Homo sapiens
  chr17:40912910-40913053
  hyper
ggggcgactcgaattcggggagcgatcctgggagaccctggagagtcctgggcgccacgcagccgagcccccgaaatagatcccggttccggggttccgggagctgtccagcctcgcggggtgagctacgagagggtgggcca

SEQ ID NO: 80447 - DNA, 30 bp, Homo sapiens
  chr17:40921807-40921837
  hypo
gtgccataaagtcaacggaaatagtgagct

SEQ ID NO: 80448 - DNA, 324 bp, Homo sapiens
  chr17:40932499-40932823
  hyper
gctgctcgcgggatccgcaccgcgggagcagctcggaggggcggccctggggggcaagggcgggccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcct

SEQ ID NO: 80449 - DNA, 82 bp, Homo sapiens
  chr17:40932843-40932925
  hyper
cgcgccgcttctccgggaaggctgagccccggccgcgctcttctcgtctcagccgccgtagctcagtcgacttggggctgct

SEQ ID NO: 80450 - DNA, 40 bp, Homo sapiens
  chr17:40933234-40933274
  hyper
cctcaagtttgacatcgagattggacgtggctccttcaag

SEQ ID NO: 80451 - DNA, 30 bp, Homo sapiens
  chr17:40951150-40951180
  hypo
agagacgattgaagacgccctgcttcactt

SEQ ID NO: 80452 - DNA, 103 bp, Homo sapiens; identical to SEQ ID NO: 16200
  chr17:40975574-40975677
  hypo

SEQ ID NO: 80453 - DNA, 34 bp, Homo sapiens
  chr17:41131532-41131566
  hypo
gggaagccaggccctcggacggcagggccactac

SEQ ID NO: 80454 - DNA, 30 bp, Homo sapiens; identical to SEQ ID NO: 45079
  chr17:41188525-41188555
  hypo

SEQ ID NO: 80455 - DNA, 146 bp, Homo sapiens
  chr17:41278547-41278693
  hypo
tgcaaagaagaggggcgactttttccgtgtctccggacagctaatcgttttagtgacaggatgagagagcccttcgtgttctgagggaccgagtgggcgaaaagcgccggagagttggagagtctgtggttcagaatgcgaggtga

SEQ ID NO: 80456 - DNA, 35 bp, Homo sapiens
  chr17:41290312-41290347
  hypo
atactatatggcctgcggaccgctcagctttcatt

SEQ ID NO: 80457 - DNA, 20 bp, Homo sapiens
  chr17:41416854-41416874
  hypo
ccttgcgggatctgcagact

SEQ ID NO: 80458 - DNA, 280 bp, Homo sapiens
  chr17:41464702-41464982
  hypo
ttctctgatagaggacgtatcagatattaaactgataagaacagatactacacttgatcttagccaaaaggacgagaagagatgtcgtcgccttcctccctgccatcaccgtcccactctcatctacattcaagacgcggtgagagccccagcctcgctccttgcctcattcactttgtcttgtccacaccaatattgacgccattacacactcgggctgatttcttattctccacgttttaaaagaaaaatctgccgggcgcagtggctcacgccagta

SEQ ID NO: 80459 - DNA, 30 bp, Homo sapiens
  chr17:41651782-41651812
  hypo
caggcctcctgacaccgtcctgccagttag

SEQ ID NO: 80460 - DNA, 80 bp, Homo sapiens; identical to SEQ ID NO: 36525
  chr17:41723454-41723534
  hyper

SEQ ID NO: 80461 - DNA, 94 bp, Homo sapiens
  chr17:41723778-41723872
  hyper
gacgacgggcgcggtcggggactggtttcccaatcttctcccgtcccgaggcttagtgtttcccagcccttcctttccacggttgcggggagtg

SEQ ID NO: 80462 - DNA, 56 bp, Homo sapiens
  chr17:41791451-41791507
  hyper
ggggcccagctcccccgggcgaccgttcctatctgagttctcgttcctatctgggt

SEQ ID NO: 80463 - DNA, 32 bp, Homo sapiens; identical to SEQ ID NO: 36527
  chr17:41832619-41832651
  hyper

SEQ ID NO: 80464 - DNA, 66 bp, Homo sapiens
  chr17:41957220-41957286
  hypo
catacaggttgccctcgtattcgccatgctccaggtagcgcccagcacggacgtcagcctccatct

SEQ ID NO: 80465 - DNA, 516 bp, Homo sapiens
  chr17:41983831-41984347
  hyper
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggaccatcagatcacccctgccccaacggacccagccctaacaccctgggcgctaggacctgggggaggggggcgtgttgtgagccatcaaagaaggctctctacgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaag

SEQ ID NO: 80466 - DNA, 209 bp, Homo sapiens; identical to SEQ ID NO: 36530
  chr17:41984363-41984572
  hyper

SEQ ID NO: 80467 - DNA, 39 bp, Homo sapiens
  chr17:41984976-41985015
  hyper
gggaggtgaggagaacgcggaggccggcacaactcggag

SEQ ID NO: 80468 - DNA, 38 bp, Homo sapiens
  chr17:42015533-42015571
  hyper
cgctgaccacagccccggcatcacgtgacctcccgcgg

SEQ ID NO: 80469 - DNA, 422 bp, Homo sapiens; identical to SEQ ID NO: 36531
  chr17:42030329-42030751
  hyper

SEQ ID NO: 80470 - DNA, 15 bp, Homo sapiens
  chr17:42030779-42030794
  hyper
cgcccctaggcagac

SEQ ID NO: 80471 - DNA, 187 bp, Homo sapiens
  chr17:42061233-42061420
  hyper
caggggccgcgtgtccggtgccggccgggctgagtgttccgaggcgagcggctgctgtttgcgcagctaagtggcgtctgtgtacccagcggggcgcagcggtcgcgcgcttatctcccgcaaacaccgcgcccggatccgccggaaccacggccgcgccgccccatttgcacgccccggccgccgg

SEQ ID NO: 80472 - DNA, 1570 bp, Homo sapiens
  chr17:42082149-42083719
  hyper
cgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtgagcggagcccggcgtgggccgtgacgcagcgaggggatggggttgtgcggccacctgtcctcaggcatggcaggatacgctgcgggctctgcgcagcggaagcgggaaggagcccggcagggcccagaccagcgccgccgggaatgggagaggccgtaagctcctccggaagcctcccgcccagcccgagtgaggatcctgggggaccccacccgccaggtgtgatgctctgaagaaggcccccaacatgggcgcagttaggggttcagaaggacctggacaggagccgcttgcactgcccctcccccaaagatgtcccggagtccaaggtcggagggaggagggcgggaggtaccccagcgtgagacaagggagtggcaagacccaacggggcaaagggcggagcaggtgggcactggtggccagaactgggtcctgacagcttctggaagggtagggtcaccgagacggccctgcaggccaggctgtgggagccagcggctcaggtccgtgtcacgctccttgaaagcccactcctccgcaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgcccaggcgtcctcagagcgtgctactctgcccgccctgccccgtccggcaggcctggagggggccctctcgagcaccacgtctggcccacagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtgcggccctttctttcaccttcccccacgccggcgatccgggccttctcttgcgcccctcgcacttctccccgacgggccgcagactcactagcaagccgggtgggtagaaaa

SEQ ID NO: 80473 - DNA, 129 bp, Homo sapiens
  chr17:42091732-42091861
  hyper
agtccccgtagtggacgtagcccccgatgtaggcggcgtaggtgctaatggccaattggagtgcggcccccagcgcgaaccagcgccgcttcacgccaaaggacatgaaactagcgcacagcacggctg

SEQ ID NO: 80474 - DNA, 59 bp, Homo sapiens
  chr17:42092128-42092187
  hyper
tcttgcccacatcaccgccccctgccgcgtttagcggctgcgtaggcctgctcaccggc

SEQ ID NO: 80475 - DNA, 169 bp, Homo sapiens
  chr17:42092188-42092357
  hyper
tgcctcagccctctcagcgtacagcatgagctggctgaagcagccccaaaaggggcagcgtgtgagcagcaccgaacccaactgcatgatcagctgcaacatccaccgtctcgaacctatcttcgacgccatcttgggaaagggcagtccgctgcggcctcaccccagt

SEQ ID NO: 80476 - DNA, 89 bp, Homo sapiens
  chr17:42142826-42142915
  hypo
agatgccataaaaaattactcctccaaaaaaaaattccaataaacccacctgtggctcacataaaaagggaagccgtggcacatttatc

SEQ ID NO: 80477 - DNA, 80 bp, Homo sapiens
  chr17:42222379-42222459
  hypo
ggccctagattgtttaagtctttaacgaaatcccatttcttctcattccttagtcctttcccagccgtagcaaaaacaaa

SEQ ID NO: 80478 - DNA, 75 bp, Homo sapiens
  chr17:42287799-42287874
  hyper
cgactgagccttgagcgccgcctctcgggccttgtacttggcctgcggggatggcccgggcgtcagccttccacc

SEQ ID NO: 80479 - DNA, 120 bp, Homo sapiens
  chr17:42301918-42302038
  hypo
ctgcgcccggcctgtcccttgttatttttttattgctgtgtaagtcagagatagtaaagtacacatactttaagtatacaacttttttttttgagacggagctttgctcttgtcacccag

SEQ ID NO: 80480 - DNA, 23 bp, Homo sapiens
  chr17:42329685-42329708
  hypo
acaacccccggcctctatcggtc

SEQ ID NO: 80481 - DNA, 325 bp, Homo sapiens
  chr17:42330572-42330897
  hypo
ccatgacagtgagggcgttggcatgggtgacggaacgcacggtggtggcactgagccagggcatcccaaagagggcggccaccccacccatgcctactaccagcagcaggtccaggtggaagccggagcccttgaccatcttgcgctcaggtttgctgacaatcagcctacggtaggggaaggtgaggggtaagcagggttctcccctgcctcctccaccccctccttccttctccatacttggtgtccttgtagctcagttttgtcttctgtgcccctcgctctttgagttccttgctcccctccctcccgccccatcttgaga

SEQ ID NO: 80482 - DNA, 135 bp, Homo sapiens
  chr17:42331636-42331771
  hypo
cccggccacgttttttttttcttaaaaagagctctccaaattatacaacttctggtcccacaaaacctggaactgcccctggcttttcactattcctgctagtcgggagggccacacacccgcagggactagctt

SEQ ID NO: 80483 - DNA, 58 bp, Homo sapiens
  chr17:42335454-42335512
  hypo
aggtaataggggtagcggcgccggatatcacgcaccaggcccccgaagagctggcctg

SEQ ID NO: 80484 - DNA, 30 bp, Homo sapiens
  chr17:42335968-42335998
  hypo
atgtaggcatctatgcggaacacctagggg

SEQ ID NO: 80485 - DNA, 30 bp, Homo sapiens
  chr17:42364250-42364280
  hypo
tccataatttcattacggtgtgtaattgaa

SEQ ID NO: 80486 - DNA, 79 bp, Homo sapiens
  chr17:4236625-4236704
  hypo
gaagaaaaaaacttacgggcgaagctgttccctaaacagctaaaatatgtaaaatgtaaaagacgggccgggcacggtg

SEQ ID NO: 80487 - DNA, 44 bp, Homo sapiens
  chr17:42390058-42390102
  hypo
caaaggtgggcccagcgcccctcccccagcggtccctcccccag

SEQ ID NO: 80488 - DNA, 74 bp, Homo sapiens
  chr17:42392337-42392411
  hyper
tggtcatcgattacacgccctacctaaagttcacgcagaggtgagcggctccatgactgcggcggggcggggga

SEQ ID NO: 80489 - DNA, 291 bp, Homo sapiens
  chr17:42392465-42392756
  hyper
cgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcgggg

SEQ ID NO: 80490 - DNA, 205 bp, Homo sapiens
  chr17:42392796-42393001
  hyper
cgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacc

SEQ ID NO: 80491 - DNA, 155 bp, Homo sapiens
  chr17:42393420-42393575
  hyper
accaccctgatcttgcggcaagatccccaagacgatcttacacttcagggattcccacactatcctccactgacgtccccatcaccccagctgaccccaacaacactgcaccattccctccaactcccaatatttgtgcacgaatccctgtcacc

SEQ ID NO: 80492 - DNA, 329 bp, Homo sapiens
  chr17:42393870-42394199
  hyper
aactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctcccccaacccaacacccagtacccctccagaaagggctgaggcaaggccctgaggcctcaaggcatgtcctcattcattctcttagtcttttttttttt

SEQ ID NO: 80493 - DNA, 41 bp, Homo sapiens; identical to SEQ ID NO: 16204
  chr17:42395128-42395169
  hypo

SEQ ID NO: 80494 - DNA, 30 bp, Homo sapiens
  chr17:42395520-42395550
  hypo
gctgcaagtccctggcgagcttcaaatcca

SEQ ID NO: 80495 - DNA, 24 bp, Homo sapiens
  chr17:42401293-42401317
  hypo
caccgcacccggcccactgtgaga

SEQ ID NO: 80496 - DNA, 124 bp, Homo sapiens
  chr17:42402772-42402896
  hyper
cactggaaaccccagcgccttctggacggcgagggtgacgcactggccctcttcctcggtgtcctcaggtgcgtggcggcggcagtgagaatgagttcttcgagatcgccgggagaccacacaa

SEQ ID NO: 80497 - DNA, 20 bp, Homo sapiens
  chr17:42587335-42587355
  hypo
ccagacgccttctcaaaaaa

SEQ ID NO: 80498 - DNA, 612 bp, Homo sapiens
  chr17:42635148-42635760
  hyper
ctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgtt

SEQ ID NO: 80499 - DNA, 414 bp, Homo sapiens
  chr17:42733506-42733920
  hyper
ctatcagcaaatcatcgggccggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggaggggcgggcctcacagcggggcggggcgcgcctgtgccgtgtcgcgtgccgagccgcgagccccaggcaggccaggtaacggcctctgcccccgcccctccctccccgctcggacttcccttacccgcacactggctccaggcagcgcccgggcggcggaggcggctgcggagacggcggggtgcgggctgagggagccgggcctggacgccc

SEQ ID NO: 80500 - DNA, 43 bp, Homo sapiens
  chr17:42734191-42734234
  hyper
gcggggggcgcggcgcgggctgactggacgggccggacggagc

SEQ ID NO: 80501 - DNA, 17 bp, Homo sapiens
  chr17:42737897-42737914
  hypo
cccggccagaattacat

SEQ ID NO: 80502 - DNA, 82 bp, Homo sapiens; identical to SEQ ID NO: 45090
  chr17:42787212-42787294
  hypo

SEQ ID NO: 80503 - DNA, 82 bp, Homo sapiens; identical to SEQ ID NO: 45091
  chr17:42787534-42787616
  hypo

SEQ ID NO: 80504 - DNA, 54 bp, Homo sapiens
  chr17:42835736-42835790
  hyper
tggttggagtgacagcgatccctgaagccctcctggaggccggggcatctttgg

SEQ ID NO: 80505 - DNA, 30 bp, Homo sapiens
  chr17:42849487-42849517
  hypo
ctgggagatcagatccgacatgggagctgt

SEQ ID NO: 80506 - DNA, 30 bp, Homo sapiens
  chr17:42865115-42865145
  hypo
ttggggcaaacaatgcgggctgccaactcc

SEQ ID NO: 80507 - DNA, 1049 bp, Homo sapiens
  chr17:42906582-42907631
  hyper
tcccaatcagacaatcgcaaaaaaaagaacaaaatctaaaccatacattcacgtacatcttttcaactcagagctccaaacgcagccgccaaccacacaactgcccacaatcacagcggtagcgcctactcttaattttgaagctagagacttaaggaaacacacacacacacaaaacagttctcaagtttgacaaagtgggggaaaagtcattttaagtaaagacaacgagttaatcaggaggcgatgagcccagtccttccgccccgctttcccgcttccagccctcgaacgaaccctcctctaacccccgggaggcaggagttccagcggggagatgcgggaagcctcagacgagcccgcacgccgccggagacgcagggatcgaggtcggggagacaaagagcagcccgcgaagagcccgggcggcgaggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaagagggagggtgcgccggggacagtggcaggacgcgggccggcgacgcccctccggactcggcgggaacccctcggcggcgcccccctccttctcccgctctggccgcgctcctccccggacctccggaggttctcctcggcccctccccgggctccccaagagttctcccgcctccccctgggaccccgcccctggcccgcttctcctcagccggccctgcggccgcccctcacccggcggcgggttcccccggagccgcctcctccgccgggcctcggcccgtcccgccggtcgcggcctcatgtgccccgcgtcgccatcgccttcaccctcgcctctcctccacctcctccgccgctgccgccttcgcctcagtctccagccgaggcagaagccgctcccgccgctgccgccgccgccgccgcctcccgctcc

SEQ ID NO: 80508 - DNA, 497 bp, Homo sapiens
  chr17:42907654-42908151
  hyper
cgcctgcgcactgcgcgctgcggtgggggcgggggcgtcccgccgcggcccgggagcggggggcgcgcggcacgtggcgctcgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 80509 - DNA, 200 bp, Homo sapiens
  chr17:42988598-42988798
  hyper
ctcaccggttctcctcgccctctagcagcttcctgtaggtggcgatctcgatgtccagggccagcttgacattgagcaggtcctggtactcctgcaagtggcgggccatctcgtccttgaggctctgcccctcttcctccagccgcgccagcgcctcctgataactggccgcctcccgcacgtgccgctcctcctgctcg

SEQ ID NO: 80510 - DNA, 254 bp, Homo sapiens
  chr17:43001692-43001946
  hypo
tggagatggaagtcacgagccaggtggacgggtgttggcagcagactgcactggacttaagcctgtggggattagcttggagcctcacctaagacctgggggccactaagaaggcagaactcctagcaacccaccgccaaggccgtagaagggtggaacagacctccaggtgcaattactcccaaacccacggagaagaggaggccctttagggcgtattgggctgtgaagtgaagagccgggctcagacctca

SEQ ID NO: 80511 - DNA, 12 bp, Homo sapiens
  chr17:43037677-43037689
  hyper
tgttgctggcgt

SEQ ID NO: 80512 - DNA, 299 bp, Homo sapiens; identical to SEQ ID NO: 36547
  chr17:43044508-43044807
  hyper

SEQ ID NO: 80513 - DNA, 6 bp, Homo sapiens
  chr17:43044863-43044869
  hyper
cgccgc

SEQ ID NO: 80514 - DNA, 228 bp, Homo sapiens; identical to SEQ ID NO: 12730
  chr17:43045038-43045266
  hyper

SEQ ID NO: 80515 - DNA, 158 bp, Homo sapiens
  chr17:43045371-43045529
  hyper
cgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgccggcgggcagggggcgcg

SEQ ID NO: 80516 - DNA, 233 bp, Homo sapiens; identical to SEQ ID NO: 36551
  chr17:43047752-43047985
  hyper

SEQ ID NO: 80517 - DNA, 126 bp, Homo sapiens
  chr17:43099263-43099389
  hyper
ggtgggcaggggacacgccctttggcacccagggcccgcagcccaggctcagaggacgtgggcgaacaacgcaccttttgagttagcgctcagggtcaggcagagcctccgcgcccacctggcccg

SEQ ID NO: 80518 - DNA, 104 bp, Homo sapiens
  chr17:43175938-43176042
  hypo
aaggccccaaaaatgcgggtgtctgcactgtagttgaggagcatgtgccactgtgagtcacagctccgcccttagcatcccacctctggcgtatctggtaaggc

SEQ ID NO: 80519 - DNA, 18 bp, Homo sapiens
  chr17:43233608-43233626
  hypo
caccgtactccagcctgg

SEQ ID NO: 80520 - DNA, 41 bp, Homo sapiens
  chr17:43298625-43298666
  hyper
gagatggctccccctcgtcctcagctcgtctctgggctaag

SEQ ID NO: 80521 - DNA, 30 bp, Homo sapiens; identical to SEQ ID NO: 45093
  chr17:43318029-43318059
  hypo

SEQ ID NO: 80522 - DNA, 51 bp, Homo sapiens
  chr17:43321296-43321347
  hypo
atgctatgcttcagccgcatcccgcgcctgccggagcgcatgaccacactc

SEQ ID NO: 80523 - DNA, 224 bp, Homo sapiens; identical to SEQ ID NO: 36552
  chr17:43339109-43339333
  hyper

SEQ ID NO: 80524 - DNA, 305 bp, Homo sapiens
  chr17:43339632-43339937
  hyper
gaactccttcctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctccatgaccaaggaactcagcaccccgtgtgccccagctc

SEQ ID NO: 80525 - DNA, 41 bp, Homo sapiens
  chr17:43827217-43827258
  hypo
tccaggcagtagactcgctgtgtgcccggaccagtgaggca

SEQ ID NO: 80526 - DNA, 193 bp, Homo sapiens
  chr17:43974207-43974400
  hyper
aacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggc

SEQ ID NO: 80527 - DNA, 32 bp, Homo sapiens
  chr17:4436418-4436450
  hypo
ggacaggtggggccccgcggggtgggcccagg

SEQ ID NO: 80528 - DNA, 68 bp, Homo sapiens
  chr17:4446308-4446376
  hypo
gcaggtagagagaggcgttgaagtggtagagggcggtgggggagtcgggctggcggccagcctgctgc

SEQ ID NO: 80529 - DNA, 38 bp, Homo sapiens
  chr17:4487283-4487321
  hyper
actgggaggggacagcgcgtagtcgcagagtcagggag

SEQ ID NO: 80530 - DNA, 317 bp, Homo sapiens
  chr17:44919021-44919338
  hyper
cgggtaggggctggccgggagcaggaccgggaggaactggaccctctggactggggagtgcggggtagatgaaggcagaggagatggaggttctgcagtgtgaggcaggcggacagggaagcctgcatccagctgagagaccttgagcaaccacgtcctcctctgagctccgcgtttgccgtgtgcaaagtgaaggggtaggccgaccccgcagggcccttcttgcgctcctctgcggtgtgtgggggggtctctggtccgcgagaggacagtccctgccgcgccgagcgtcctccagcgtccgcggccgccgcgag

SEQ ID NO: 80531 - DNA, 113 bp, Homo sapiens
  chr17:44928624-44928737
  hyper
aggcagaatctcctccgtccccgcctcgtaccctcctccccgcctctccaggcccggggggcttcacgttcagccaccgcgaccccgggcgggcgcggcgccaggtgagcgct

SEQ ID NO: 80532 - DNA, 172 bp, Homo sapiens
  chr17:44929063-44929235
  hyper
cgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagt

SEQ ID NO: 80533 - DNA, 105 bp, Homo sapiens
  chr17:44929255-44929360
  hyper
cggtctccagcttccccggctccgaatccatcgccctgttcagtgtccgagtctctggtcgccccccagccgccgctctcctcatcccgccgggtctcggactct

SEQ ID NO: 80534 - DNA, 136 bp, Homo sapiens
  chr17:44929567-44929703
  hyper
gggacgggctgttcccggtctcggggcagaggatcgtgcgcgtccagggagaatgggggaaacctcggacggtgagagcgccagctggagacgcaggaaggaaccgtgcgctggggaaatgcgaccacatctcaga

SEQ ID NO: 80535 - DNA, 46 bp, Homo sapiens
  chr17:44953620-44953666
  hypo
gtggcctcaggaccacgtgtaagtgccatggcgtatcaggctcctg

SEQ ID NO: 80536 - DNA, 30 bp, Homo sapiens
  chr17:44953868-44953898
  hypo
tcacccagcttctgccggcccagcaagtac

SEQ ID NO: 80537 - DNA, 38 bp, Homo sapiens
  chr17:45022231-45022269
  hypo
ctgggattactggcataagccaccgcagccggccttaa

SEQ ID NO: 80538 - DNA, 82 bp, Homo sapiens
  chr17:45055719-45055801
  hyper
actcccaccctgccccgaacgtcttaaaaaacaaacaaacaaaaaaaactggtaagaaccctcaccccacattctcccaccc

SEQ ID NO: 80539 - DNA, 474 bp, Homo sapiens
  chr17:45055831-45056305
  hyper
cgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcg

SEQ ID NO: 80540 - DNA, 277 bp, Homo sapiens
  chr17:45056574-45056851
  hyper
gcgagcaacaggcggcgcaggagctggagccggagaacctagtgtgcttagcggtcgcccgctgggttcctcgcgcgcctggccgcccctcccctagcaacggcccggccccgccccgccggtccccgcggcatctccgaggggcgggaatcccgccgcgggcgcagcctccccggagtcccggtgctggagggggtcgggagatccggcagcctctgtccgcgggccggcgaaactccaccccctcctggcacccgctgtccgttcttggctagaa

SEQ ID NO: 80541 - DNA, 17 bp, Homo sapiens
  chr17:45187461-45187478
  hypo
tttttttttttgagacg

SEQ ID NO: 80542 - DNA, 45 bp, Homo sapiens
  chr17:45268793-45268838
  hypo
attattatctggacacgtctattaaagtggactacagttgtattt

SEQ ID NO: 80543 - DNA, 243 bp, Homo sapiens
  chr17:45331432-45331675
  hyper
cctggctggcgcggtcggagccgggagctggggaccttcctggcccggcggtggcggggctgagaggtgcctggtgcctgggagcgggtcctccgagacgccgaagccatcagccaggctgagcgccttcccggccgccgcggcgcgcacggtgcggtgggcgcatctctgagccccgcgctcacccggggctgcgcgcgtcgcgggtggtcctggtcgggccaaggacgactggcccaggag

SEQ ID NO: 80544 - DNA, 30 bp, Homo sapiens
  chr17:45331924-45331954
  hyper
gtccccaggtggcagcggtgcctctgctcc

SEQ ID NO: 80545 - DNA, 786 bp, Homo sapiens
  chr17:4544270-4545056
  hyper
gggaatttgggctttcgcggaagaaaaaaagttaacaggaccgggtagaacacccggtagatgtgacatgagatatgacgggaggtgggtcgggaaatcgagagcgttctcctgtcttgactccccatcccttccctctcaccacccactccaccccaggtgataaagcctgaaaggtagagatccaacagcgctagcggttgaaacggtttttaaaatagagaaagcgagaggaccgacggcggctccagtgactgctgagtttccagacaagggagctttgtgcaatgaggggcgcacaggagcatgccctcaattccaaggagatcgggtagcggcaacatttattgagcgcttactgtgtgccaccgactgccctaaagccccccacccccgtggcctccgcgcgctttgagcccaatgcgcgggcccttggcaaagagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataacccagcctgagaccccgccctctcggaggtcgcttggggtcggaatgtgggtggc

SEQ ID NO: 80546 - DNA, 129 bp, Homo sapiens
  chr17:45786739-45786868
  hypo
gggcttccccatccccgagtcgcccgccgccaccgcctacgcccacgccgagcacgcgcagtcctggccgtccatcaacgtgagtggggcgcccgcgttccgcccaccccggaccgggccttgagattg

SEQ ID NO: 80547 - DNA, 1106 bp, Homo sapiens
  chr17:45810394-45811500
  hyper
agaaagcaagatcttcgaactacagggtgcgcgcaggctctcgcttctctccaccatggggggccctgcagtactcgccaagagcgtagaatttgcctagtattagccacgagagggcggggtggggcgaggcggagcagggccgaggtggcggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggtgagtgcggcgcgccggcccttggggcctctgtgcccgcgccggaacaagaacgtctcgtctgtttttctggctcgacaatgcttctgactccgtgtccctcactgctttggcttcagcgtagggagacaggggaatggggttgttaggaggacagggaaagctccggaggggcgtctgtgcccaggc

SEQ ID NO: 80548 - DNA, 567 bp, Homo sapiens
  chr17:45867017-45867584
  hyper
gcccggccttacttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgcccggagcgcggacacggtgatgcggctgcccctcgccccggccccaggctcgctgcgccctccctccccggtcgcctctgcgtttctcccgccagcaggagaccgagtctgagcgcagccgccgaccctgcgccttccctgtgcactcaaagaccgccagctctgggggagcccggggacccacgccgctctgggcacaggcgaccgaggccaaggcgctccgggtctctccagttccggcgtcttctggtcctcgggctccgctccgc

SEQ ID NO: 80549 - DNA, 76 bp, Homo sapiens
  chr17:45970972-45971048
  hypo
tttttttcacctctgcggtcttcatgatggggcctccaggataggagaagcatagctaccccgtttttctcccaga

SEQ ID NO: 80550 - DNA, 30 bp, Homo sapiens
  chr17:46030424-46030454
  hypo
acaatcttctccaggcgggtgttaaagtcg

SEQ ID NO: 80551 - DNA, 184 bp, Homo sapiens
  chr17:46036392-46036576
  hypo
cattctctctcccctcggatgggcatcgctggagagtggaaaacatctgctacatactcagtgtctctgccacttcctgggcccagtgctaccagcttaggtgcccaatccacccaccagctaccttcctccatggaccaggtgtgcgtgtcaggcaaagggtgaggcacggggtagagaaaag

SEQ ID NO: 80552 - DNA, 32 bp, Homo sapiens
  chr17:46080796-46080828
  hypo
ttggggaggagcaggcgcgggggtgggtgtgc

SEQ ID NO: 80553 - DNA, 38 bp, Homo sapiens
  chr17:46089245-46089283
  hyper
gccctcgggagttcccgccgcaccgaccccagccaggc

SEQ ID NO: 80554 - DNA, 521 bp, Homo sapiens
  chr17:46089581-46090102
  hyper
taataaatacatttgcggcccctcattggacagttggcctaatttgtttctttttcgcggggtggggggagcagccgcgcccgcgccccctggctcccagcagccctgtgcaaagcagatgttccgccgcagacgcggagctgcgcctagccgcgcgccccggaggccgcggttgccatggcgacggcggggccgcctgctgtcgccgagcacgctgtctcgcccgctcagtgattacctccatctccgcagtgttcgccatacggcccggattctaatcagatcccctcccccctcccccctccctcctccgcccggcccactaccccttcagctcccacagccttgggactcattgagaactgcccgcgcatccctgacggtgcccaggaaggcagagtgggggagagacgacccgcactcagcctgtgtttagggaggactggacccagtgcggttcgcaagaggttctgtgtccccaggccatctttggtgacattgaaccccgggagtccagctcc

SEQ ID NO: 80555 - DNA, 54 bp, Homo sapiens
  chr17:46100803-46100857
  hyper
gcccggctgcggtcccgccagcggggagccatccatcaccgcctgaatgccagc

SEQ ID NO: 80556 - DNA, 69 bp, Homo sapiens
  chr17:46124901-46124970
  hyper
agcaagactaagctgcgtgggaggccaaacgaggggggtcctttgggctgtttctaccatgacaaaaat

SEQ ID NO: 80557 - DNA, 142 bp, Homo sapiens
  chr17:46125006-46125148
  hyper
cgccaacgttccgccaacgtcccaccaccctcatgatatccgtccgcggtactgctccagcgaaggtacccttgcctgggccatgaggcgcaaccgtccctcacagctggggtggcttctccaggttcgcaccgaggggaag

SEQ ID NO: 80558 - DNA, 17 bp, Homo sapiens
  chr17:46176758-46176775
  hypo
cccgaccctactattta

SEQ ID NO: 80559 - DNA, 81 bp, Homo sapiens
  chr17:46177127-46177208
  hypo
attccacctcaattgcgttaaaccaacacgtctaaatgtaacaccaatttatgaaaaaccctcatttgaaactttgaaaaa

SEQ ID NO: 80560 - DNA, 146 bp, Homo sapiens
  chr17:4622963-4623109
  hypo
ggagtaaggacccagcggaagtaagcaatgtgggtgagcaggaaaggagggttctgggcagagagaaaacaaagactcagaggtggggcagcctggggtgttggaggaatggggaggtgccatcgtgccctcgggcaggagcagcc

SEQ ID NO: 80561 - DNA, 24 bp, Homo sapiens
  chr17:46344157-46344181
  hypo
caccgtgcccggccctgttttcct

SEQ ID NO: 80562 - DNA, 251 bp, Homo sapiens
  chr17:46507487-46507738
  hyper
tgggcgggagagaggcgggacggggcgcgggccctggtcgggaggcggacgggctggaaggcgacccggctgcaccgcgaggcacctgtacctcagccgcggtcgccgcccgcccagcccggccgcggggcggggccgtgggtccccgggcgcgtcaggaagtggcgcgggcggcaggcggggaccggaacggggcgcggggcgtgggtgcacgtggcgctcacgccggagccccacggtagaaggattgg

SEQ ID NO: 80563 - DNA, 256 bp, Homo sapiens
  chr17:46570216-46570472
  hyper
tgcttttcagcacttcgtaaatcacccatccgcccgggcagtttgctgctgccacgtctcggttctccctccgcgcgctccctgtccccccactcacctcggaagagggcacacccggggacgactccggagctgtcaccacaaagggcaggagggcaaaggggaaatggtgtctgtgcttcccagagccctcagcgccccggaagggtacggggcagcctccaggaaagctgtcaggagacgcttcctcccgagg

SEQ ID NO: 80564 - DNA, 48 bp, Homo sapiens
  chr17:46619087-46619135
  hyper
cgcaggggcgggggcagatcccggctgggccggcgcctcctgcagcgg

SEQ ID NO: 80565 - DNA, 1106 bp, Homo sapiens
  chr17:46620352-46621458
  hyper
agggtgggagaggctcgatttttccagtagacggccaaggagcgcgggggtcgaaaggaccgggaggaggaaacaggttagggaaactgcaggtcgatggcacagagcgtactggtgaaaaaatccagctcttcctcggaaaaagggaccgggctgtcgagagaaccctgtaggctaggggagaggcctccggatagctggagacaggagtcggccgcgaagaagttgaggtcgggaaggaaaggtgaatcctggcgccccgagaagacgtcttctggcaatggcccgggctccagcccgccggccccgcgcagcgcgcagccgggactcgacgcgcctgcgccctctaagcgaacggctaaaggccgggggtccgcgcttaaggcccccggcaccacctccggcgggtgacagcaggcttcccacgccgcccgcgaggcggaggggccgcccgggctggccgcgggttcctcggcagggtcgcagatgtcctccagggctcccgggcaggcaggctccccatccggcggctctcggtgctgcgtctgccgcttgtgcttcatgcgccggttctgaaaccagactttgacctgcctttcggtgaggtccagcaaggccgcgatctcgacgcggcgtggccggcacaggtacttattaaagtggaattccttctccagttccagcagctgcgtgttggtgtaagccgtgcgcagcctgcgcgccccgccgccaccagcctccggcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggagagcggctcccttcggcgccggaacctcagatccccctcccaagccctcccagtggacccctcaattcggaactttccaactcaaccggagcgagggtcagaaaga

SEQ ID NO: 80566 - DNA, 232 bp, Homo sapiens; identical to SEQ ID NO: 36569
  chr17:46621779-46622011
  hyper

SEQ ID NO: 80567 - DNA, 443 bp, Homo sapiens
  chr17:46654951-46655394
  hyper
actgtatctccctggcgaaaaagtcgctggtgagaatggtgaagaggatggggaacctacttcaaaggcgcagggcccaccaggccataaaaatttatgggggatgtaattatgtggctctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 80568 - DNA, 24 bp, Homo sapiens
  chr17:46655395-46655419
  hyper
gcgcaggagcccgaggggacagac

SEQ ID NO: 80569 - DNA, 111 bp, Homo sapiens; identical to SEQ ID NO: 1297
  chr17:46655450-46655561
  hyper

SEQ ID NO: 80570 - DNA, 437 bp, Homo sapiens; identical to SEQ ID NO: 1298
  chr17:46655562-46655999
  hyper

SEQ ID NO: 80571 - DNA, 374 bp, Homo sapiens
  chr17:46656057-46656431
  hyper
cgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcatgcactaattcggggagacttcgcc

SEQ ID NO: 80572 - DNA, 480 bp, Homo sapiens; identical to SEQ ID NO: 4434
  chr17:46659429-46659909
  hyper

SEQ ID NO: 80573 - DNA, 417 bp, Homo sapiens
  chr17:46663408-46663825
  hyper
ccgcaaggctcagcccggatccactaggggagaggcagtccagagggcggcctcgcagactgggaactgtttccggggaggagaagctagaggatactgcagagagtgcatttttctctccaagaggaactttagggggagaagagacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccacccccggtctacagaggcggaggtggctgcggcggtgtggc

SEQ ID NO: 80574 - DNA, 682 bp, Homo sapiens
  chr17:46670849-46671531
  hyper
gtggctggaggaggccgaggagcggttgacgctgaggtccatcccattgtaattgtagccgtaagagccggtgtgcatggcagcgggatccctgtaagagccgctcagagagctgccactgccataatttagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatgcggccaaatatggggggggggttggaaggggggtggggggcgttagggaatcacgtgcttttgttgaccagtcgtaaattctcgctgatgacctcaagaggtaattcatgctctatggttacaaataatgacgatccgagaatcgttagggccgattcaatgcgagcctccgagagagggggaaaaaaggagaagggggagaaacagagagaaggttggctttggcctctgagcagagcgcgccacctcccggcgaccgacgggagcgcgggcgtgagaccgccatggcggcgggcggctgcctccctgctggctccctgcaggctccctgcagtcgccgggagagaaagaaacccggccaaggctcagc

SEQ ID NO: 80575 - DNA, 835 bp, Homo sapiens; identical to SEQ ID NO: 36578
  chr17:46674922-46675757
  hyper

SEQ ID NO: 80576 - DNA, 1216 bp, Homo sapiens
  chr17:46687590-46688806
  hyper
ttaaagctaaaaggccgagaggaagggtgggggcgggctgggggctcgcagcgccgtggtgccggcgaagagagatccgccgggaagcagagcgagcctgagagcaccgagcaaatatgggggcggggatggcctgctgggtcgcggcccagtgggtgcagccttccagggccgacctccggctgggagcactctggacgcggaaaggggcgcccagccgggaaggaggcgccttcagggtaatgtgccccggcccctggggctcaggacagctcggtgcgcggcgttacctgagcttcgcatccaggggtagatccggaagttactctcggccgccaagtccgagtccctctgctccttggcgcccgccgccttggcggagtcgccgggacacaccccggagaggttctgctcaaagggcgcgcagtgcatgttgaaggaactcggctcgagcccatagccggccgcgtagacgccggccgcgctctggcccgccatgccccccccgccggggtacaagccctgcatcgaggcggcgaaggaagcgcccgaacccgctccatagcccgggcgctgggggttggaagcaaacgcacaagaagtttgttctgggaaggctccggtagcgaaaaccgaacttgaggctggatatttagaaaataaagtattcgcataatacaatgaactcataatttggccggatgatttgtaggcagggacgttttagtgtcggttttacgagattccttgatatattacagaattagagtccagatttacaccaaaaaggaccccctttttcctctccggaccacgtgaccccgcccacgtgacgtcccctccgccaatggccgggccgtctccccacggctcccggtaatgtggaaaaaattgtgtggcgttggatttataaaatatgatcaataatgaatgggaaagccgagccctgtggattggggctgggggctcaagggccgctgccgactcccgcgggctggaggccgcttgcaggcgagatttggggaggaagagattgagtggaagggaaaataaataacctcggggcgatccgtgtcaccctccacccatcctcttcagcccgttaccgagcgagagacaaacgcagggattgaatgcacgcaactgggtgggtgggtgcttggggcaggtctgttctttattaaaccaggccaattctgcacggcaaggccttttg

SEQ ID NO: 80577 - DNA, 378 bp, Homo sapiens; identical to SEQ ID NO: 36580
  chr17:46689986-46690364
  hyper

SEQ ID NO: 80578 - DNA, 276 bp, Homo sapiens; identical to SEQ ID NO: 36581
  chr17:46690429-46690705
  hyper

SEQ ID NO: 80579 - DNA, 53 bp, Homo sapiens; identical to SEQ ID NO: 36582
  chr17:46690852-46690905
  hyper

SEQ ID NO: 80580 - DNA, 606 bp, Homo sapiens
  chr17:46691213-46691819
  hyper
aaagccgggtggggacgaatggacccaccttgaaaagcccccagagcctctgccccagaagaaaagtttcttcagggtaattaaactataaagcaattgagaagtgcaaaagttgagcgcccccactcccaccaccctctcttcactaccccccataaaacagtaaaaggggaaaaaaaggaggagaagaagaagaaaagtaaggcaggatgaggggtttatagattcaggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgc

SEQ ID NO: 80581 - DNA, 437 bp, Homo sapiens
  chr17:46691987-46692424
  hyper
cgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccaccccccaccccccaaacaaaaatataccaccacttaaagaggtcctcgctttacatttcga

SEQ ID NO: 80582 - DNA, 27 bp, Homo sapiens
  chr17:46696538-46696565
  hyper
aatcaagaggctgcccgcgcccagacg

SEQ ID NO: 80583 - DNA, 226 bp, Homo sapiens
  chr17:46702529-46702755
  hyper
cggttgcggactctgcgcggctacagcgcgagatctgctaggaacaatcctccgccaagctgttgcatcgcaaataaaatcctaatgagctccctcccccttccccttggccggcttttacggtctgcgcgtggcgcggggagctctgccagccgcacggccccgggcagcccagtgcgctccggcccttgccctcgccggctctcggcctcgctggccgctggcc

SEQ ID NO: 80584 - DNA, 30 bp, Homo sapiens
  chr17:46703929-46703959
  hyper
caccgcactccatatcgaggatggattgtt

SEQ ID NO: 80585 - DNA, 50 bp, Homo sapiens; identical to SEQ ID NO: 36586
  chr17:46710940-46710990
  hyper

SEQ ID NO: 80586 - DNA, 197 bp, Homo sapiens
  chr17:46713933-46714130
  hyper
cggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggc

SEQ ID NO: 80587 - DNA, 181 bp, Homo sapiens
  chr17:46714131-46714312
  hyper
ccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgatgtccccagcagccggctagagggcagc

SEQ ID NO: 80588 - DNA, 39 bp, Homo sapiens
  chr17:46719480-46719519
  hyper
aagaagatgctcactcggtaagggcgagggagcccggca

SEQ ID NO: 80589 - DNA, 484 bp, Homo sapiens
  chr17:46723716-46724200
  hyper
ttggagaggtagggtcgggtgccagcggacagggaggccaaggcgttttcgggtgcgccccgaggccctacccgggaagctgcctcggtctggagatcaaggttaagccggtggccccgggaagcccacgcctgccacgggcggttggtcctgaaagctcgggccacggggctgcccagcttggagaggggcctttcacgccgcagtccccagctgcgagaggaagggctgcgcccgcctcctcacctacctctcggaaccacgccgtcccccgcgcgtcttcgtagactgcaggagtccagggcgtctggggactgtgacggcgcccaaggcgggggatgtggcggctctgggtcgccgccttctgcccccgcctctgtgaggcctctcgaggcagtgtctgtgtctggggcagcgacgccgacggcgctgggggcgcgaaggggctcacgctcctgcgttcccctggcgccggtgagtggcg

SEQ ID NO: 80590 - DNA, 152 bp, Homo sapiens
  chr17:46724752-46724904
  hyper
cgctcacaccctgggcgggaggcgactgatccacacttagggctccgaatccggagaaagagagcgccggaccctcctccgcccacctcccgccccagccgcagcccagcgacttcccgccatcctcggccaccgagcggctcctgcctggg

SEQ ID NO: 80591 - DNA, 115 bp, Homo sapiens
  chr17:46755586-46755701
  hyper
cctagagacgctccccgcctgctccaggtggccggcaccctagacggggcaggaagggcaggcgccaagcctcaagtctcaaacacggtgcggggctgcgcggcaaggagaaacc

SEQ ID NO: 80592 - DNA, 1013 bp, Homo sapiens
  chr17:46795361-46796374
  hyper
attataaaacatacacgttgaaacaatttttttaatttaaaaggggctgtttataaaaaagttttaaaagtagctctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcc

SEQ ID NO: 80593 - DNA, 47 bp, Homo sapiens
  chr17:46796498-46796545
  hyper
ggagatcgagtgtttgatcttcccttgctccaggatcctgaattctt

SEQ ID NO: 80594 - DNA, 33 bp, Homo sapiens
  chr17:46796605-46796638
  hyper
cgcacacgcagcactactaccgtctgagcaggc

SEQ ID NO: 80595 - DNA, 365 bp, Homo sapiens; identical to SEQ ID NO: 36594
  chr17:46796849-46797214
  hyper

SEQ ID NO: 80596 - DNA, 455 bp, Homo sapiens; identical to SEQ ID NO: 36595
  chr17:46797274-46797729
  hyper

SEQ ID NO: 80597 - DNA, 1760 bp, Homo sapiens
  chr17:46799288-46801048
  hyper
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttctttgtccctttctgcccagggcggctgccggtctctccaggaaccgcgagtaggtgctcccgccaggtggtatcggtgaaagcctgctgctcacccttcccttgtttcccaaaacttctgaaggctcccaaattcctgggagaccctctcccagggcctcctgatgcagctaccatactgagcgatccgtcgataacgcccttggcccaccgatcagtttaccttattagagagaaaagcactcttggaggtagtaagatgggccggtccttgatctgagaaatgggcgcacaacatcgctgttctctctgcaaaggtggggaccagaatccagcttgcctgaccttgcaagcaagcatcggcctaaaggtttcagcctcccagtggcgctctgtttgcacgccttaggctaggagaggaaggacgggagcacagcactgggtgcccctctccctgtagagtctggggcggggctcagtaagaaggcctgcggttggtggctccccacctcatagctgcaagtaggggcgaaagctggagtgtctcctcccagcagcctcctcgcctccccgcaaacctccgaatctccctggacctcctggttgctgtggcccttcctcccctgattggcttcctccctctttcccaaggccagagaagtcctctcttcccctcaccttcctccctcttcccataaaacttttaggaaaatgggggcgggggcggtggagaccaccagcctggaacttcaagttcaatggcaaagtccctgaccctccccccaggctgggcgccagcattattctaggggcgattaaactcttttgctgccccctgtgcacctcccagttcgggggcagtttaggggaggagagaaggtaatggtggaattctttccctcactctcccccgaccacttcgtcccctccccctcatcccctctacacagaactaactggtagggagagaggaagaaaggctggcatcggttcctcattggatgttttaaatctgtctcaggcccaggccagtgcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagc

SEQ ID NO: 80598 - DNA, 220 bp, Homo sapiens
  chr17:46801108-46801328
  hyper
cgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttggctctgagggaggggaacggtctggagggcag

SEQ ID NO: 80599 - DNA, 30 bp, Homo sapiens; identical to SEQ ID NO: 36601
  chr17:46801636-46801666
  hyper

SEQ ID NO: 80600 - DNA, 905 bp, Homo sapiens
  chr17:46802007-46802912
  hyper
cgatgaaagcctgcccgcaggttctcctggagtggtgagcctctgtcggaagggggcgcccacgtctttttaatggtcctaacacaccagtggaataaatctctaagattccacatcttttgtttgctctgaatttattgcgagtgaaaaacagagaaaatcctcaagtttaagtttctgatagcagagtgtgggagttagagcatggggagtccagaggttccagacccccaaaggtctctaccagggccatctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccac

SEQ ID NO: 80601 - DNA, 192 bp, Homo sapiens; identical to SEQ ID NO: 36603
  chr17:46802993-46803185
  hyper

SEQ ID NO: 80602 - DNA, 71 bp, Homo sapiens
  chr17:46803745-46803816
  hyper
tccctgcaaagggatcgccttccaaatttattcataattagctcaattcatgaaagcggtttctaaagtgc

SEQ ID NO: 80603 - DNA, 321 bp, Homo sapiens; identical to SEQ ID NO: 36605
  chr17:46804107-46804428
  hyper

SEQ ID NO: 80604 - DNA, 539 bp, Homo sapiens
  chr17:46805572-46806111
  hyper
gcaaactcagtggggcggctggggtactcttccccggccgtgggagtctccgcggggtacgcggccagggtggctgcctgggcacagggtttcagcgagctccgggacactcggcaggagtagtacccgcctccaaagtaaccataaggcacgggagctggggacgtcccctggggcaccccagggcatgggtggcattgctttggcggctccgccgagcctggcagatccaagggggcatagttgacagcaggcatcagcgtaggcgccgctgggtggctggtcagaggggagtgggcgaccagattccgcccccctcccgctcccagcaagccttcgatatccttggctccatccaaggtggcataattgccgggctccatggagccgagggtcggctcatgaggtgcgggggcggggaatctagggggcacccagctcgctctccccacccaggccgggggaatccaaagcgttttaaatcgctcccagctcgcaagtcgcctgcattcgctcagcacggccgtcttgacgcaaga

SEQ ID NO: 80605 - DNA, 303 bp, Homo sapiens
  chr17:46806788-46807091
  hyper
tggaatgagctgctccgggccccagggaggtgccctggacgccccttacccagggactcgctactgcccagaatgctctggaggccctgattcgggtgaggctgagggaagaggcgggagacacgaacgtagacgtagaagacatgcgatctggatggaacccaggacactccacttccggacctgaaggggaaatggagcctctagagtggcctgtggaagggtctggatttccctttaagtaaagacatacggagggacggagacccacaggacttgagggagggacggggagagggagag

SEQ ID NO: 80606 - DNA, 848 bp, Homo sapiens
  chr17:46810248-46811096
  hyper
tctacatgggttcagcggggaagtccctgcacaacccaggcgtcctgatcttccagactgactgggctgagcctggccttcccctaaccccacagatgcctttgtgtcctgctgggagcctcctggcagaccctccgggagcccggagcctcccccagctttctttactgacccagccaaaagcgctgaaagcctcagcgtgctcctttacatacccgccagacacctccaggaaggtaaaggccaagttgaaagttaagagtctgtttacctccaggagcccattcagctcggccccacagacagcctgtgacctttacagcccggcctttgagcgcggccgccgcgcccccgggggttccggcaacggggacttggcacctcggtgtcagctcccgcccccacccaggctagggacccgccaacgaggggtgggggcgggaggcgcccacccgtcgcactagtgggcatttgctaaactacgttttatttttttgtaaagtgagcgcccgctgccttcgttctcccaactggagcaaactctgtggcggcgacgatggcggccgtcaggtcggtggtgatgaatagagaggatttctctgcagcgcgacgctcccctctcccgaaaggttggctccacggtcccgccggccgcgcaggtctggctgaactgcttggggtcgcccggctcctctcgattttatgaaaatggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 80607 - DNA, 146 bp, Homo sapiens; identical to SEQ ID NO: 12785
  chr17:46811354-46811500
  hyper

SEQ ID NO: 80608 - DNA, 55 bp, Homo sapiens
  chr17:46811594-46811649
  hyper
cgctggagatgaagggtgactccggcctttcgccctgaaacgaagtcaagcgggg

SEQ ID NO: 80609 - DNA, 47 bp, Homo sapiens
  chr17:46812568-46812615
  hyper
cacggatttttcatgcgtgtctagtgcaggcacggttattagtgctt

SEQ ID NO: 80610 - DNA, 106 bp, Homo sapiens
  chr17:46815930-46816036
  hyper
aggccaagctttggacgagggaaagcacagactgacgccgaccagcccatcctccccggccttgcactgcccgagatccgtgcaggtcaagcgggcaaggtgggac

SEQ ID NO: 80611 - DNA, 499 bp, Homo sapiens
  chr17:46816240-46816739
  hyper
tcctggatggtaaagcgccctgcggcccgcgggtcaggtctttaacggtccagccagcgcagcaagagagctggggagtcttcttgcagtcccttcctcctactcacgcaaagatctcctctatgctggtaggtgcacctgccctccaccgatcctcaccctgagcgcaggtcgtacctcaaggcgaaaacccgcttagtgcgttggcgggtggagagctgccgccttcttgatccgggactgagaagctgcactccctgacgccactgtggccagcacctcgggccgcgcagacccctacatctctaatcccatagccctccaggggtccttggggcagtccctttggaaagtcttcgaagtgcagggtactttaagtaccctgtagacgccttttatttaatccgcacaacaaaagaacggggcaggagtggggggaaattgttacttccgttttgtagataagagaactgagccgggacggtggctcacgcctgca

SEQ ID NO: 80612 - DNA, 557 bp, Homo sapiens
  chr17:46824358-46824915
  hyper
cgcttactggttctcaagtcagagtcccccttcccggggctccttctggggactccgggggagagggatctctctgtccatcctgcaactcctctcctggcatagatgccccgcacccccaccttgggccatccttatctgcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctc

SEQ ID NO: 80613 - DNA, 767 bp, Homo sapiens
  chr17:46824916-46825683
  hyper
gcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggagaactcgggaagcccagcaacaacaaacaggtttcaacttggaaacaaaccattaaagtttggcttagtttttggtgtgaatggtgcaaataatttctcctcttcactcttcagtcgatctcagctgtatagagctgctctgcaagctaaaaagaaattagtatctattccccccgccaacaatttttttttaacccgggctaccagcttaagcaactggtatcattcttgttgaattaagctctgaaagctcgcctcagaaaaaaagtttttattttaaaaaacgaattattaagtcg

SEQ ID NO: 80614 - DNA, 97 bp, Homo sapiens
  chr17:46826997-46827094
  hyper
aaagacctcagtcctcgcatccccaccccgacccccggcagcctctttcgctctaagcctcagcctagggcaaactcccctccgcaggtcatcagcc

SEQ ID NO: 80615 - DNA, 172 bp, Homo sapiens; identical to SEQ ID NO: 36616
  chr17:46827330-46827502
  hyper

SEQ ID NO: 80616 - DNA, 131 bp, Homo sapiens
  chr17:46827625-46827756
  hyper
cgccagcattttgccggggtttatgcctcaatcccgcattccagccacttccacgaattacttggaagacagaatggtttgtgcccatttatcctacctggagcacagacaagaaacggccaaaaaatgaa

SEQ ID NO: 80617 - DNA, 221 bp, Homo sapiens
  chr17:46829434-46829655
  hyper
agacgcacctccaggcgaccctgcagactggggtcgggaaaaggacaggctgagaagtctagaaaggcaaagaagttaacgatgtttggcagtctgaggtcttatcagtgtgttggggtcaggtgggggccgaggcaacaagctcaggcagacgccagccggggctgggacggtgcaggtgaggaggggctgcctgggggacagcccgcctcactgaccca

SEQ ID NO: 80618 - DNA, 157 bp, Homo sapiens; identical to SEQ ID NO: 4459
  chr17:46829979-46830136
  hyper

SEQ ID NO: 80619 - DNA, 466 bp, Homo sapiens
  chr17:46830189-46830655
  hyper
cggtagggatgcctgggagtctagggagtggcgggggtgtttcttggcccggcagggtggggtttccaagcgtgatctcctcgccctggcagagccggggtgccgggtgggggcaggctcgggggcctgcctgcggtgaatcaggcttgtgacctcaggccgtccaggtaaacatcctctgcgctttggaaactgttgggactagaaaggagcgggcggcagggagagggaagggggaaggagggattctgagtggaggagacctctgaaatcctctctcctgccaggaaaccagggcggtcttccaagcgggcagccacgttgcctacttgaggccaaggcagaagcatcaatcacatggggcgtagtttctgtctggctaaagaacggctcacgcggacctcgggaatgcgactgtggaaacgacggggaagctggaagggctgggtggcgggggaagctggag

SEQ ID NO: 80620 - DNA, 600 bp, Homo sapiens
  chr17:46831726-46832326
  hyper
acactgtaaaattggcgtaaccaccattccctcccagtctttctctggagtcctaatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctc

SEQ ID NO: 80621 - DNA, 398 bp, Homo sapiens
  chr17:46832489-46832887
  hyper
cgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttgaatggtattttcctttagggtccctagaagcagagcaaatgaaaaggccagggggaaaaaaaaaaaaaaaagaaagaaccggtgaattggctct

SEQ ID NO: 80622 - DNA, 57 bp, Homo sapiens
  chr17:46863338-46863395
  hypo
tcctctaaaagatgccggctcctgtgtgccttcagggctccccgcaccgccccgtcg

SEQ ID NO: 80623 - DNA, 61 bp, Homo sapiens; identical to SEQ ID NO: 36623
  chr17:46918852-46918913
  hyper

SEQ ID NO: 80624 - DNA, 116 bp, Homo sapiens; identical to SEQ ID NO: 45097
  chr17:46946208-46946324
  hypo

SEQ ID NO: 80625 - DNA, 41 bp, Homo sapiens; identical to SEQ ID NO: 44973
  chr17:4699211-4699252
  hypo

SEQ ID NO: 80626 - DNA, 353 bp, Homo sapiens; identical to SEQ ID NO: 36624
  chr17:47072676-47073029
  hyper

SEQ ID NO: 80627 - DNA, 225 bp, Homo sapiens; identical to SEQ ID NO: 12797
  chr17:47073103-47073328
  hyper

SEQ ID NO: 80628 - DNA, 172 bp, Homo sapiens; identical to SEQ ID NO: 36626
  chr17:47073388-47073560
  hyper

SEQ ID NO: 80629 - DNA, 501 bp, Homo sapiens
  chr17:47073908-47074409
  hyper
cctcccccttcagttcgctccggttagccctagctatcactcctcttccttgtctcccaccgttcctgtctcctggagtcatctccggccagttccgcgtgttcccctcaggaccccgaaacgttatcatttaacagccggaccccgggtgcgaaccaccctttctcccgtggggatctcaaaacattatttcctgcggcttcctcgttctccactgggataccccgttcccagctttccagtcccgcgctcgcagggtcccccggtcctgcatccccggaggcgggggagtttcgtggggctggcgtggggaaggcggagaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 80630 - DNA, 1038 bp, Homo sapiens
  chr17:47074697-47075735
  hyper
tgggggctgtcaccacgtggcttctcctttttttttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcgacctacccccttcgatgccccctccctcgctctgcgcctcccacccccgcgcagaaacattcgggatttcctcatccctttctcccagcctgagataaggagctctggcttcccccatccttcctccccaccgacggggcgggagcccccactggcagtagtggggggttgaatttagggacacggggatgacccctggctgggcgttatttccacgcccagcccctccctatccgccggtggacgcccccccagctggaaaaccccggctcccgttcctcagtcttaggcctttccaggcgtggaaggggtacccggac

SEQ ID NO: 80631 - DNA, 416 bp, Homo sapiens
  chr17:47075879-47076295
  hyper
cggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaatttacagactc

SEQ ID NO: 80632 - DNA, 270 bp, Homo sapiens
  chr17:47081179-47081449
  hyper
gttgggtggatttcccgcttcccttttaaaggggagcggctggagtctcacagtgttacccacgggagaggggtcggagacgggtggtagactcagctcagggcaaggctatatttgcttttggagttgccggccttcccttcccctttcaaaaaagagagagagtagagagagagaaagtggcggcggcgctgcaggctcttcctggagcgctcgccccggcccggcggccctaaccttccccgcccgcccccgcgccagtcccagccc

SEQ ID NO: 80633 - DNA, 170 bp, Homo sapiens
  chr17:47170202-47170372
  hypo
ctcactattacacctcgtagactgcttgaataatttctgcttcccatccccatgatcctgaatttgggggatgtgaaggttctagtgcacagtggagtgttcttgttggaatgcacggtcatggtttcactgaattaggagctgaaactgccttccgggagtttggaaag

SEQ ID NO: 80634 - DNA, 30 bp, Homo sapiens
  chr17:47170926-47170956
  hypo
cgtgcggattctaaccgcactgcattgtgg

SEQ ID NO: 80635 - DNA, 480 bp, Homo sapiens
  chr17:47210020-47210500
  hyper
gggggccgtcccaagcgtcctgcacctgccctactcgccgagaatttgcccgggtcggtgccagggcggggcagtcggcggcctggctgctaggctccgtgacatccggcagtctgagggcggcgggattcgggatgacttcgggcgggtgagtgtccccggggcagagcagagcgagaggtgaaacttcgggagcagggagcgccgcgggtcctttctggcgtctgcagagcgggcaggtgctggggacgcagacgccggagccagggagcgggcggttggagtcttaagtccaaccggttccccgcataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcggctcgggagtgcgggctt

SEQ ID NO: 80636 - DNA, 81 bp, Homo sapiens
  chr17:47226409-47226490
  hypo
ttgtctcaaaaaaaaaaaaaaaggagttgataaatgcattcccgttcttcttaggcatcaacatctcggtggctgcagggt

SEQ ID NO: 80637 - DNA, 102 bp, Homo sapiens
  chr17:47227368-47227470
  hypo
ttgtatttcctcttccgttaattacctgtttatgttctttaccatttaaaaattttggaggtcggggggggtcagccccccacctggccagccgccccgtcc

SEQ ID NO: 80638 - DNA, 30 bp, Homo sapiens
  chr17:47287915-47287945
  hyper
gacttcctcttgtcccggaatgagcatgcc

SEQ ID NO: 80639 - DNA, 281 bp, Homo sapiens
  chr17:47307520-47307801
  hyper
aagccagcactctggcgcacccccggctggcgggcgctgggctccaatgcgggcggggggtgcgcggctcggggaggggtattgtgggtggcagggagcaaggggacaccaattccttggctttgtcagagtcggggacggagggataccccagcactatgttcctgggtaggagagagaaggggactcactcctgagctccagaactcccccagtgccacgcgcgtgaaggagcgccttcaaactccacagcccccaccccgcgccgggaccccagccct

SEQ ID NO: 80640 - DNA, 275 bp, Homo sapiens
  chr17:47308444-47308719
  hyper
ccgcctccagggcttcggttcttgagatttgcagaagtgcacctccacctcctgcccattccgctgtcgcgtcctaaacccagtgggaggcacgggatgacccagccctcgggacccttttccccagattataggttactgaggattgcgggggttggcgggaggaatgactccctacccccacccccgcccgtaaagttggtggagcgggtggtgacagacagtttgccccttttgcagatggccctataaataaaaaacgcactttctcccct

SEQ ID NO: 80641 - DNA, 30 bp, Homo sapiens; identical to SEQ ID NO: 45100
  chr17:47330524-47330554
  hypo

SEQ ID NO: 80642 - DNA, 19 bp, Homo sapiens
  chr17:47336379-47336398
  hypo
gccacggtgccaggcccta

SEQ ID NO: 80643 - DNA, 28 bp, Homo sapiens
  chr17:47355143-47355171
  hypo
gagccaccgcgtccggcctccaatcaat

SEQ ID NO: 80644 - DNA, 30 bp, Homo sapiens; identical to SEQ ID NO: 45101
  chr17:47449030-47449060
  hypo

SEQ ID NO: 80645 - DNA, 118 bp, Homo sapiens
  chr17:47547799-47547917
  hyper
gggtgggggaggggacgccgacacggagctgccatcggatgcgacggaccccaccgagcaccccagccacggagcggcttccgcgggcagcctggggcctgggcggggtcctagggag

SEQ ID NO: 80646 - DNA, 30 bp, Homo sapiens
  chr17:47559443-47559473
  hypo
gtttacctagagctgcggtttcacttcttt

SEQ ID NO: 80647 - DNA, 41 bp, Homo sapiens
  chr17:47572358-47572399
  hyper
gagaggaacaggaaccgcagtggggacgccctggtccccgg

SEQ ID NO: 80648 - DNA, 2283 bp, Homo sapiens
  chr17:47572971-47575254
  hyper
aaggacctctgatgccgggaccacgaaggagggtctagggttcccggagcgcagaggcgactctccagggtggagatgagggcaagaccggagcacggatgccggtcctcaggtaccgcagggggcggtgggggagctgggaggggtctttcaagagggggcatggggctctccgatgcccaggttcttcggaagaggacactcgaatgccgggatcccgaagggactttcccctcagcatctcggtctctggagagtcgtgggacagaaccaaggcgagagaaggagggggaactggacggggactagagatgagaggggcgagctgggctggggcggggagcccgggacgacgggatggaacaatggaggaggtcggagggactggaggcagaggggacccggcaaggacaatggggaccggccagacaatgggggggaggggcgtcggagggagaggttggggagcgggagagaggttgagaagtgggttagggagggcagaagaggggcgacggcgagggcggcagagagatggaagcagaaggaaaggagacagagcggggcgcggaccctgaagtggtcggggtcccgcctgcccgctgagggacagtgagacgagaagagagagcagaggcttggacatttccagcgcctgtccccgcgctcctgctcgcggcctctcccagtcccggaattggggctgcggatctaaggctgggaggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 80649 - DNA, 30 bp, Homo sapiens
  chr17:47643694-47643724
  hyper
gtggaaagggactggcgggtgagcgggcct

SEQ ID NO: 80650 - DNA, 30 bp, Homo sapiens
  chr17:47644064-47644094
  hypo
cctcatttcaggaaacgctggcatgggaaa

SEQ ID NO: 80651 - DNA, 64 bp, Homo sapiens
  chr17:47653309-47653373
  hyper
gcagctggggcccttcgaggcgctcggggcgcacatctgggacctcgagcgggggccgtgccgc

SEQ ID NO: 80652 - DNA, 97 bp, Homo sapiens
  chr17:47657497-47657594
  hypo
cctcacctgtcagaccggggttctcccggatctggatggcgccgccctctcagcagcgggcacgggtggggcggggccgggccgcagagcatgtgct

SEQ ID NO: 80653 - DNA, 36 bp, Homo sapiens
  chr17:47756022-47756058
  hypo
acgcatggtggctgacgcctgtaatcccagcacttt

SEQ ID NO: 80654 - DNA, 62 bp, Homo sapiens
  chr17:47840698-47840760
  hyper
tggcataaagggaagcgcacgtgaagtggtggagaatggaactccagcgcagttgagaggga

SEQ ID NO: 80655 - DNA, 32 bp, Homo sapiens; identical to SEQ ID NO: 16208
  chr17:47851118-47851150
  hypo

SEQ ID NO: 80656 - DNA, 31 bp, Homo sapiens; identical to SEQ ID NO: 16209
  chr17:47851390-47851421
  hypo

SEQ ID NO: 80657 - DNA, 163 bp, Homo sapiens
  chr17:47865437-47865600
  hyper
gttttgcctcctccccgcgacatcaactaactcacttgctgttagctaagggcaaggacaatgtctcctctaccagacaggaaacttgatggcggacgctatccgttagttcctttttcaattccccattcccaccccttcgagaccacgatgtttcttaaaa

SEQ ID NO: 80658 - DNA, 376 bp, Homo sapiens
  chr17:47928151-47928527
  hyper
ccctgacacacagcacgcgctcagttaaccctaacttaattgttgtgatgatgaggaggatgatgattttattccttcgaaggagcgctggtctcctggccccctctcagtctcccgacctcgccagcgccagagccatcctgcatggtcccgacctcgtcagcgccagagccgtcctgcatgaggcaggatgtggtgggcgcacagcagggacgaggcggggggcacggggcagaaaggagagggcgacgggaagaaggcagagaaaacccaaaaggtccggaaggctgggagggaggcagggcacaggctggaaaccgcggctatttgcagcgtcgccctcgggctgcggtcaggctggcgctggcagtcctgg

SEQ ID NO: 80659 - DNA, 113 bp, Homo sapiens
  chr17:47967958-47968071
  hyper
ctccgggcccgacgccggcccagcccagcagtgccgggcgccgggcccaagccgaccccctgttttggctctgccgcctgatttctaccgcaggcagatatcttccgagaccc

SEQ ID NO: 80660 - DNA, 15 bp, Homo sapiens
  chr17:47968095-47968110
  hyper
cgctaccccagggcc

SEQ ID NO: 80661 - DNA, 39 bp, Homo sapiens
  chr17:47979358-47979397
  hyper
ggggcaccctctctacggcgggcccgccccctgccccgc

SEQ ID NO: 80662 - DNA, 605 bp, Homo sapiens
  chr17:47987509-47988114
  hyper
agggagctgggctttcggaggtgagaggaaccgcgaggcagcagcggtgtggggaaggcactcagctttcctggaggagcggctcccggtggcggcgggctgcctggaggaggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccgaggggtggaaccttgcggtgagctcggcgcggcgccccctccccgagctccggcccagcggcgctctcagctggttcccacgctgcgcagcgctggccacgacccctcgtcccttctccacctgggtctgcctcttggctcgctgactgcaagcctggcagcgcgcacgcgcacacttcctcca

SEQ ID NO: 80663 - DNA, 85 bp, Homo sapiens; identical to SEQ ID NO: 36640
  chr17:48040403-48040488
  hyper

SEQ ID NO: 80664 - DNA, 677 bp, Homo sapiens
  chr17:48041100-48041777
  hyper
ggtggcagaagtatacgtctgtgcatctatgtgtttgtggtgtttttggtgtgtgtgtctgtgtgtgcgcgcgcgcgctctgtgttgtattgtgtgcgctagtgcacgcattgtcttcgatgttgccgctagaggaaccttccaactcccactactcccacctccggctttcaccctgcacccggcgatgaagacgtcggcgaaacgcctactttccatgcctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctccaagacaccctcaaaaccgcctcattttttgttaaccgttttctctctctctctctctctgtctctctctctcttcctccgtccccccaccccgtgtcccaagaatt

SEQ ID NO: 80665 - DNA, 102 bp, Homo sapiens; identical to SEQ ID NO: 12812
  chr17:48042039-48042141
  hyper

SEQ ID NO: 80666 - DNA, 435 bp, Homo sapiens
  chr17:48042213-48042648
  hyper
cggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctaggg

SEQ ID NO: 80667 - DNA, 234 bp, Homo sapiens
  chr17:48042750-48042984
  hyper
cggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctagagccccgcggcgccgtatcccctccccc

SEQ ID NO: 80668 - DNA, 258 bp, Homo sapiens
  chr17:48046722-48046980
  hyper
gctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggc

SEQ ID NO: 80669 - DNA, 1787 bp, Homo sapiens
  chr17:48048796-48050583
  hyper
accaccccgttgagccgtagggagcagcgggcctggagggaggccttggggctccatgatcgcgacccgggcagatctcgtaacttgctggaactggggtagggaaaggcagctgtccgggaaggaacttggagggggtctgctgggagagttggggcgcggagggctatgcgaattcagcaaccgggtcggcctcagagactctgcgtccccgctcgaattgcgcagtccacgcagccagagaggcgcgggtgggctctgggctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaaggtggggggacgcgggcggacagaagccgctctctctcggctcaggtcggctggacagacccgcagggaatgcggcgaacgctgccctaagcgcccgggcattgcggctgctccatccgccctactcctcccattgcctgggacctctgcagcgtccccgtagagccgcgcaggttagggtggctggcttggaagaacagaaacccctcggcccaaccctcccctgtccctcagcattctagggctgggctgtcccgcggccgagattcctggagagctaggcgggccagagctgaccagatcccccgcggcggcaccgcagcgcgatccaggagtggccccgccgggctacgctgcgcgctcttggaacccgggtcaccttccctgccgccggaaccgctctgtgcgcgctgcccaacgaaggaaggggctgccccacgcagacccggcttctgggggtccctggaaacccaggcggccacggtgtggcgggggagacatggtcacttttcctgcagggtgcgcctgagcagaggggcagcccgttacagtaggcgaggccagggcaaacccggggtcactatcagcgctgcgagactggtattcaaggtcctctcagccgggcctctcacccaccccgctggccgcagccggaggctgccacgcggacaccgtctcaagcctctgagcattgctctgagcctctgcctgcaatgtccttcctctgtcatctctaggcctcggctcagccctggacctagcctttctgccccgccctaccccaagctggcgccaccgcccgtggctgaactccgacctcccaccgcaggcgccgcggtaccctggctgtggccctcggcgctttcttcctagggtcacaggacccatacgagtgggagctccctgggagcagaactgcgtcttgtatcacctggcgcggtgaacgtgggggttgaaacgctccacgcggaaggtagagggcaggggccaagggggcgatcctggtggctgcgctttttgctatttgctgccgacggcatgcagacgagatgcaaataagcttatgaaactgtccgtcctaccccctcgctccctcctcgccccctacaccgtgttgtgctgcccaccagactcggagaagccgcggctgtccccggaaccctccgagcggcgccctcaggcccccgccaaaaagctccgcaagccgaggaccatctactccagcctgcagctgcagcacctaaaccagcgtttccagcacacgcagtacctggcgc

SEQ ID NO: 80670 - DNA, 1051 bp, Homo sapiens
  chr17:48070654-48071705
  hyper
agagttccaggagcccgcagggcccttcagtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggcttcccattcaccatgcgcacctctgcttccggctcctccttcaccgacactgcggggaacgcaccgggcggaagagggggcggttcagcctcggcctgcgactcctgcgaccctccagggccccgccggacgcccctcgcttccgcccaccgactcgccgcgggattcccggccgcgcgctccgctgcccgcggcccaggggggagccgcggccccagagccagaactggccgcggcccacaacgcggcgctcccagctccgcgcccggccgccgcagcactgtccccggcgccagccgccgcctgcgccaggaccgcctcggcttcgctcacgacgccttcccggctcgcctcccagcctcggggctcctcgccgcccggctgctagccgcccccttcccagtcccatctcgccgtcggttgtttctctcgctccttcccgtccgccccccgccctttaaaaaagtttcattttagaatctctttagattttcagaaaagttgcaaggatagtgcagactttctttctttccctgtcccccttcttccccccttccttctctccttcctttcttgtttcttctgccctttctctcactgtctttccatacttccctcttgctgccttcacttttccctttttcagcttctctgcctctcggtggctgcttccctccgctttcccgcaacttccgtgggtccttctcattgccccctcacgactcctagtctccccatcccttatccaaaggagggcccctagagtttccagcccctgccgcctacccccaagccctctg

SEQ ID NO: 80671 - DNA, 74 bp, Homo sapiens
  chr17:48071806-48071880
  hyper
cgatcctcatccgggaccgcggcgcactgcgcacatcgcgccccaaatgcttgcacacccggggctggaaggtc

SEQ ID NO: 80672 - DNA, 88 bp, Homo sapiens
  chr17:48190266-48190354
  hypo
ttggcctcctgctctcggcgccggagcttctcccgctgccgcgcagccttctcctgggccttgcgctccttctcggcagctgctgcca

SEQ ID NO: 80673 - DNA, 277 bp, Homo sapiens
  chr17:48206298-48206575
  hyper
ctgaagaggagaaagcgacagagagaagtgcaactgggagaggccgggaagaggtggatgggaaaggagactagcggtcggggaggcagttgtggagccagagaggtggtccccccttcccatatcgccggccgtccactggccccaggcttggggtagtcctcaggagtcgggcaccccctcaaagcactgttggagatggggtgaggttggggacagggcacctactccactctcagagcccttctccccagtcagagcccggtggctagtttct

SEQ ID NO: 80674 - DNA, 30 bp, Homo sapiens
  chr17:48207718-48207748
  hyper
ggccagtgggccagtcgggggctcagacga

SEQ ID NO: 80675 - DNA, 30 bp, Homo sapiens
  chr17:48225911-48225941
  hyper
accagctcaccctcacgatctgcttccctc

SEQ ID NO: 80676 - DNA, 33 bp, Homo sapiens
  chr17:48239531-48239564
  hypo
tccagctctcctgaccgacgccccaactgggga

SEQ ID NO: 80677 - DNA, 39 bp, Homo sapiens
  chr17:48278705-48278744
  hyper
gcccccgggaccaagcgcaaggcgcgatatagagtatcc

SEQ ID NO: 80678 - DNA, 30 bp, Homo sapiens
  chr17:4841792-4841822
  hypo
gcccctccactcacccgccacagtgtgagg

SEQ ID NO: 80679 - DNA, 30 bp, Homo sapiens
  chr17:48503171-48503201
  hyper
ctttggcccccggctcgcaagtagcggggc

SEQ ID NO: 80680 - DNA, 30 bp, Homo sapiens
  chr17:48550296-48550326
  hypo
gatgatgcccaacatcgataaataacacca

SEQ ID NO: 80681 - DNA, 177 bp, Homo sapiens
  chr17:48585866-48586043
  hyper
aggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtc

SEQ ID NO: 80682 - DNA, 369 bp, Homo sapiens
  chr17:48611939-48612308
  hypo
taaacaagttgtggccgtggcattcccacagaaggcccacgacccgctggaaggaaagagatagcagacaaaaggtaggctgcgctgtgggccaggcactctccacctcgcccactcccacggtatcttattctctgggcccccaacaaaacctgccaaggcatgttttcaaagcgtggggctgctttgaactgagcccagcactggcggggctggggtggaaggagcgtggaatcgggtgcgagaggacagtctccttcagattcctgcttctggcagcctggggaccagttggggcacgggctgggatggagggtggagccgaaaggtgtttggtgggtgggggacagttcacgggtgaagtggagg

SEQ ID NO: 80683 - DNA, 30 bp, Homo sapiens
  chr17:48617944-48617974
  hypo
gaaggtggcctgagtcgcccacacctgcag

SEQ ID NO: 80684 - DNA, 195 bp, Homo sapiens
  chr17:48619096-48619291
  hyper
tcagagcctagcctccgccggaggagcccactcttcttcccaacttccacgacctcccggtgtagggctctgaaccccgggtcactcaaagccactctcgttctgcaggtctcagcgctccgtcccccaccaacccgttcggcgcgggcgagccgggcaggccgacgctaaaccagatgcgcaccggctcgccgg

SEQ ID NO: 80685 - DNA, 390 bp, Homo sapiens; identical to SEQ ID NO: 36652
  chr17:48619346-48619736
  hyper

SEQ ID NO: 80686 - DNA, 30 bp, Homo sapiens
  chr17:48620645-48620675
  hypo
ccacacaggaggaatcggaccccttctggg

SEQ ID NO: 80687 - DNA, 882 bp, Homo sapiens
  chr17:48636387-48637269
  hyper
gggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggt

SEQ ID NO: 80688 - DNA, 71 bp, Homo sapiens
  chr17:48637706-48637777
  hyper
gatgcctggggcctgcggccctacgccaggaccccgcgccgaatactctgattcttcgggctccctccaag

SEQ ID NO: 80689 - DNA, 103 bp, Homo sapiens
  chr17:48638942-48639045
  hyper
gggcagcgcggactccgaggcggaggggctgccgtacccggcgctggccccggtggttttcttctacttgagccaggacagccgcccgcggagctggtgtctc

SEQ ID NO: 80690 - DNA, 501 bp, Homo sapiens
  chr17:48639331-48639832
  hyper
aagagagctgtgccccgctggctcgcagctggacgccctccagatgtggtcaggggagggtcgtcatcctccagatgtgggaagcttcgggagcctgggagctgtactctgcccgcgccggttagcgagctgggtttggtttccgagtttggtggggggtgggtgggggcggtggggaggaagctgcggggacggaggaggggggaccgcaatctcctgggtttccctccttcccccgccccaaagtttgcggcggattctagggtctgatcccccaacctggtccttgaggctgaggtttttactgacctagaaggagatgttggggggcggggaccaggtcctggcccacctcaccccccacctcgcgggttggaggcacaacaaggagattccggcggcggctgatgtcaggggcgcagaatgagaacaagatgtggtggaggggagctgtctgcccccggagctgggagtggagcccctttccgctagagcccagtg

SEQ ID NO: 80691 - DNA, 449 bp, Homo sapiens
  chr17:48652975-48653424
  hypo
gaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 80692 - DNA, 35 bp, Homo sapiens
  chr17:48673781-48673816
  hypo
gcgccgtgcatgtctcgtgccgtggttgctggttc

SEQ ID NO: 80693 - DNA, 71 bp, Homo sapiens
  chr17:48678374-48678445
  hypo
cctccccctctcagccgttgcctccatgcctgggcaggttccgcctcctgtgtcaccggatcatcacccac

SEQ ID NO: 80694 - DNA, 88 bp, Homo sapiens
  chr17:48687158-48687246
  hypo
gagctgaggggaagccgcccctgaggggccctgcccagcgcacctggtccggccagtgaccaatgtcgtgtttcgttcttttagatct

SEQ ID NO: 80695 - DNA, 158 bp, Homo sapiens
  chr17:48712444-48712602
  hyper
acggagcccctgagacggcctgggcgcccgggagggggcgatgggctcgggagggaggttggctgcgccgcccggagccgggtcccacgcggtgtcggggacctgccctgctctgcccttcccggctgcagcactggggagcccgggaaagtgaggaa

SEQ ID NO: 80696 - DNA, 24 bp, Homo sapiens
  chr17:48799846-48799870
  hypo
gcgcccggccggctcctcttatgc

SEQ ID NO: 80697 - DNA, 105 bp, Homo sapiens
  chr17:48805065-48805170
  hypo
gagctggagaaaaatcggtgaatttggcaaattttaaatagtattgtagtgtgtatgtttttgttgggtggggtagtgtagataggtaggcaagaacttggtttt

SEQ ID NO: 80698 - DNA, 36 bp, Homo sapiens
  chr17:48846173-48846209
  hypo
atttaggggaacacacgttcttcttttaattcattt

SEQ ID NO: 80699 - DNA, 43 bp, Homo sapiens
  chr17:48911187-48911230
  hypo
tgtctggcttcattacggggactggcctcgaagggaagtttat

SEQ ID NO: 80700 - DNA, 30 bp, Homo sapiens
  chr17:4891311-4891341
  hyper
tctggggacccagcccgacttcattgtagc

SEQ ID NO: 80701 - DNA, 273 bp, Homo sapiens
  chr17:49008614-49008887
  hyper
agggcccgcctggctcgctgcggccgcttatcagagccggctgtggcgccggttacgtaaccgggcggctaatgctgttttacttgtcgatgaaacccaaattaaaagaggaaattattgtcctgatgctcaactcgcctaatccccatctgtctcctctctggtcccccgcgctgccgagcgctcgcatctaaaggtcttgaacgcgttccaggtttctaatttcgtttgcttatgcaaccaaaaatattatggccgcgtttcctgggggtg

SEQ ID NO: 80702 - DNA, 38 bp, Homo sapiens
  chr17:49012104-49012142
  hypo
tcacacatcaacactcgcgtacacgcactggggtgtgc

SEQ ID NO: 80703 - DNA, 30 bp, Homo sapiens
  chr17:49021785-49021815
  hyper
gggaggtggggctgtcggtgctccagggtc

SEQ ID NO: 80704 - DNA, 120 bp, Homo sapiens
  chr17:49229481-49229601
  hypo
cgcttgaacccggatggcggagtttgcaatgaaccgacatcgtgcaactgcgctccggcctgggcgccaaagcgatactcggtctcaaaaagaaaaaaaagaaaacaggagaataatgaa

SEQ ID NO: 80705 - DNA, 124 bp, Homo sapiens
  chr17:49462711-49462835
  hypo
ctggcgggatccatccgccatccttcccctcacatgggctcctctaggcccgctcccgcatccctttctgtcccctcccacaaccacagcgactcttcccataaacaaccgtgacctggtcatg

SEQ ID NO: 80706 - DNA, 27 bp, Homo sapiens
  chr17:4976841-4976868
  hypo
gtgtaataaagcagacggtgggccagg

SEQ ID NO: 80707 - DNA, 179 bp, Homo sapiens
  chr17:4981370-4981549
  hyper
gagagttaaaagggtcgcgcaaacggtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattc

SEQ ID NO: 80708 - DNA, 34 bp, Homo sapiens; identical to SEQ ID NO: 36347
  chr17:4981951-4981985
  hyper

SEQ ID NO: 80709 - DNA, 582 bp, Homo sapiens
  chr17:5000354-5000936
  hyper
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataagggaaggaggaaggtggcttgagggcagtgaccgagcggacagcggaagcccatttcaggagccccggtacccgagctcgggcccctttccaatcccccaggcgtccttcccatgtccttgtctcctagtcctgggaatccacggccactccactctcctgcagtaccgcggacaagaacaccatgtactcttcacaggcaggtgtcttctggtggacccaactctgttggtacttgtcgtctccaaaaagtccccaaatgcgctagaggccagccagcccggtatccgagaggtaagagccc

SEQ ID NO: 80710 - DNA, 69 bp, Homo sapiens
  chr17:5001149-5001218
  hyper
gggcgggctctggggcgtccgcggaggctcccgcgtgcgtgtgcggggtggggtcggggtggcagttgg

SEQ ID NO: 80711 - DNA, 40 bp, Homo sapiens
  chr17:5014692-5014732
  hyper
aagacaaaggaggcgcgaggaaaaacgcggagctcgcgtc

SEQ ID NO: 80712 - DNA, 40 bp, Homo sapiens
  chr17:50234619-50234659
  hyper
ggtactctccagtcccgcatcctcccgcagtctcttgaaa

SEQ ID NO: 80713 - DNA, 99 bp, Homo sapiens
  chr17:50235160-50235259
  hyper
tccaagtgcatcactcgacgggaaaacggggggaaggggggagcccgacacggcacacacacatacacactcgcacacacttccgagcgagtgcacact

SEQ ID NO: 80714 - DNA, 751 bp, Homo sapiens
  chr17:50235728-50236479
  hyper
cctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 80715 - DNA, 60 bp, Homo sapiens; identical to SEQ ID NO: 36657
  chr17:50236690-50236750
  hyper

SEQ ID NO: 80716 - DNA, 30 bp, Homo sapiens; identical to SEQ ID NO: 36658
  chr17:50237251-50237281
  hyper

SEQ ID NO: 80717 - DNA, 30 bp, Homo sapiens
  chr17:5039277-5039307
  hypo
gtggccaggtgatctcggctttcagccaag

SEQ ID NO: 80718 - DNA, 48 bp, Homo sapiens
  chr17:5094851-5094899
  hyper
gggaatggggcacgccgagaccaagaagccgaccgagagcaagaaggc

SEQ ID NO: 80719 - DNA, 30 bp, Homo sapiens; identical to SEQ ID NO: 45112
  chr17:51321147-51321177
  hypo

SEQ ID NO: 80720 - DNA, 21 bp, Homo sapiens
  chr17:51787080-51787101
  hypo
aggcacggtggctcacgcctg

SEQ ID NO: 80721 - DNA, 178 bp, Homo sapiens
  chr17:51900906-51901084
  hypo
agctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaacctta

SEQ ID NO: 80722 - DNA, 50 bp, Homo sapiens
  chr17:52978290-52978340
  hyper
aggcgcggggagagacgcccaggcaggcaggggaccgtgggatcctttcc

SEQ ID NO: 80723 - DNA, 20 bp, Homo sapiens
  chr17:5320631-5320651
  hypo
aagtaaatagccaggcgtgg

SEQ ID NO: 80724 - DNA, 120 bp, Homo sapiens; identical to SEQ ID NO: 44976
  chr17:5320771-5320891
  hypo

SEQ ID NO: 80725 - DNA, 270 bp, Homo sapiens
  chr17:53341212-53341482
  hyper
tcacaaaggcctttacgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggc

SEQ ID NO: 80726 - DNA, 846 bp, Homo sapiens
  chr17:53342183-53343029
  hyper
gtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcac

SEQ ID NO: 80727 - DNA, 627 bp, Homo sapiens
  chr17:53343030-53343657
  hyper
cccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctc

SEQ ID NO: 80728 - DNA, 40 bp, Homo sapiens
  chr17:53479136-53479176
  hypo
gaaaatgttttctgccggccgggcacggtggctcatgcct

SEQ ID NO: 80729 - DNA, 35 bp, Homo sapiens
  chr17:536397-536432
  hypo
ccccacgatcaatcacgccccgcaatggatcaggc

SEQ ID NO: 80730 - DNA, 87 bp, Homo sapiens
  chr17:53916938-53917025
  hypo
aactggggtgcaggacgagtgtcctcataagaagtcaaaggtttggtgataaacaacaactggccgggcgcggtggctcacgcctgt

SEQ ID NO: 80731 - DNA, 357 bp, Homo sapiens; identical to SEQ ID NO: 36663
  chr17:53922649-53923006
  hyper

SEQ ID NO: 80732 - DNA, 28 bp, Homo sapiens
  chr17:54150661-54150689
  hypo
cttaacatcctaacgttttattatgaaa

SEQ ID NO: 80733 - DNA, 22 bp, Homo sapiens
  chr17:54266818-54266840
  hypo
ccgcgcccggcctgccctgact

SEQ ID NO: 80734 - DNA, 157 bp, Homo sapiens
  chr17:5436596-5436753
  hypo
aaaggggccaggcaccgtggctcttgcctgcaatctcagcaattgggaagatcttgctcacgtccaggagtttgagattagcctgagcaacatgggaagccgccctctctacagaaaaaagaaaaatatcagccaggcatggtggtgagcatctgca

SEQ ID NO: 80735 - DNA, 30 bp, Homo sapiens; identical to SEQ ID NO: 16216
  chr17:54473510-54473540
  hypo

SEQ ID NO: 80736 - DNA, 52 bp, Homo sapiens
  chr17:54588100-54588152
  hypo
atagcctgaccctcacggggttcacacccaagaaccacgccaagactgtgtc

SEQ ID NO: 80737 - DNA, 124 bp, Homo sapiens
  chr17:54670716-54670840
  hyper
cctgccaagcgccaccgccgccgccaccgccgctgccgccgccgccgccgccgcctgtgagctccggcgggcagccggactgtcggcttcccggggcatctgggtccggcggggcacagccctg

SEQ ID NO: 80738 - DNA, 1166 bp, Homo sapiens
  chr17:54671198-54672364
  hyper
ccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccac

SEQ ID NO: 80739 - DNA, 183 bp, Homo sapiens
  chr17:54673501-54673684
  hyper
aaccctttgcatgcccggaagctacggtggtacgaactgaggcaatcccttggaatcaacaaggctcacagcctccgggatcttgcaggtccgagccccgaaatcccaggccctcggccggaggtgctggggatatcagggagatttgacactggcctcccctctccccggggacctaaggaa

SEQ ID NO: 80740 - DNA, 155 bp, Homo sapiens; identical to SEQ ID NO: 36666
  chr17:54673918-54674073
  hyper

SEQ ID NO: 80741 - DNA, 399 bp, Homo sapiens; identical to SEQ ID NO: 36667
  chr17:54674738-54675137
  hyper

SEQ ID NO: 80742 - DNA, 171 bp, Homo sapiens; identical to SEQ ID NO: 36668
  chr17:54675138-54675309
  hyper

SEQ ID NO: 80743 - DNA, 42 bp, Homo sapiens
  chr17:54755949-54755991
  hyper
taaccccccaggaagcgctccacgtgctgctggtgcgagcgc

SEQ ID NO: 80744 - DNA, 136 bp, Homo sapiens
  chr17:54756259-54756395
  hyper
ctagctggagcccagcgttggagtcataaagaagagctggcaggagagtgatgtacagccctgggccctcccgagtgactggcgttaacctccaacggagagacgctcaccccgtttacgacggagccctttgttt

SEQ ID NO: 80745 - DNA, 95 bp, Homo sapiens
  chr17:54911779-54911874
  hyper
gttgcctggcctgaacgcccggcctttcggtggagggcagcttgcccctgtatgttgcgcccttccgtgggtcagaccggcggcaaggtgaggcg

SEQ ID NO: 80746 - DNA, 32 bp, Homo sapiens
  chr17:55037248-55037280
  hypo
tcatcagaagcatcccgggaaggatgctcgtt

SEQ ID NO: 80747 - DNA, 30 bp, Homo sapiens
  chr17:55139041-55139071
  hypo
ttgttcattttcatacgattagtaattaaa

SEQ ID NO: 80748 - DNA, 82 bp, Homo sapiens
  chr17:55184753-55184835
  hypo
acttggttcctcaaccggtgaccttccccagtgagcccttcccaaggaactagcgccaagttgggctcgctgattaacatta

SEQ ID NO: 80749 - DNA, 181 bp, Homo sapiens; identical to SEQ ID NO: 45118
  chr17:55364048-55364229
  hypo

SEQ ID NO: 80750 - DNA, 30 bp, Homo sapiens
  chr17:55568360-55568390
  hypo
acctggccagggttccggggtggggaggac

SEQ ID NO: 80751 - DNA, 180 bp, Homo sapiens
  chr17:56024224-56024404
  hyper
tccccaactccatctcggacgcatcttcttcctctctctgctcaacacaggagttccctgttcacacaccttgccattggctgacacagccaatggtgaaactcccccagctgaccctccctggagctcactagctctctcccagctgtgggtacagcctgaaaccgaaactaatctcag

SEQ ID NO: 80752 - DNA, 79 bp, Homo sapiens
  chr17:56031530-56031609
  hypo
gtggctcaggtgctgcgggatcacccagggaaggctcattcctctcgctacaagacgctgactgcggatcaggtgggga

SEQ ID NO: 80753 - DNA, 20 bp, Homo sapiens
  chr17:56092600-56092620
  hypo
taagagctgaaatcacgaga

SEQ ID NO: 80754 - DNA, 569 bp, Homo sapiens; identical to SEQ ID NO: 36671
  chr17:56234271-56234840
  hyper

SEQ ID NO: 80755 - DNA, 186 bp, Homo sapiens
  chr17:56326821-56327007
  hyper
gcgtcccctccgcctcgagcagaggctccttcccccatggggtcctgggctttggagccccggagccggcctgccgaagctcagcgaggatcgtgctggtttcaggaggaagcctgcgctgggcgccgccaacagggctctggcgcgctggctgcccgcggagtacgaggacgggctctccctgcc

SEQ ID NO: 80756 - DNA, 79 bp, Homo sapiens
  chr17:56327222-56327301
  hyper
cccggagcccggccacgtggcggtcacgttctggccgccgcaggccagataccctggggtctcccgggcagatggcctc

SEQ ID NO: 80757 - DNA, 30 bp, Homo sapiens
  chr17:56435300-56435330
  hypo
gttagagagccgccccgaaggggctgctga

SEQ ID NO: 80758 - DNA, 30 bp, Homo sapiens
  chr17:56680534-56680564
  hypo
tacacatgggctccccgctggcaggggagc

SEQ ID NO: 80759 - DNA, 30 bp, Homo sapiens
  chr17:56742978-56743008
  hypo
acccacaactcattgcgtttacctcactaa

SEQ ID NO: 80760 - DNA, 30 bp, Homo sapiens
  chr17:56781879-56781909
  hypo
agtaagaatcctgttcggtcagtttagcaa

SEQ ID NO: 80761 - DNA, 1055 bp, Homo sapiens
  chr17:56832946-56834001
  hyper
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcggctgagagctgccca

SEQ ID NO: 80762 - DNA, 362 bp, Homo sapiens
  chr17:56834019-56834381
  hyper
cgcccgcctcggcccccacgcctcctacccggccttgaagccgctctcctgagccccggcgccctcccgccgggcccgggcccctcatcccctttcacctcggcccccagcttctagctccacttcacgcaacctttccctttcctgcctggaaaggtccttcctcccaggcttgagctccctcttcttcccagatcccttctttctccgggaggtttcctcccaccccagtctgtcttttcccgggctgagtgccttgttgtttggcggcagagacgcgactcctttctagactgagctgcgaggtgcctcctgcgtaactgcaacaatgatggttataccggccccgtatccagatgaga

SEQ ID NO: 80763 - DNA, 102 bp, Homo sapiens; identical to SEQ ID NO: 45120
  chr17:57297027-57297129
  hypo

SEQ ID NO: 80764 - DNA, 97 bp, Homo sapiens
  chr17:57299480-57299577
  hypo
attggaaccagggaccgacttttagtattcaagttgctgtcacagaagcaattttcttttttctttttgtgtttttgtttgtttgtttttttgtttg

SEQ ID NO: 80765 - DNA, 22 bp, Homo sapiens
  chr17:57787544-57787566
  hypo
cagactccgtctcaaaaaaaaa

SEQ ID NO: 80766 - DNA, 30 bp, Homo sapiens
  chr17:57866235-57866265
  hypo
tgtttgcagatatggcggtggaaaaagcac

SEQ ID NO: 80767 - DNA, 26 bp, Homo sapiens
  chr17:57879973-57879999
  hypo
tgtagtgcagtggcacgatctctgct

SEQ ID NO: 80768 - DNA, 30 bp, Homo sapiens; identical to SEQ ID NO: 45121
  chr17:57881555-57881585
  hypo

SEQ ID NO: 80769 - DNA, 47 bp, Homo sapiens
  chr17:58212262-58212309
  hyper
cacccaagccagcaccgtggctggaaagcttacgtataggataaggg

SEQ ID NO: 80770 - DNA, 735 bp, Homo sapiens
  chr17:58212587-58213322
  hyper
tctctaagcacagggcggtggcgaaagggaagggctgcagggtggagtccggcaccaagacctcccggcccggcttctagcagcacacggacgcttgagatgatttcttctgaaaacgggcagtggttgaaaaccactgcttcaaaacacagactggaggagtggtaaatactaacgaggagttttagcaatggactctgttaacagagtctggtcgcctgagaagggcctcggaggactggccaggttggagaacgatttcaactgcgtactggacgacacacagaagactgcggggagccttagcccctacccggcctgcagtgctctctggggcacacggcagccccacgacgcctttgggtttcttcgagcgctactcgcacgcaccagcgcccacacagctgcaacgccaaacgcccgccagcaccttagggccgcgggagtcccttccccaggcccgccccacacgccggccttttctgccgcttcccaagccggagccaatcagcgctcagcagcgaccggcagggacgaccaatcgacttatcctgcgttgtgctaaagacctagaaatcgagcgtggtacattcgatcgacggaacgtctgggccctagtgctaagttgggtgactgttcggtggttgtctcggggggttgcaggaagatcctgtttccttggcgtagaaggagaggttgaccccgaagagttaagattctcgaagcacactattt

SEQ ID NO: 80771 - DNA, 40 bp, Homo sapiens
  chr17:58216263-58216303
  hyper
actcaggagatggggcgttgtgtataggcaagtcgctaac

SEQ ID NO: 80772 - DNA, 272 bp, Homo sapiens; identical to SEQ ID NO: 36678
  chr17:58216565-58216837
  hyper

SEQ ID NO: 80773 - DNA, 434 bp, Homo sapiens; identical to SEQ ID NO: 36679
  chr17:58216865-58217299
  hyper

SEQ ID NO: 80774 - DNA, 268 bp, Homo sapiens; identical to SEQ ID NO: 36680
  chr17:58217356-58217624
  hyper

SEQ ID NO: 80775 - DNA, 446 bp, Homo sapiens
  chr17:58218611-58219057
  hyper
tgagtgtgcagccagcgcccaattcagacggcgccccaggccaaggctggcccgcttagggaccgcgctcgggctggacgtcgcgctcagcgcgcagggcccccatggacgtcgcgccgctgacctagctgtcagacatcgccacgaggagttggcaggctcgggaggccgaaacgctgtgctcacctcgagcactgccaggctgctggagaggctttccggggcacagaagctgcagcggcgcggggcggtgggctgtgagcgagcatatgtaggggagcgtttcccgcgagaaagcagaacctgcgccagccgagggccctagggctgctggtaggaggactgttctctatcgtccagctgctcccgacctcttctctgaactggccctgctctggggaacagcgccctgcttctttgtgcgacgatcacgcttgactcattgg

SEQ ID NO: 80776 - DNA, 294 bp, Homo sapiens; identical to SEQ ID NO: 12837
  chr17:58227104-58227398
  hyper

SEQ ID NO: 80777 - DNA, 325 bp, Homo sapiens
  chr17:58228072-58228397
  hyper
caacgcacgccttcttttctcacccagcctcctccgtctgcccgtgggtttccgtccgtcccgctgggactcagcgctgggtgactgccccgcggccagagcaagggcggtctggcagggtcctggaagccgcgcttcccacacgggttccttgcccctgagggtcgcaagctcccctggcctccctaacctccagcgctgaattgggagcctggcgggggcggggggtgggggacccggagccccaaggcctctgcggagccggtctttccggacagggtgattttcgtttaaagattaatggtgaagccgagctcttaattat

SEQ ID NO: 80778 - DNA, 88 bp, Homo sapiens
  chr17:58471337-58471425
  hypo
ccccaccaatatttcgtgtttttctactcacctttcctggcaaaccagatcagcagcgtggcattagtcacagcgctgccctttccag

SEQ ID NO: 80779 - DNA, 230 bp, Homo sapiens
  chr17:58498747-58498977
  hyper
cccctctcctgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgcc

SEQ ID NO: 80780 - DNA, 367 bp, Homo sapiens; identical to SEQ ID NO: 36685
  chr17:58498978-58499345
  hyper

SEQ ID NO: 80781 - DNA, 30 bp, Homo sapiens
  chr17:58896180-58896210
  hypo
acatcttaggtataccgtttatgctgacag

SEQ ID NO: 80782 - DNA, 30 bp, Homo sapiens
  chr17:59277972-59278002
  hypo
ttttgattatcaatgcgggtggtagtgagg

SEQ ID NO: 80783 - DNA, 30 bp, Homo sapiens
  chr17:59380675-59380705
  hypo
atgtaaacaagcacccgtgtttggggatac

SEQ ID NO: 80784 - DNA, 128 bp, Homo sapiens
  chr17:59467426-59467554
  hyper
ttttcttgcgcctgccggtgctcttctcccgcccgcctggccctgctgtcagcgccccctagtgccgggccggccgcgcatgagggcggtgggacagatcgcccacaactcctcggcttgcttttggg

SEQ ID NO: 80785 - DNA, 341 bp, Homo sapiens
  chr17:59473906-59474247
  hyper
cgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgccc

SEQ ID NO: 80786 - DNA, 403 bp, Homo sapiens; identical to SEQ ID NO: 4476
  chr17:59474741-59475144
  hyper

SEQ ID NO: 80787 - DNA, 3321 bp, Homo sapiens
  chr17:59475357-59478678
  hyper
atctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcagctcggagtcaaagattcgttctggccagagaggaggtactaagagaggtgcgacctagccaagaacgaggtcgtggagaaaaccctgtgggggcggcgctcacatatgcggtgatgaggagttgtgagggccctggggtcggccccgaaaagtagggataacggtcgcagaggccatactgcttccgccggtcccgaatccgcactgccaggagagatccggccttcaaacgctgctcccaacgttcaacaacgaagtgccctgcgaccggtgtgcgcagtgggcgggcgcctgcatgggtcaatgttggatgtacgcgcccaccacgcggttgtacgggtgggaatgtcacccgtggctagtgcatgctctgtcttttccttcagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacacacacacacacacacacacacacacacacacacacacaccatcacttcatgggggggaaactgaggctgccggaagacagaaaacgaagactgatcacagaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccgaggatccgctcctcccggccgctggaaagctcagggcggggcccgggcctgcggagaactccaggttccttccgagtcttccggtgaaggcgggcgcgggtagggggtccccgcgtttccccagcgcaaggccgcgtcccgctcccgcccgcgccggccccagcagggctcggccatggctccactcaccagctcccgccacctgggatccgctcccggacctcggccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcctccgaatgaaataaaacgaaaacatactgctaaagaatagccccaaccgttctgagtcccagcgcagaggaggccccgcggcttggccctggcggtctcctccgccccgcgctctcgctcttctgcgtccgggtccgtctccgagctcgggggaaattcagcctctctcagactctgctccgaccccgaagcccctagtgggacctgggcccagctaaccccacgctggttgctcggttcctggcagcgagccccgggtcagccgagccctccgcctcaccgggctgggagccctttctccaccgcgggcatccgagccctggacgcatccgccgccccaggccttaaagcctgaagaaagccacagccccggcccctccacccttcgactcagccaccgagaatccaggcctcgggttcaccctcttcccccgaactgcacggccaggatgtcttatcaggctctgtagcccagttcccaatacaaacaccctccagatttatttctgggagcttccgtcccaagtgggta

SEQ ID NO: 80788 - DNA, 32 bp, Homo sapiens
  chr17:59483112-59483144
  hyper
aggcgggctgggtcccgcggccagcgcagcaa

SEQ ID NO: 80789 - DNA, 324 bp, Homo sapiens
  chr17:59488100-59488424
  hyper
cctgcctcagacctgcgggcaggtccgggaacccgacagggacagagaagcccgttttccagcctaaatagaagctcgtgggcagcgcgtttgctggaggtcgctttgggctgaaacgcctctcatactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggc

SEQ ID NO: 80790 - DNA, 478 bp, Homo sapiens
  chr17:59488634-59489112
  hyper
cggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtgtgagtgcaggggctccgagagacccctagcggctaagccgcccggatcccaaggcccaggggacctcatttcctctcgggttaatcggaatcttccgagccctcaagccc

SEQ ID NO: 80791 - DNA, 172 bp, Homo sapiens
  chr17:59490094-59490266
  hyper
ggagggcttgaggctcggggtggggccttctcccctgctgccagaaccgcccggcagcgccagctcggcgaccttccaggctgctgcagaccccagcttgtcctcttctgcgcgcccgcggggctgggccctcgcgttctctctgcgggaagtgagccgccggcctccggcc

SEQ ID NO: 80792 - DNA, 275 bp, Homo sapiens; identical to SEQ ID NO: 1315
  chr17:59528876-59529151
  hyper

SEQ ID NO: 80793 - DNA, 12 bp, Homo sapiens
  chr17:59529253-59529265
  hyper
cgacctcgggac

SEQ ID NO: 80794 - DNA, 509 bp, Homo sapiens; identical to SEQ ID NO: 36697
  chr17:59529843-59530352
  hyper

SEQ ID NO: 80795 - DNA, 351 bp, Homo sapiens; identical to SEQ ID NO: 36698
  chr17:59531667-59532018
  hyper

SEQ ID NO: 80796 - DNA, 89 bp, Homo sapiens
  chr17:59532269-59532358
  hyper
cgatcccgccggggccctagatatagttggacccagcgcgctggccggagcgggcagctaccctactggcgcagcggccctgtgtgggg

SEQ ID NO: 80797 - DNA, 9 bp, Homo sapiens
  chr17:59533759-59533768
  hyper
acgaagtcc

SEQ ID NO: 80798 - DNA, 532 bp, Homo sapiens
  chr17:59533874-59534406
  hyper
cgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgc

SEQ ID NO: 80799 - DNA, 711 bp, Homo sapiens
  chr17:59534556-59535267
  hyper
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 80800 - DNA, 37 bp, Homo sapiens
  chr17:59535526-59535563
  hyper
gtgttgttgggggagcggctctcggtggctgccagaa

SEQ ID NO: 80801 - DNA, 728 bp, Homo sapiens
  chr17:59539215-59539943
  hyper
gtccccagggacctccgagaaagtcggggctgcagcggggttggggcttgggggaccctccaggtggagagaatctaggggtatcccctagtctctgtccctttccccaggaaaggggctgagagtaagcgccttgaatttggccaccgctttggccggggagctcccgcggctctcgcagcgcagctagaacttgcgtgttccctcagcagtgagttcgcagttacgggtttgttgccagaattaaaaaagccccaaacccttgccccgcgccccgcgcgcctccaacaccgagaaacgtccgaggaagcttatcttagcagttcattctaaagccatttccgagtatgaatagataaaggctccagctccgcaccctttcagagcctgtttcatgatcagaggagaagccccgggctttcatctcctcccgggccggcgagcaggcggcttgtttattcccctggcggagccgtttccgcgtgtgccgtggggagggcgggggagcccccatctgtctgggggcgcgggagcccgacggcgcgaggggaactgggggagcatggagagggcgcttggggcgcggagagaaggtgcggggcacgtggaaagcgtgccgaggggctgggaagagggagggacaggaggacggggtgggagcagggagagggtagggggcatagggagagggtgcagggaggggagagggggagcgcgcaaggaggggg

SEQ ID NO: 80802 - DNA, 971 bp, Homo sapiens
  chr17:5973275-5974246
  hyper
tgggaagcagtgattcgggatgtgtgtgtcaggcagtgtgcggctgtcgctgtgagtctgcatgggagagtggcggcgtgctctcctctgcgcggcagtgccccgtgtgtttgtgggtctgtgtctgggtgtgagcgtcatggtgcgtgtgttagagcccgtggggccccggtgaaaggctgtggctctgggtgactggtgtgtgtgtgtgtgtgtgtgtgtatcagagtgggtggcggcgtctctgctcggcagtggcgcgtgtggcccgccccgcgcgcgtgttctcgcgggccggggcagggcgtgggccccctccggcggagccgcgacccctcccccgggcggcgggaggtgcgcaccggcgcctctaggacccggcggcggccggccgctgtccccgggccgcgcgagtgagcatgtgcagagcccggcgcccgctcgcccgcccgctgcccgccccggctccgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgctccggctgcagggcgggcttgccgggggcaccttcccgggggcccggggcggctcggccggggcaggggagagtgagcgggtgcgtgcaggggttgtgggggggcgggggcggcgctcggcgcggccgggatggggtgggggtgcgcgagg

SEQ ID NO: 80803 - DNA, 28 bp, Homo sapiens
  chr17:5974297-5974325
  hyper
cgggagggcgctgcggttggtcccgggg

SEQ ID NO: 80804 - DNA, 30 bp, Homo sapiens
  chr17:60214776-60214806
  hypo
gatacggctggatgacggggacgcccaggg

SEQ ID NO: 80805 - DNA, 158 bp, Homo sapiens
  chr17:60216617-60216775
  hypo
gggtacagtgagaaccggccctcgtacacctggcgctctaggcggttcttggtctcccgtagctcccggcacagtgctttctcccattggtcccgcagggtcttcagggtcttccgcgcgtgcgtgacctccttgcttggcaacgtgggcttctccac

SEQ ID NO: 80806 - DNA, 41 bp, Homo sapiens; identical to SEQ ID NO: 45124
  chr17:60221577-60221618
  hypo

SEQ ID NO: 80807 - DNA, 195 bp, Homo sapiens
  chr17:6023680-6023875
  hypo
ggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagccctt

SEQ ID NO: 80808 - DNA, 30 bp, Homo sapiens; identical to SEQ ID NO: 45125
  chr17:60242060-60242090
  hypo

SEQ ID NO: 80809 - DNA, 21 bp, Homo sapiens
  chr17:60499390-60499411
  hypo
agactccgtctcaaaaataaa

SEQ ID NO: 80810 - DNA, 32 bp, Homo sapiens
  chr17:60669597-60669629
  hypo
gcacgagccactgcgcccggccagaactacat

SEQ ID NO: 80811 - DNA, 42 bp, Homo sapiens
  chr17:60670437-60670479
  hypo
ctgtgtggcccagttcctaacaaggcacggacctgtactggg

SEQ ID NO: 80812 - DNA, 70 bp, Homo sapiens
  chr17:60704531-60704601
  hyper
gctgctggagacgcccgcagaaagaggcgggatggcggggcggatgctggcggcccgggtctggccacct

SEQ ID NO: 80813 - DNA, 30 bp, Homo sapiens
  chr17:60705143-60705173
  hyper
actgagcgccgcgctcggggatggggcccg

SEQ ID NO: 80814 - DNA, 387 bp, Homo sapiens
  chr17:60705569-60705956
  hyper
gctcttgaggacccccgcgcaccgcgctcccggaccacccggcgccggcccgtcctcggcaggggacctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttgcgtagcgtgggcagctctgg

SEQ ID NO: 80815 - DNA, 30 bp, Homo sapiens
  chr17:6070721-6070751
  hypo
tgccgttcccagcctcgttaacctccctaa

SEQ ID NO: 80816 - DNA, 30 bp, Homo sapiens
  chr17:60739876-60739906
  hypo
attatctcatttcatcgttaccagagtctt

SEQ ID NO: 80817 - DNA, 84 bp, Homo sapiens
  chr17:60743917-60744001
  hypo
gcgagcagcagggtgcggatctgctgagcatcacggagatccacgagcagacctacatcaacggtgagccggggcctgatgcct

SEQ ID NO: 80818 - DNA, 156 bp, Homo sapiens
  chr17:60744464-60744620
  hypo
cacccctgtgggcagcgggcaccagcgcacccagcagcctggacggggaggccggggcggggctggtactggttactgggtagaaggttcaaggcgacgtgcacccaggttagaaagcgcggaggaccccgtggtctggggcggagctggagctga

SEQ ID NO: 80819 - DNA, 42 bp, Homo sapiens
  chr17:60747365-60747407
  hypo
ctgaaggaaggggcccgctgggaggcccgggtgtgggcatgc

SEQ ID NO: 80820 - DNA, 30 bp, Homo sapiens
  chr17:60754622-60754652
  hypo
ccttcagggtacagccgtgggggctgcgtg

SEQ ID NO: 80821 - DNA, 167 bp, Homo sapiens
  chr17:60765906-60766073
  hypo
ttggcctccatgcctcgcagagggacttccagtgggtggagcaggagcctttgatgtatgccaactgggcacctggggagccctctggccctagccctgctcccagtggcaacaaaccggtgaggatgccctccctgttcccctccgcaccgcgctgccctaagcct

SEQ ID NO: 80822 - DNA, 173 bp, Homo sapiens
  chr17:60766934-60767107
  hypo
gctctcctacctcaacggcaccttccggctgcttcagaagccgctgcgctggcacgatgccctcctgctgtgtgagagccgcaatgccagcctggcctacgtgcccgacccctacacccaggccttcctcacgcaggctgcccgagggctgcgcacgccgctctggattgggc

SEQ ID NO: 80823 - DNA, 91 bp, Homo sapiens
  chr17:60843863-60843954
  hypo
aaaagaaaagaaaagaaaaaaagaacgttaaaatgcggtgtttaatagtttaacagcacattgagattgcccttgacgtaggtgtctttca

SEQ ID NO: 80824 - DNA, 234 bp, Homo sapiens; identical to SEQ ID NO: 45129
  chr17:60856637-60856871
  hypo

SEQ ID NO: 80825 - DNA, 30 bp, Homo sapiens
  chr17:60869374-60869404
  hypo
tgtggcaaaactggccgagggcagtcttga

SEQ ID NO: 80826 - DNA, 43 bp, Homo sapiens
  chr17:60885448-60885491
  hyper
cccttcctcccctgccggggctacaggggtcgaggggctgggc

SEQ ID NO: 80827 - DNA, 56 bp, Homo sapiens
  chr17:60885492-60885548
  hyper
ggcgggccggtccagggcgcaggagccgcccattaattgcgcggggacggccctga

SEQ ID NO: 80828 - DNA, 30 bp, Homo sapiens
  chr17:61151401-61151431
  hypo
aatttcaaaaaataacgatagatatttctt

SEQ ID NO: 80829 - DNA, 85 bp, Homo sapiens
  chr17:6120251-6120336
  hypo
gacggcactggcaaacgcttagttaccaccatcctatattcataaacatgtatacccttttcgcacaaataggttcttttttttt

SEQ ID NO: 80830 - DNA, 107 bp, Homo sapiens
  chr17:61553987-61554094
  hyper
gatcagccccatccccgccgcacgagcggcgcctgcggacagctcctggggccccggccttgtcactccggaggcgggaggctccggggggtcgggctgggaagatc

SEQ ID NO: 80831 - DNA, 87 bp, Homo sapiens
  chr17:61580782-61580869
  hypo
gcctgtgagaatggccgtcctcagcttcacgctcgaataaacctgttaaactggattctgatcttttttattatttcaggttgacag

SEQ ID NO: 80832 - DNA, 87 bp, Homo sapiens
  chr17:61580929-61581016
  hypo
ggaggattgcccgatcatatggtaattctatgcttcattttttttgaggacccaccagactgttttccgcagcggctctgccatttt

SEQ ID NO: 80833 - DNA, 30 bp, Homo sapiens
  chr17:61586953-61586983
  hypo
tcttcacctccttggcgctgccacctgccc

SEQ ID NO: 80834 - DNA, 106 bp, Homo sapiens
  chr17:61600692-61600798
  hyper
ggacgctgctgagcccgaggacagacggagacgccgggagccagtggcgcctgtggctccgggcaggggccgcggccgaaagatgccggtccgcaggggccacgtc

SEQ ID NO: 80835 - DNA, 66 bp, Homo sapiens; identical to SEQ ID NO: 45132
  chr17:61607855-61607921
  hypo

SEQ ID NO: 80836 - DNA, 30 bp, Homo sapiens
  chr17:61611741-61611771
  hypo
gcacagcactgggtgcggagagtatctggc

SEQ ID NO: 80837 - DNA, 33 bp, Homo sapiens
  chr17:61616015-61616048
  hyper
catcctaggtgggtccggcggagtggaccaggc

SEQ ID NO: 80838 - DNA, 26 bp, Homo sapiens
  chr17:61677513-61677539
  hypo
gccaccgcgcccggctgtcctgcttc

SEQ ID NO: 80839 - DNA, 37 bp, Homo sapiens; identical to SEQ ID NO: 44939
  chr17:616989-617026
  hypo

SEQ ID NO: 80840 - DNA, 202 bp, Homo sapiens
  chr17:61777872-61778074
  hyper
ctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccc

SEQ ID NO: 80841 - DNA, 15 bp, Homo sapiens
  chr17:61778234-61778249
  hyper
ggtatgcgtggttcc

SEQ ID NO: 80842 - DNA, 160 bp, Homo sapiens; identical to SEQ ID NO: 45134
  chr17:61817857-61818017
  hypo

SEQ ID NO: 80843 - DNA, 89 bp, Homo sapiens
  chr17:61847615-61847704
  hypo
agccaccgtgcccggactaatttttttttttctgtagtgtacttttgtcactagagaagaggcattgcagactgcggaacaggtttggc

SEQ ID NO: 80844 - DNA, 189 bp, Homo sapiens
  chr17:61926136-61926325
  hyper
tttcaaaacaaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggc

SEQ ID NO: 80845 - DNA, 118 bp, Homo sapiens; identical to SEQ ID NO: 36709
  chr17:61926507-61926625
  hyper

SEQ ID NO: 80846 - DNA, 73 bp, Homo sapiens
  chr17:62020120-62020193
  hypo
gaggatgggtcttcccgagtgcctcagctcagtgctgccctgccggtccagcccgccccgctcacccacaatg

SEQ ID NO: 80847 - DNA, 30 bp, Homo sapiens
  chr17:62022052-62022082
  hypo
agttgtcaatgatgacgccaatgaagaggt

SEQ ID NO: 80848 - DNA, 144 bp, Homo sapiens
  chr17:62029028-62029172
  hypo
cctctccagcctccccggccccgtcagcctccccgaggctgagcatgatgtccttggggctcaggatcttgccatgcagcagccccaggaggaaggccttggcaaagccgatgcccaacttgatgcgcccgatggcaatctgca

SEQ ID NO: 80849 - DNA, 30 bp, Homo sapiens
  chr17:62032715-62032745
  hypo
ccagcactgccctgccgcacgcctgcaaca

SEQ ID NO: 80850 - DNA, 23 bp, Homo sapiens
  chr17:62054825-62054848
  hypo
agcaagaccgtgtctctaaaaat

SEQ ID NO: 80851 - DNA, 48 bp, Homo sapiens
  chr17:62066209-62066257
  hypo
gcagagcaaaggagccgccagcaccccccaccccggcctcctgccgca

SEQ ID NO: 80852 - DNA, 92 bp, Homo sapiens
  chr17:62221901-62221993
  hypo
taaatgttgagataacgaaagttaaaacagcaacaaaaataaatagagactactaaacacttgtcaaagtcattattgctttggattaaaga

SEQ ID NO: 80853 - DNA, 30 bp, Homo sapiens
  chr17:62773492-62773522
  hyper
ttcgtctgggcatcccggactcagtcctgg

SEQ ID NO: 80854 - DNA, 54 bp, Homo sapiens; identical to SEQ ID NO: 36710
  chr17:62776217-62776271
  hyper

SEQ ID NO: 80855 - DNA, 1364 bp, Homo sapiens
  chr17:62776506-62777870
  hyper
ccggcaggttaggcccggaccatcgccctgggcggggcttccgaggtggtgccggagaggtttcgcggaatcggagctggcaacggcagcgaatagggacagcgacgctcaggagtgctgtcacccatacccaaagaagctgcgtctgggcggggcgaggaggaacctgaatgcctctgctggggaccttggggggcattgggacgaggaccggagcagaaagccggggtccggagccaggaaggctgcgtctgaaggggcgctggctggtcgctagcggagcccaaggagggtgggcctcccctgtcccgccttcccccttcccttctcccccggggatttgctgtcccggagtccctgcgtccctcccgcctgcggctctgggaatgccggtctggggctggttgtctagtgcgggcgttcccgttcgcggggaggtcattggcaccctgaatcacccactgcgagcccttccaaccggattgtagacctgccagctccgggcccacctcccccaacagggcctttcccggagcaacccggccgggcctggaaaaactccgagagggattcccagcgcagggacgcccaccggagcgcagtgtctcgggctggataagaaggggacccggccacagctccttcgccaacctgcgggaacacagagaaggggagggattggtgggggccgagaggatccctggagcgcgagagcgcacccgtcgccaggaggtcccctgcgtccactgcccaggcgacgcaagctacagcggcgtcaacgcctgggtcggcgctaggggcctgggcctgctccccacccgcctccagagggagggcagcccttcgcctaccttctcctccccgtgggatgcggcccgagcagctcccgccccagcacggagacaaggggagcaggcgcgcggagctcccgggtgcggacccgccacctgccgcacccttccctccccaaccctgcccctttccccacccccaccccacctcccacctcaactcccgctcggcggcccactgcctgcccgggcacctcggggcgtccgctcgccggcctcgtctccacttgtcccggcaggcgcgcgtgggctcggcgtcccgcgctccctcctcgaccgcgcggctccggcgctgccaggtttcctgtatagcactataaccagtgaggcaccggcggagagcgcccggcagaacttcctcccggactggggctgggctgcggttgcgagagacaatccccggcgtcctggcttcctgtcgcctctgggccaggcccgcgcctgaagaggaaagatgccaccccctcccctgcatttcccgggatcctgggccactcccgggatcctggctgt

SEQ ID NO: 80856 - DNA, 30 bp, Homo sapiens
  chr17:62782754-62782784
  hypo
gctgggtgcacaggtcgcagtggtagacat

SEQ ID NO: 80857 - DNA, 30 bp, Homo sapiens
  chr17:62831104-62831134
  hypo
cttttcaaaggaatacgactataagtggca

SEQ ID NO: 80858 - DNA, 30 bp, Homo sapiens
  chr17:6294932-6294962
  hypo
gtgaaacctcatgcacgaccttaggtggac

SEQ ID NO: 80859 - DNA, 221 bp, Homo sapiens
  chr17:6297080-6297301
  hypo
ggagctcattccagccggctggacgtgagggctcagtaatggggcagtcttagcattcagaggagaaaaccatgagggcgtgggttcaggctgctaaaataagaaccaaaaggcaaaggttgataatagcattaattttaatcaaatccatcatttatggaggcatggttctcagtgttctacccttgaccacaggaagacagcaccgatgacttaccttc

SEQ ID NO: 80860 - DNA, 42 bp, Homo sapiens
  chr17:63063928-63063970
  hypo
ttaatacctacaggccgggcatgggcgcggtggttcatgcct

SEQ ID NO: 80861 - DNA, 38 bp, Homo sapiens
  chr17:63152807-63152845
  hypo
ggatgagaaagccctcggctcctcggtggagagagcta

SEQ ID NO: 80862 - DNA, 30 bp, Homo sapiens
  chr17:6347790-6347820
  hyper
cggccttagtggtgtcgggtgagtgcgggc

SEQ ID NO: 80863 - DNA, 131 bp, Homo sapiens
  chr17:63533315-63533446
  hypo
ggccgtgcactctgccgccctcttagaaactaaatgcctgtaatgcggctcccacctcacacctgcccatggacctggctgggagacaagccccacacgggacactgcggtccgcccggcacttacccaaa

SEQ ID NO: 80864 - DNA, 30 bp, Homo sapiens
  chr17:63973353-63973383
  hypo
atcaacacaactactcgacactttagcttg

SEQ ID NO: 80865 - DNA, 27 bp, Homo sapiens
  chr17:64197672-64197699
  hypo
aaaatagaggatgggcggggcgcagtg

SEQ ID NO: 80866 - DNA, 30 bp, Homo sapiens
  chr17:64412556-64412586
  hypo
gagcatccatgtggccggcagctggggact

SEQ ID NO: 80867 - DNA, 147 bp, Homo sapiens
  chr17:6454672-6454819
  hypo
ctccatctcaaaaaaaaaaaagaaaagcctggagtctggacactggtgtctgatttgaccatatttgaccataaccttcccattggggaccaaagaaagtgagtttaccatctccttgcaggatgcaatgcccgtcccaagatacac

SEQ ID NO: 80868 - DNA, 37 bp, Homo sapiens
  chr17:6456361-6456398
  hypo
ttacaggcacgaaccaccgcaccgagcccctggccac

SEQ ID NO: 80869 - DNA, 32 bp, Homo sapiens
  chr17:64671946-64671978
  hypo
cagttctggttcctccgcggggtcccacgcca

SEQ ID NO: 80870 - DNA, 272 bp, Homo sapiens
  chr17:64672325-64672597
  hypo
tgttcttcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggggcctctcccacaccaggcttgccccgacaggtcagcttg

SEQ ID NO: 80871 - DNA, 30 bp, Homo sapiens
  chr17:64751173-64751203
  hypo
ccacagtcaccttcccgatttctgccagga

SEQ ID NO: 80872 - DNA, 289 bp, Homo sapiens
  chr17:64825601-64825890
  hyper
agttctctaaggagccgctcgtgtgtaacaccatagcccatgtgaatccgtgctgacatccgcacagatgaacggatcagatgagatttaatctccctgaggcccatgggcacgagtcactggagttttatggggtccagtaaagagcaaggaaaagtccgggtcttacaaggctgtaatcgcctcttagaaagagtctcccctaaccacctggtgccttagccctgcagggagctgtccagatgctgacccatttaagcgcagcttcctcggccgccttcagaccttc

SEQ ID NO: 80873 - DNA, 467 bp, Homo sapiens
  chr17:64831006-64831473
  hyper
gcctctcctctcccacgccggcccccaactcttcacctgccacccccacaagggtgctcaccccagaggtgctcacctcccgggctgggagaccgcatctgaccggtcccaaaccccgcctgcagctggcagcgccggggtggggaggccccgccctcggccccgccccctgcccgcccctccctctcggggtccggggcgcgagctgcggcggcggcggccacggtcattggcgccgagcggttccggctgactggacggggcgggcgtcccgggcagcctagcgcggtacctcccgccccgcgcgcccagccggcgagggacattggaccagggtcgggggtcgcggccgctccagcgaggtaagagccgggaagaccgggagagaccacctcttccatcctgggggggtccctgggggacggtctcccaccggtgctgggccgcggcgccgggctgcgccccca

SEQ ID NO: 80874 - DNA, 561 bp, Homo sapiens
  chr17:64960744-64961305
  hyper
gccgaggggggagggcgagcggagagggaggagcccccggccgccgccgccagcccgcccggcggccgcgcagcccgcactcgtcgccgcgcctcggagtttgagccccagcgctgccggagcgcaggcacgcccggggcgcggggtcggagcgcgcagcgcggcgccgccccccggccctcggccccccaaccccggcgcccccggagcggcgcgcggagggaggagggcgggcgggcgcggcgggccgggccggcgggcggcggactatgaggcgcccaccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaaggtacggccagccccgacccctcgccgccccacacacacacacacacacacacacatat

SEQ ID NO: 80875 - DNA, 260 bp, Homo sapiens
  chr17:64961365-64961625
  hyper
gccggggagagggtgggcgcggcgctggctccgcgcgagacacaaaggagccggagctggcgggcgggtcccttcgcggccagctgtacatcagctctggtccctctcggctggggacctccccagcacaccgatcccacaaactctccacgcgcacaccccctcgcccacagacacaatgaaacacaccgaaactcaagcacgcgcgcgtagcccgggacccgagcgatccccaggggccgcgccggcacccccggggg

SEQ ID NO: 80876 - DNA, 314 bp, Homo sapiens
  chr17:64961827-64962141
  hyper
gggcagaagtaggggcgggggcgcggtcggagccggggtaggggctgagttcctagcggatctagggtagctgggtaggcccagcccgacgcccgcctcgtctcccacggagtcaccggcccgctcctcgctgtgcggtggggtggtaaggggagcgacaccgagtctcccccaacggagacagcgacctcggtcgcggcccctcagcagggaggctgcggagacctcagtaggaaactagggtgtgcaggaccgatctgcggaccgggaacagactgggaggggcgtggtcatctcgtcggagctgggcgctg

SEQ ID NO: 80877 - DNA, 59 bp, Homo sapiens
  chr17:65021078-65021137
  hypo
catcgtcctcagtgccggcatcctcttcgtggctgcaggtgagccgcccgcccgggctg

SEQ ID NO: 80878 - DNA, 61 bp, Homo sapiens
  chr17:65254229-65254290
  hyper
cctgaagacagaaggcgaccctctgaagacaggtctagagacttaacgtatgatgttcctg

SEQ ID NO: 80879 - DNA, 30 bp, Homo sapiens; identical to SEQ ID NO: 45139
  chr17:65298508-65298538
  hypo

SEQ ID NO: 80880 - DNA, 90 bp, Homo sapiens
  chr17:65363297-65363387
  hypo
cttaagggccttacacgttttatgtgttatcattcataccatgctggtccctagaaaatagcttgagatcttaaaaaagcttaggatcct

SEQ ID NO: 80881 - DNA, 30 bp, Homo sapiens
  chr17:65712223-65712253
  hypo
taactacaataactgcgatagacttctagg

SEQ ID NO: 80882 - DNA, 80 bp, Homo sapiens
  chr17:65778166-65778246
  hypo
caggcaccacccctatactccatcacctggggcttattattgtgccaaatttgtctgcctgaagccgtcttcccttagga

SEQ ID NO: 80883 - DNA, 36 bp, Homo sapiens
  chr17:65789836-65789872
  hypo
gttagaaaagataaccgaccccagttggctgcgatg

SEQ ID NO: 80884 - DNA, 612 bp, Homo sapiens; identical to SEQ ID NO: 36353
  chr17:6616271-6616883
  hyper

SEQ ID NO: 80885 - DNA, 207 bp, Homo sapiens
  chr17:6616884-6617091
  hyper
cttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctct

SEQ ID NO: 80886 - DNA, 39 bp, Homo sapiens; identical to SEQ ID NO: 45141
  chr17:66421027-66421066
  hypo

SEQ ID NO: 80887 - DNA, 30 bp, Homo sapiens
  chr17:66426439-66426469
  hypo
gagaacaatccaggacgtattattctggca

SEQ ID NO: 80888 - DNA, 30 bp, Homo sapiens
  chr17:66430633-66430663
  hypo
tgccagcggtccctgcgggacttctgcggg

SEQ ID NO: 80889 - DNA, 96 bp, Homo sapiens
  chr17:66434324-66434420
  hyper
tgccatgcatagctacgggaggaagtggctgagccccggaacctttaactgcacgttctggcagccctgccacccctttggcgatacaaggtcatt

SEQ ID NO: 80890 - DNA, 41 bp, Homo sapiens
  chr17:66462815-66462856
  hypo
gtgctgagattacaatcgtgagtcaccgtgcccaaccatgt

SEQ ID NO: 80891 - DNA, 143 bp, Homo sapiens
  chr17:66506934-66507077
  hypo
ttgcccttttgatatcgcctatgtatccctatcagaaggcagtgaataacataactaaataaatcatctgatggacagtacccttagagcctggtggatttgggggagcagtcggcctccgagggcagcgctgcccaatagga

SEQ ID NO: 80892 - DNA, 1229 bp, Homo sapiens
  chr17:66596286-66597515
  hyper
agccgtgggtggagccgctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 80893 - DNA, 30 bp, Homo sapiens
  chr17:6662975-6663005
  hypo
tttaggttgggtgtacgatgtgtcagcaga

SEQ ID NO: 80894 - DNA, 37 bp, Homo sapiens
  chr17:66643278-66643315
  hypo
cacctcttatgggggcgccagctgcggggaggggtct

SEQ ID NO: 80895 - DNA, 492 bp, Homo sapiens
  chr17:6679303-6679795
  hyper
gcgcagaagcaagggcgggggcgtgccatcctcacccggagcgccggccgagcctcccgcctcccaacgcctggccagggccccgtctcgccctctgcacatgggatccactgaccaggcaactgcaggtttggggctctgcgacccgggggcaggaacagagccttgcaggcggcagcgcgtcacaaaggcggccggagcttggcatttagcttgggccagagcaaggcgcagacccggggcgcccatggagttggcgtcggagcaacagctgcgcgggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacat

SEQ ID NO: 80896 - DNA, 30 bp, Homo sapiens
  chr17:66834845-66834875
  hypo
ggagaattcaatccacgctttgggaagtac

SEQ ID NO: 80897 - DNA, 42 bp, Homo sapiens
  chr17:66872604-66872646
  hypo
tttgctgctgcccctcggggtccatcccggtcgacggctcat

SEQ ID NO: 80898 - DNA, 53 bp, Homo sapiens
  chr17:66959344-66959397
  hypo
atcccaccaaagccccgaggaaaccccaaatttcatctcgaggacaccagtcc

SEQ ID NO: 80899 - DNA, 423 bp, Homo sapiens
  chr17:6735130-6735553
  hyper
tggccaaaggcttagcgcaggcgcaaattctgcggaccccagagccagagacccaggagtgtggcgtgtgggaagggtagggccagatgctccggccacctcaacctaccgcgaagacgcggggcaccaagcagaagacagcggccaaagccccgagctgggagtcaggagacctgcgtctagtccgagccctcccgcgggcgggatcatctcgggtcgcgctgtaccccggctctcagacttcccggctgtacagtggggttgggctgggcgatgcctccaggacctcgcagtcgcaggcgaaattgagggttaaaaatcaggaagccaagttgattgtttctgtaagctacaatgagtttcctccagagtttgtataggtctgttaccacaactggcttatttctgcgtggggcgcccgat

SEQ ID NO: 80900 - DNA, 22 bp, Homo sapiens
  chr17:67410388-67410410
  hypo
tccctctcgggaaaaaaacaac

SEQ ID NO: 80901 - DNA, 30 bp, Homo sapiens
  chr17:67410790-67410820
  hyper
ggccttcgcgcccttcgcaggaaggacgtc

SEQ ID NO: 80902 - DNA, 30 bp, Homo sapiens
  chr17:68164507-68164537
  hyper
ctcaaggaggccttacgaggtttaaataaa

SEQ ID NO: 80903 - DNA, 36 bp, Homo sapiens
  chr17:68164768-68164804
  hyper
ttttaggggtctgcgcgctctcgcctggctgctggg

SEQ ID NO: 80904 - DNA, 1064 bp, Homo sapiens
  chr17:68165132-68166196
  hyper
gggcgctgcagcctccgcggggggcttcgaagggccgaggggctccggcagagagggagtggagagggagacgcgccgggaccgacgaacaatcctgcccctgcggcaaaggtctctacccggcgctggcacctcgcaggcccctcgaggagcacgcagggcaagcggcccaagagcgggggaaccgggaagtgtgtggggctccagacggagtaggaagctttgcccaaggccaggctgcaatcaggcagccgcaacagccgggcgcggagcttcccacctgctgctgtcccagctgggccgcaacttcctcctccccggcccgggcccgactccccggccgggctccgagggtggagggggacgaggcggcggcaggttccctccgctggcaacgcctcgcagcatcctcccctccccgccgcggttcccggggccggccgcgcggccaggcgcgctgcgattggccggcagcggccgggggcggggccaggagagccggtgtcgcacggaccgcctcaaaagagcccaggatattgcagagcgcactggagccctggccagcgcgcagccttcccggcgccggcgggctgggtcttgggaattctggtttgctttggctcactcgctttttacaaaccactggatcttacatgcctctgtaccccccacttccactccatgtccccatgctcctgcgccagcaacaggtaagggctgctgtgttttcttccttttcgctcgctgccggtgtgtcctggggaatggactctggccgccgtcccctaccctaccctgccccgctgctccagaggtgcccagctgtcacactgctgtagcgctcacccacactccggagtcccagatcatgcctatatagtttgtgtgcgcaccagaacatccccagagctaaaaatactgagacatgcttggaacagttgagcaatagaaacagatttctctgcagcatctgtttgtgctcataacttccaatgcaccagctgtagcgagatactgggtttggaggcaagggcgagagcgtctgtgttcggttctcactctaa

SEQ ID NO: 80905 - DNA, 34 bp, Homo sapiens
  chr17:68268160-68268194
  hypo
ttaaaaaaatattgtcggccgggcgcagtggctc

SEQ ID NO: 80906 - DNA, 30 bp, Homo sapiens
  chr17:6882316-6882346
  hypo
cacacccagcacacacgcctcccatacacc

SEQ ID NO: 80907 - DNA, 230 bp, Homo sapiens; identical to SEQ ID NO: 36358
  chr17:6926198-6926428
  hyper

SEQ ID NO: 80908 - DNA, 30 bp, Homo sapiens
  chr17:692622-692652
  hypo
gtgggtcacatgccccgcacacaaattcgc

SEQ ID NO: 80909 - DNA, 200 bp, Homo sapiens
  chr17:6946212-6946412
  hyper
tcaccctgaatgacccgggcatcccacttccctcaccagcgaggaggcccaggccgaggtagagatgcagcagatcgctggcgaaagccgagaagacgaagcccagcgaggcgaggacgcccccaaccatcaccacggggcgggccccccagcgcgtgctcagggcgctgcccacggggcctgaaagggggcggagtcaa

SEQ ID NO: 80910 - DNA, 15 bp, Homo sapiens
  chr17:6946476-6946491
  hyper
cgaactaatggttct

SEQ ID NO: 80911 - DNA, 124 bp, Homo sapiens
  chr17:6946872-6946996
  hyper
ccacgcctgtgcttccgctggggagctggcatccctgagatccagcctctggctgctcgcccggggtgggcccgtcactccgagcgcgatggcgcggggcggagggagccggagcctggcctag

SEQ ID NO: 80912 - DNA, 30 bp, Homo sapiens
  chr17:6947321-6947351
  hyper
gcgcgtgaggccagacgccagtcccacggg

SEQ ID NO: 80913 - DNA, 30 bp, Homo sapiens
  chr17:6978470-6978500
  hypo
agtgagcacagtcctcgcctccacccagcc

SEQ ID NO: 80914 - DNA, 167 bp, Homo sapiens
  chr17:70026568-70026735
  hyper
tttgcctcctgccctcgctgctgttaatctgcaacacgccacagcctctagatcgctgccgttcagagtcggatgtcatgggggcgactggcaggggttctttcttctttcggtttgatacatccttccttccgctgctcctcgcaatcaaccgctaggggaaggag

SEQ ID NO: 80915 - DNA, 67 bp, Homo sapiens
  chr17:70026970-70027037
  hyper
aaggagttggagctccgtgatggtgagctttcagacttccccctacaacctccgcctccccaaaggc

SEQ ID NO: 80916 - DNA, 751 bp, Homo sapiens; identical to SEQ ID NO: 36721
  chr17:70112816-70113567
  hyper

SEQ ID NO: 80917 - DNA, 372 bp, Homo sapiens; identical to SEQ ID NO: 1322
  chr17:70113647-70114019
  hyper

SEQ ID NO: 80918 - DNA, 485 bp, Homo sapiens
  chr17:70114152-70114637
  hyper
cgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctgaatggggaaaggggagtggacaccaggaggcccctgcagaaatgcaggaccgatccactcgcgagctgacaatgccacgcgctagacttggcctgacggtggcaacgcttggcacctggg

SEQ ID NO: 80919 - DNA, 30 bp, Homo sapiens; identical to SEQ ID NO: 36724
  chr17:70115315-70115345
  hyper

SEQ ID NO: 80920 - DNA, 76 bp, Homo sapiens
  chr17:70116259-70116335
  hyper
ctcccccagacagggcgactcggctgacgtttttgacccggccaggaggcaaagaccaaaacgtcagagcagtagc

SEQ ID NO: 80921 - DNA, 38 bp, Homo sapiens
  chr17:70117768-70117806
  hyper
ggtgctcaaaggctacgactggacgctggtgcccatgc

SEQ ID NO: 80922 - DNA, 640 bp, Homo sapiens; identical to SEQ ID NO: 1324
  chr17:70215667-70216307
  hyper

SEQ ID NO: 80923 - DNA, 303 bp, Homo sapiens
  chr17:70216392-70216695
  hyper
cgtcaaagccgggtccagggaaggggggcatgccatgggcgtattgttggcctgcgagttccgtcaatgggaaaagtcatgtttcctccgaaggaaacaagtggaaattgtcggggaggggaagggctggtgggtggctgggaagcagagctcggccagttgctactaaggctgccttcgaactgtccctccccactgccagtttctgcaaatgggcaagtctggtccttctggaaggcagttctggggaggggcagtggaagggaacgttttaatatcaggaagaaccgatgtaaatcctag

SEQ ID NO: 80924 - DNA, 98 bp, Homo sapiens; identical to SEQ ID NO: 44977
  chr17:7047830-7047928
  hypo

SEQ ID NO: 80925 - DNA, 33 bp, Homo sapiens
  chr17:70585967-70586000
  hypo
aaaaaaaatttacatcggccgggtgcagtggcc

SEQ ID NO: 80926 - DNA, 121 bp, Homo sapiens
  chr17:70588010-70588131
  hyper
ggggccgagcgggtgcgccgaggacgcgggggcgtctcccccagctgaggttcggtccctccaggcagccaaggcttggcagcgctagaggctgaaggacaacggccgagaacgcccagga

SEQ ID NO: 80927 - DNA, 189 bp, Homo sapiens
  chr17:70588893-70589082
  hyper
tcctctggataccagcgccgcaccgcgcacccgcgccgcctgcgcgccctgcagtcggctgggccattcggcccttatataccaggcggacccgcgccgggacggggcggagcggggtgggcggggagggggtggggaaggccgaacggcttcctgggagtcgtagttcgactacgtagtcctgtcgta

SEQ ID NO: 80928 - DNA, 57 bp, Homo sapiens; identical to SEQ ID NO: 44940
  chr17:706526-706583
  hypo

SEQ ID NO: 80929 - DNA, 38 bp, Homo sapiens; identical to SEQ ID NO: 16227
  chr17:70657503-70657541
  hypo

SEQ ID NO: 80930 - DNA, 30 bp, Homo sapiens; identical to SEQ ID NO: 16228
  chr17:70712704-70712734
  hypo

SEQ ID NO: 80931 - DNA, 77 bp, Homo sapiens
  chr17:708414-708491
  hypo
ttcagcacctccacccgcccctgccgcgtgatcacctcgccctgcgggtccagcatgatgagcgtggggatgcctgc

SEQ ID NO: 80932 - DNA, 101 bp, Homo sapiens
  chr17:7107617-7107718
  hypo
agagggagcccataacggagggtcccatcagcgtggctaccctttcagcctcttagccaagcccactccgccaccctgagagctgctcaagggcccagcct

SEQ ID NO: 80933 - DNA, 146 bp, Homo sapiens
  chr17:71160732-71160878
  hyper
cccggggctggcccacggtaaacacagctttgctaacttgtttggctaaggaaatcacagaggtcccggtataagtctgggtcaccccggccgccactccagctgcctagaatatatgggtggaagggaatcgactctgtgaaatc

SEQ ID NO: 80934 - DNA, 41 bp, Homo sapiens
  chr17:71161118-71161159
  hyper
atgtgccgaggggcccgggctggctgggccagtcccagcgg

SEQ ID NO: 80935 - DNA, 255 bp, Homo sapiens
  chr17:71161183-71161438
  hyper
cgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgt

SEQ ID NO: 80936 - DNA, 979 bp, Homo sapiens
  chr17:71161498-71162477
  hyper
aagcgcacttgggcacctgtgtgcatctgcgctgatggtggtgtgcccatccgagtgcctgagcttaggtcccggtgcgtgattctccgctcttgtgccttttggggtgattgtagtaggaatgaacgacaacgggtacccttgcctgagtaagggggctgtgggtagagtgtgctggaacggacgtgtcctcgcagcctcatgcccgtgtgcgtggcgtgtgccctttagcccgagatttcaggtagctgcgacgggtgacaacttctctcccagccccctacaaaagagacctggcgcgaggggagcgaggccgtgagatgccagctggggctcctgcgggagcgcacccggagatccgagcctgccagaggcaggcggcgggcgcagagcggagaaagaggggcttctctccctagacgctgaacgatctaggatccgtccccgtcccccacctcgggacagaaaggacagtttgtctaggtttggagagaaaaaaccactgcataggccgtgcccaaaagccgctggccaagtcccccaagcgactgtcttctgcgccccgatgtctctgtcctcagcgccccccccccacacccggcacccctgctgtgcgtttcgatactgggcgtgctggcgccacaatctccgctcttgcctcgtcttcctggaaatggcacagagttctttgggaaacccttgctctgaggatcagcgagttggatggccaggaggaggactttctgtgccagccgggagcaaccggctccgcggtcctgacactcgcccctccatttctcaaccccgtaggccagcaccgccccggcttttcccaggcgctcacgcgccgcggtggccctcaggggcttttgtcaccctgccagtgggggctctcgctctagccgcacagagaccaagccgggttctgcaggccctgagggaggcggggggtgggaagtgaatgcgggaaacatgatgg

SEQ ID NO: 80937 - DNA, 25 bp, Homo sapiens
  chr17:71183402-71183427
  hypo
gagccaccgtcgccggccccaagtg

SEQ ID NO: 80938 - DNA, 19 bp, Homo sapiens
  chr17:71190303-71190322
  hypo
gggtgcggtggctcacgcc

SEQ ID NO: 80939 - DNA, 30 bp, Homo sapiens
  chr17:71191269-71191299
  hypo
gcctgattttagaaacgtattgattttcat

SEQ ID NO: 80940 - DNA, 30 bp, Homo sapiens; identical to SEQ ID NO: 45149
  chr17:71201620-71201650
  hypo

SEQ ID NO: 80941 - DNA, 30 bp, Homo sapiens; identical to SEQ ID NO: 45150
  chr17:71202377-71202407
  hypo

SEQ ID NO: 80942 - DNA, 36 bp, Homo sapiens
  chr17:71202740-71202776
  hypo
tgacagttagaaatacggtagcgatgggtgactaac

SEQ ID NO: 80943 - DNA, 126 bp, Homo sapiens
  chr17:71246047-71246173
  hypo
acagaggagctgccacgtgcaacccagacctgttggtaggagctgagcaaagtataatgatcgtggatttcccatagactcgagcttttggttttatgtacattttgctcccgttttatggataac

SEQ ID NO: 80944 - DNA, 39 bp, Homo sapiens
  chr17:71283415-71283454
  hypo
cataaatgaggatcccgcctgtgacgtctccactgtgga

SEQ ID NO: 80945 - DNA, 31 bp, Homo sapiens
  chr17:7136114-7136145
  hypo
aagcagaggttgggccgggcgcggtggctca

SEQ ID NO: 80946 - DNA, 30 bp, Homo sapiens; identical to SEQ ID NO: 45151
  chr17:71375377-71375407
  hypo

SEQ ID NO: 80947 - DNA, 30 bp, Homo sapiens
  chr17:71378704-71378734
  hypo
cctgctgtgctgtaacgtgttttatcggtt

SEQ ID NO: 80948 - DNA, 61 bp, Homo sapiens
  chr17:71391476-71391537
  hypo
tgatcttatagcccacggactcagggttcccattgtattccatctccgggagaggctgcag

SEQ ID NO: 80949 - DNA, 30 bp, Homo sapiens; identical to SEQ ID NO: 45153
  chr17:71417363-71417393
  hypo

SEQ ID NO: 80950 - DNA, 30 bp, Homo sapiens; identical to SEQ ID NO: 45154
  chr17:71427753-71427783
  hypo

SEQ ID NO: 80951 - DNA, 30 bp, Homo sapiens
  chr17:71439688-71439718
  hypo
ctgagtttaaaaatacgagggctgccccag

SEQ ID NO: 80952 - DNA, 30 bp, Homo sapiens
  chr17:71475104-71475134
  hypo
tcacccatggtacaacgcacattcatgcac

SEQ ID NO: 80953 - DNA, 30 bp, Homo sapiens; identical to SEQ ID NO: 45155
  chr17:71484009-71484039
  hypo

SEQ ID NO: 80954 - DNA, 30 bp, Homo sapiens; identical to SEQ ID NO: 44979
  chr17:7156905-7156935
  hypo

SEQ ID NO: 80955 - DNA, 1254 bp, Homo sapiens
  chr17:71639013-71640267
  hyper
ctctggattgcctggcgcacgaggcggcgtggggagtgggttgcagcccccacagtccggacccctagggtgggtctggccccctcctgagcctgcgagagtgaaggcctagccctgcgagtcctggagctcggtccaggcttcgtctccctccgcccccagcaggcgccgctcggacaccgctgacaccactgtctggatcggcgaaccccaaagtcgaggaaccgccggtgcagccgcccttcacctcggggacctgcccggggaccagggggacgtctgggcatccaccctcaggaagcgggcagcgcagatcacacctcggatccttcgtagcactcccaaacccaaagccaccagcccttctccaccgcgaggctgctcccggcagccacaggtcacagcagcgagcggctgcacagactatcgagcgaacagcggaggctggaggcaggggcggggatgctgggtgtgggtggatgggtaggaggggaggcctcagaccctccctgtgcaccaccccccggtgggtccgcggctgcacccgcgaccttggctccaggcccgcgcagcgaagcacccccagccccagcggctggccgagcagccaggggcgggctcccgtacgtggccaagccgggcaattgctctccccgggcgagcaacccggcatccagcgctcgcccaccccactccctcgccccggggaggccatcgcctgcccggcaggggccctgcccttccccgcagacaccgagcagggaaccaggagctcggtctgggaagctcagcgtagccgagcgtggagcccggcacggaatgtcgctcccctcccaagccggcgcagggcagccacagcagacggggggaggggagcgcccctcccacttcaccttgggctcttctctgcctccccaggtcgtccccaccttcccccattcggaagccacaagtctcggagagactgccccacccccaaaagagccccaaaacttgggagatggggtgtcttgaaactccctggagagggctctgccacggctaagccgggtgtccaggaggtcaccgtgaggccggccagctcccgccgcccctcccccgcccactctcccagccccctccctgtccccacgtgggggtccctccttaccttgggctctggccgcgcggatctgatgcagagctagcagtgtccagatcaaaagcccccacatggtgaccagcctggagaggggtcctcggggtctcccttcc

SEQ ID NO: 80956 - DNA, 123 bp, Homo sapiens
  chr17:71640470-71640593
  hyper
gccaggccgccctctcggactagggcgcctctctcccttagcaccccaactccgacttctcccaaacagggcggcctctgcgatccggccgggtcgccggccgagctccggaataaatggaca

SEQ ID NO: 80957 - DNA, 301 bp, Homo sapiens
  chr17:71640832-71641133
  hyper
gcaggcagcatctggcggggccgaaccaccccctctgggctccaccgccctcgcgccgaatcgggagacgccgggtctcctccgggggcgctggggccgggcgcgccctcggctccgcgcccagccggctagcaaactttgcgggtcccggagccgggcgcgcagccctgagcgcccatgtccgcgccagccgcggggcggcgggggagggtgctgggcttcgcgacgcgggctgtcgccggcgcccgggcgcagagcctcctgccggcccgaggatggagaccggcggctctgccctccg

SEQ ID NO: 80958 - DNA, 325 bp, Homo sapiens
  chr17:71641358-71641683
  hyper
gagctgcgggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcggccgcgggcgcccagcggctctgggacccgcaggggggcagcagtgccaaccttctgccgcgccgggagagatgcgcgcgagcccctccgctctctgcccagcctttccttccagcctcgctcgcgcccctgtctcaaa

SEQ ID NO: 80959 - DNA, 41 bp, Homo sapiens
  chr17:7164579-7164620
  hyper
ggtgaaagggtgcagcgaagagaagccgagacggtggtccg

SEQ ID NO: 80960 - DNA, 21 bp, Homo sapiens
  chr17:71879558-71879579
  hypo
ctccaaaatccgaaacgctcc

SEQ ID NO: 80961 - DNA, 185 bp, Homo sapiens
  chr17:71897979-71898164
  hyper
attcgcacctgattacgctgcgcggacacaacagaggcgcccggacccgcagccctgccttcgccgcctttgctgggctgtttgcgcttcgtttccttctcgccgccccatggcgcgctttctctcttctttatttcgccggttctccccgctcctaacctgcttaacaacttacctcgctctcc

SEQ ID NO: 80962 - DNA, 245 bp, Homo sapiens
  chr17:71898228-71898473
  hyper
cgtggctgcgccagcatttaataaaagctgctgaccgggaaatccgagctaactgaattacttcctcattaaagaggcgggcagattcttgggccccgcgtgcagccaccctcgctgcctccctccccgccccgctccgccctgctggtcccgcctgccgtccgcaattaggcggcagatgcttgccgcccggtggtggcctgggttctgcagggactgagggggctcgtcggcttctctccagg

SEQ ID NO: 80963 - DNA, 990 bp, Homo sapiens
  chr17:71948390-71949380
  hyper
actccattcatctcccggttcctcgcattcatcccccaccgaacccacccacaaaatgctgaatcggtgggtgagatccccatagcaacggctccgatgccagaacccaggattacgacaccggatcagccagagacgcgctggaggggcccaggaggggctgcagcgcgccgcaaatcccccggggcttacgggagccgctctttaggagacagcgctggacgaaccgggcggggtggggatggataatcttcaggcgccaacgcaaaacggccgcaagacgtggccaggccaggaggctcctgggtcccgggcccgcgatgtggcccttgcgcggggacaaagacgaggccatcgccctcacgtgttcccaaagacgcccaacctcatcaggaggccgccccatccgccacctgggagcgtcccacacgcccgggcccttgaggatgtcccctcggcgatgtgcctgaccgggcgctccccgcccgccaacctccaacctccaacctccgccctccaccctccaccctccttgctctgtccgcgtggacgcagcccccggttcagacactagcgggtgcgcggggccgcccaggacggcgggagaggacggggccctccctcccctctggtcccccaaagctccccggacgccgcggccgcgccccctgccggctccctccggccggctcccgcgtcccactggggctcctctcccgctgcaaggtcagcgcttccccgccccacgccctccacaactccccgcccttccgttcctgctgccgccgccctctccacccaggctcctgtcacccaccacgggagttcacacgctccagtccatcggcctcccccggcccgaccgccctggctcaggcaaatcccagcctgcacttcccgaaggaagtcccctccacgcacacaccctacacgcacgcacacatttacacacacgccctcacacatttacacacacgccctcacacacgc

SEQ ID NO: 80964 - DNA, 104 bp, Homo sapiens
  chr17:7197588-7197692
  hyper
gggggttcccgagaccgccgtcgccggattgccaggggtgcgggagcccggcgccgagggggtcccagcagcggggcccgaggcggctccgcccccgccgcccg

SEQ ID NO: 80965 - DNA, 30 bp, Homo sapiens
  chr17:72111461-72111491
  hypo
atttggggtggggggcggtgaggaggaagt

SEQ ID NO: 80966 - DNA, 30 bp, Homo sapiens
  chr17:7219436-7219466
  hypo
acccctcattccacccgtaccagcagggca

SEQ ID NO: 80967 - DNA, 35 bp, Homo sapiens
  chr17:72203913-72203948
  hypo
ggattacaggcgtgaaccaccgcacccaactgaat

SEQ ID NO: 80968 - DNA, 30 bp, Homo sapiens
  chr17:72207414-72207444
  hypo
cagctgctggtgtgccgactgtcctccaac

SEQ ID NO: 80969 - DNA, 307 bp, Homo sapiens
  chr17:72208361-72208668
  hyper
gtgggatcacggccacgaggagaggccccgaggccaggacttcctctaatggacacagggcctttgagcaccgggtgactggggccccactccccagcagccatatgtgtttgcgagcgttttcagtcggtccgcatccacccggtcccttcagccagaaccctaggagccccgccccgtcctcccggggctcctttctcacccgcgtccctgccgcggtggatacgcacccctcaggctggctgcccagcgcggtttccacgcccaatctgccgcgaccccatcactccaccgcacctacccctga

SEQ ID NO: 80970 - DNA, 176 bp, Homo sapiens
  chr17:72209140-72209316
  hyper
ttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagat

SEQ ID NO: 80971 - DNA, 44 bp, Homo sapiens
  chr17:72220254-72220298
  hypo
atcctcctgcatggccgggcgcggtgactcatgcctgtaatccc

SEQ ID NO: 80972 - DNA, 30 bp, Homo sapiens
  chr17:72222074-72222104
  hypo
gggcttacacctgggcgtgggcagtgacca

SEQ ID NO: 80973 - DNA, 213 bp, Homo sapiens
  chr17:72233492-72233705
  hypo
gagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtgaaggaccggtgggaggcagagggaggggcagcagcggctacatcagctt

SEQ ID NO: 80974 - DNA, 30 bp, Homo sapiens
  chr17:72249016-72249046
  hypo
cctggaagagctggtcgtgaagctgggaat

SEQ ID NO: 80975 - DNA, 30 bp, Homo sapiens
  chr17:72249492-72249522
  hypo
gcatccaaggccacccgtggtccccactac

SEQ ID NO: 80976 - DNA, 80 bp, Homo sapiens
  chr17:72269879-72269959
  hypo
actccgtctcaaaaaaaaaaaaattccccagcttctactcccaaggagtttccattctggtggtgcgggaagatgtcttt

SEQ ID NO: 80977 - DNA, 351 bp, Homo sapiens
  chr17:72270174-72270525
  hyper
gtaggcttggataagcgccttggcaacgcccctacaaatattcatgatcattattagtatgttaccaacctattggttaattcttctcctaactcaggagacctccaaaaagaagagggatggcctgcgcttccgacgtggcaggaaaggagtcacgtgctccggggtccttccgcgtcgccccgcgcgtccggagccaggccggggttgccaagcaaccggtaaacgccgccgtttgaggagcaccggagccgcgaccgtggattgaacgcttccccagagacccagaagcagaaggagcggacccagggtaaggggcgggcgccaggaggacgtcggaggctaaagact

SEQ ID NO: 80978 - DNA, 128 bp, Homo sapiens
  chr17:72278015-72278143
  hypo
ctcggaccgccaggccgagctgaacatcgacatcatgcccaaccctgagctggccgagcagttcgtggagcggaacccagtggacacgggcatccagtgctcgatcagcatgtcggaacacgaggtgg

SEQ ID NO: 80979 - DNA, 35 bp, Homo sapiens
  chr17:72287189-72287224
  hypo
gccatcgtctccactcgtgacgttggagttcaacc

SEQ ID NO: 80980 - DNA, 36 bp, Homo sapiens
  chr17:72296926-72296962
  hypo
tttgattcagtaggtcgagggcgaggcctcagcatc

SEQ ID NO: 80981 - DNA, 210 bp, Homo sapiens
  chr17:72321933-72322143
  hyper
cacaggcacctgctgcgatgcacgcggcgcccacggaaacccgaggctgccagccgccgccctggagaccccagagacagcggcagatgcgtgtgcttcaaggggcagcgtggctgctggggcgctccctaaagggcagtggcacggggtcgcgccgcgagcagaggggcgcgggtgggcgcgcaggagttagcgaactgacacggaggc

SEQ ID NO: 80982 - DNA, 414 bp, Homo sapiens
  chr17:72322144-72322558
  hyper
ccaggcggacgcacggacgcaccgagggccgcagggccgcacagccgggcacacatcgtcgcgcagcggttcaggctcgggggcctcctcggcggaggcggccaactctcaccctcagcgcggggaggggcgggcgccgggggcggggcggcgccgtccgggccctccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccc

SEQ ID NO: 80983 - DNA, 41 bp, Homo sapiens
  chr17:72322611-72322652
  hyper
cgccaccccactgagaggacaggcaacgaccagggccggga

SEQ ID NO: 80984 - DNA, 36 bp, Homo sapiens
  chr17:72346588-72346624
  hypo
gcttcgggagcagctcgccagcgccttccaggagca

SEQ ID NO: 80985 - DNA, 113 bp, Homo sapiens
  chr17:72353147-72353260
  hyper
ggcgagaagagcacgttccaggtgacccggcggcccgcgtcgtggccactcgggcccagctgcgtctggaagctggtgctgcggtcgtcgcgggccgggttgttgatgaccca

SEQ ID NO: 80986 - DNA, 21 bp, Homo sapiens
  chr17:72353416-72353437
  hyper
cgagcgcgcctgcagctggaa

SEQ ID NO: 80987 - DNA, 236 bp, Homo sapiens
  chr17:72356203-72356439
  hypo
agtcccagcagcaggcggtgggcgtggaatacccggacctcatcggtgcccgcagcctgcacccgcagaaccacatcgctggcgttgccctgccgcagcagctcctgcaagcgctggagcaccgcctgggagtggttgatggaggtgccagctgcctccccgccaacatcggctctctgtgctgcagcaggaaggaacacagcatagcctgagaaggtgcccgggcccagaacctc

SEQ ID NO: 80988 - DNA, 67 bp, Homo sapiens
  chr17:72368063-72368130
  hypo
gtttgctgccaaccacgcctcagtctggatcgccatcctgctcacggttgaccgctacactgccctg

SEQ ID NO: 80989 - DNA, 30 bp, Homo sapiens; identical to SEQ ID NO: 16232
  chr17:72370768-72370798
  hypo

SEQ ID NO: 80990 - DNA, 502 bp, Homo sapiens
  chr17:72427092-72427594
  hyper
ccggcgcaccgctggcgatcccccaggcaattcggcgtcatgagaaccggcaccccgagactcggcgccctgccctccctccgcgtctccagggccctggccaggcccaacaacctctccctcctctgtgcgcctcagcccctacgggcctctggcgcgggctaactaggcctcgctgcgggcccccaggactgcgcaccccaccccccgcgaggccagcagccccgggggaaggcggccggaaaatctcttgtttatcgggctggataagtaccagcctggattcgcttcccaatttctgcggtccagcttcagcagattcctggggccggaggggaaagggtggcaacccacagatccaccccggaacagggagtggggggtggggctggtgggaacctgacctcctggaaaggacggactcggagtcagagccaacgtgtcccggagcgcagaggcccagggggtcgcgctaaacactgtacctcggggaacaaaaccg

SEQ ID NO: 80991 - DNA, 59 bp, Homo sapiens
  chr17:72427813-72427872
  hyper
gtcccagagaaggaccgtgcgtgcaaaaggcgaacctcggtgtgcggtgtgtccacgtg

SEQ ID NO: 80992 - DNA, 158 bp, Homo sapiens
  chr17:72428331-72428489
  hyper
cgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcct

SEQ ID NO: 80993 - DNA, 43 bp, Homo sapiens
  chr17:72428829-72428872
  hyper
gggggtgggggagcccggcgctgcggctcgggctggagggagg

SEQ ID NO: 80994 - DNA, 28 bp, Homo sapiens
  chr17:7243860-7243888
  hypo
gataagatttgatctcggtcaggccagg

SEQ ID NO: 80995 - DNA, 30 bp, Homo sapiens
  chr17:72539052-72539082
  hypo
gtgcacgggcagcttcgtgggaggacctga

SEQ ID NO: 80996 - DNA, 30 bp, Homo sapiens
  chr17:72560329-72560359
  hypo
tatttctcttcataccgacactgaacactc

SEQ ID NO: 80997 - DNA, 199 bp, Homo sapiens
  chr17:72667283-72667482
  hyper
gctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccggg

SEQ ID NO: 80998 - DNA, 30 bp, Homo sapiens; identical to SEQ ID NO: 45160
  chr17:72731669-72731699
  hypo

SEQ ID NO: 80999 - DNA, 74 bp, Homo sapiens
  chr17:72733981-72734055
  hyper
ccctcccattccacccgctggaggcactgcctcccaccttcctccctgcagtcggaagccgctcctcccagaag

SEQ ID NO: 81000 - DNA, 30 bp, Homo sapiens
  chr17:72773643-72773673
  hypo
agttccatggggcagcgactacagtgctgc

SEQ ID NO: 81001 - DNA, 30 bp, Homo sapiens; identical to SEQ ID NO: 45161
  chr17:72800435-72800465
  hypo

SEQ ID NO: 81002 - DNA, 211 bp, Homo sapiens
  chr17:72838894-72839105
  hyper
gatcggcaagcacatcgactgcgcctgcgccaagcgcctgcaggccgagtggccgtcggggcgggcgcaggcggggccggtgcacccagcgggcagcgagctgggccgagcgaaggcctcggccacggagctgggcagggaagcgtgacgcgggcgcgagccccgggcccaggccgcgtgcagcagggcctcccgccgggccagctgctcc

SEQ ID NO: 81003 - DNA, 74 bp, Homo sapiens
  chr17:72839514-72839588
  hyper
cgatggtgcgagtggcgcggtccagggagctgcttacgcccgccgtggtcaccatgtcgcgggctgcctgcagc

SEQ ID NO: 81004 - DNA, 61 bp, Homo sapiens
  chr17:72848164-72848225
  hypo
cccgggcagggctgacgggcccagggtgaacacggcagtccccggccggggctggcagggt

SEQ ID NO: 81005 - DNA, 349 bp, Homo sapiens
  chr17:72848502-72848851
  hyper
agcaggcgctgcgtgcgcgcgcgcggccctcccgggcccagctccagcgtgaccacgtccagcagccgccaactcacgtggctggcgtcggcgacggcgcgcacgccctccaggaagagcgcgtggcccgggtgcaggctggtgatgacggcgaaggcgctccagtcgtactcttccagcaccttgaacagcacctgcagctgctgctccagggacacgcccagctgcaggaaggcggagcccggctcctgggggcgggcggggcctgagcggggcgggagggccgagcccctcctcccgccccttccccgacctcggcccctccatcagctcccaggcgcccttgcgc

SEQ ID NO: 81006 - DNA, 402 bp, Homo sapiens
  chr17:72848870-72849272
  hyper
cgggagccctctggcctgcgcctccctcccgccccaatgtggttccccgctgcctagtagcatggtcatgcccggcccccagcccaccacgctggcccgcagacccgcagcatcagcaccactggggagtttgtcagaaatgcagattctcaggtcgcaccccacaccgactggatcggagtcgctgggtatgccgcctggcatctgtattctcacaagctcttcagccgatccttgagcccgctagactgagaagcgctgccccagaccaactgaatctgaattccagaggtgcaaagccaggcgtccgtatttcctaagagcacgatgagggttgagagccaatgtcctgagatcttatgccggggccccaagaggacggggaaacgccaccctggttga

SEQ ID NO: 81007 - DNA, 30 bp, Homo sapiens
  chr17:7285270-7285300
  hypo
gctgaaatgtctcagcgttaagacgacata

SEQ ID NO: 81008 - DNA, 539 bp, Homo sapiens
  chr17:72855927-72856466
  hyper
gcatcaggctccccccgcgggaggagggggcgcgagcagcgagagccaccgtcacccgcggctcaaggacactcgcgatgcggcggcggcggcggcggcggcggctccgggcggggacccgcgccacgcctcctggcggccaagctgagcaccacgcacccggcgccccccgccccacgctgccccccgccggcgtccgcggctccggggcccccacccccactcccccaagctgggtcgtgaccccgagtcccgcagtggggggaccaagccagcctggcaggcggccccagtaccatcccaggcccgcccgggggccctgggcgaacccaggtgtcccggacctgcctacctgcccctggcacgctcttattcttcgggagtttagaaacaggctcaaagtcactagcaccgccaagacctggacgggctctgaaatacagccagcggaatggtaccctccccaaataagtgtctttcctcgattttcctgtggcccggggtcagggactgaactaagataacgccaccatccgagg

SEQ ID NO: 81009 - DNA, 1084 bp, Homo sapiens
  chr17:72856941-72858025
  hyper
tggaaggggaagaagcgggactcgcggcgggggaaggggtctgggcgccgaggcgagtgcgcagcaggtgcccagcagacctagggaaactggggcactgggctggggagccgcacagccccctttcaccttctcgactcctttccaacccctcgctctggtggatcccagccccggcccccactcccggccctgttccccgctctccgccccggcggcttccagcagcaacagtttgggtccgcggcagcccagactcccctggtcccgcggtgctgccgcgccaagcgaaggaggaggagggctcggcgaccctggggacgaacgtcttggacgcttcgcccgcgtccttctctcgcgtccgccgcgcgcctgtctgctcggcctcttcttcgccttctctccggccgcccgggtcaaaacccaaggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcggcggggcgggggcgggggcgggtggcgcggcctggtccgctggccccgacccgcccctgcgccccgcgaccctcccgaggctcgcacggcgcccggctccgtcccgggctgggctgcgcaccgcgcctcctgctcccagagctcgcagccgactgtgcgggagctctcaccgccgcccgcgagggcccgccccgccggggcccgccacctccgccccggcccggcccggcccgctgcccctcgaggcccctcccgccgcattcccgggcccctctcccctctccggaaccgcgtccccagacctgacactcggggcaagtgcgcctcggaggacacaccag

SEQ ID NO: 81010 - DNA, 50 bp, Homo sapiens
  chr17:72889307-72889357
  hyper
ccagactctcaggttcggggtgtgaccctccatccttgggtgcggggccc

SEQ ID NO: 81011 - DNA, 663 bp, Homo sapiens
  chr17:72889430-72890093
  hyper
cgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacacccgcccccggggtcaaggtgcgagacaccctggctcctctgctgcgggcgctggcgacccaggcccggctcaggcgcgcgaccctggcaggcggcatcagaaccgccgcggagggaggagccaggccgatgagctgagagtggctaggcggggaggcgaccctgcggtgagacccagcccaggtagtagggacggaggcgtcaggggcacggagaccccagtggagacaccccccacccccgccccgccccgagggccttccctgacctccgacctcaaataact

SEQ ID NO: 81012 - DNA, 791 bp, Homo sapiens
  chr17:72919501-72920292
  hyper
caaaagtgcccaccccggggccgcgcactgtgacgcccagtccggggacagtcagagatctgtcctcactagagcctggggcgctgtggctccgtatttctccacctgtcagtggaacgaaccgagagctggggaggggtgccggagggcggggtgggggagccgtcctgagccccaggacagtggacctaagaaggggcaccgtgaccgaccgcggttcggtcagcgagtgggacgggccaggccgccgccgcctgaacggagtccctcgaccgcactccagcagggggcgctggaggactggcagcggctccgcgtgccgcgtggaacttcgcacccaagccccggagtccaacggagcgcgggccggcggcgggggcgggcagggcggtgggatagaggaaaggggagcttggatcactgcgaggaccgtgggggagaggggaactggggttgccatcccaggcaggagcacaggagcacaggattcagggtgcgccgcggctggagggcgtcagggtgcccgcaggctttttggacgtctcttgagcttagctctcggggctctgggcgcctggaatgctgcgcgccagggcgcggtgggcaccaggggcggggtgccctctaggtgccgcagtgcggggccgcgcccgagcctggccgcaccggggtgacggagtggggtcgcctctcaaagggtaaatatgaatcttgccttatctggctccagcgggctcttccctaaattcaccttggagaaagatggatcatgtgagcgggactgagagctt

SEQ ID NO: 81013 - DNA, 30 bp, Homo sapiens; identical to SEQ ID NO: 36757
  chr17:72920550-72920580
  hyper

SEQ ID NO: 81014 - DNA, 278 bp, Homo sapiens
  chr17:72920796-72921074
  hyper
tggaagaagggtggccgcctgctgtcggtgctgctggcggtgaacgtgctgctcctcgcctgcacgctcatcagcggcggagccttcaacaaggtggccgtgtacgacaccgacgtgttcgcgctgctcactgcgatgatgctgctggcaacgctctggatcctcttctacctcctccgaaccgtgcgctgcccctgcgcggtaccctaccgggacgcgcacgctggccccatctggctccgaggtgccaggggaggtgggggcgaggtagggtgggc

SEQ ID NO: 81015 - DNA, 39 bp, Homo sapiens
  chr17:72931909-72931948
  hyper
cccgagcggcggctgcgcagtcccgctgggggagggcgt

SEQ ID NO: 81016 - DNA, 654 bp, Homo sapiens
  chr17:72932011-72932665
  hyper
cggcgatgcctctcccggcctcaggtaagcccggagcgccggcggaactttcccagcttgcgcaccccagacactggcacatactacccacccccccaaaaggggggttcacaagtaggggctgcagggattggaacgggaaagcggggtgactgtggagaggtgaactccctttaatctgaggccggcccctccacccgccccgcaacccgcgctccgcgcccctactcctttccgtggacccggggagcacagagggcctcagggcgcgactcctcccggccgggtccacacagcagaaagcgcggaggcctggggtgtgaggttggttggggctgtctggacgcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgcttgtcagttccaggtgcccttgccccagccttctgcccgagacccctaaatg

SEQ ID NO: 81017 - DNA, 30 bp, Homo sapiens
  chr17:72937996-72938026
  hypo
ttccctagtgctcttcggcagctgcacctt

SEQ ID NO: 81018 - DNA, 76 bp, Homo sapiens
  chr17:72950368-72950444
  hypo
cttgtgaatggtgggcgggtccgtgggcaggttggccagctggtggaagatgctgcgcttgcggatgatggcgtag

SEQ ID NO: 81019 - DNA, 30 bp, Homo sapiens; identical to SEQ ID NO: 45162
  chr17:72969610-72969640
  hypo

SEQ ID NO: 81020 - DNA, 157 bp, Homo sapiens
  chr17:72971503-72971660
  hypo
aaagcatcgggattacaagcaggagccaccgtgctcagccttcaaaaagaagaaaaaataataaaggcaagtgaaggtatgaagaaggaggaggagaagaaggagaagaaaagaattgagaactcttgctaaccagccactccgggtgaaattttga

SEQ ID NO: 81021 - DNA, 39 bp, Homo sapiens
  chr17:73031580-73031619
  hypo
tatgtttcagtctatcgttatgaagttaaacagcagaca

SEQ ID NO: 81022 - DNA, 255 bp, Homo sapiens
  chr17:73073429-73073684
  hyper
cgcagatgctgtgctcgcgcggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccgg

SEQ ID NO: 81023 - DNA, 24 bp, Homo sapiens
  chr17:73083439-73083463
  hypo
cgagactcccggccaactgagtac

SEQ ID NO: 81024 - DNA, 504 bp, Homo sapiens
  chr17:73089623-73090127
  hypo
gtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgattccctctctctgaggccacaggctttgcctcctgggtgaattcctaaggtttcaccagatttcaccaggggcccctggctggaatccagctggactgggctggagccggggagagagtggg

SEQ ID NO: 81025 - DNA, 105 bp, Homo sapiens; identical to SEQ ID NO: 45166
  chr17:73091075-73091180
  hypo

SEQ ID NO: 81026 - DNA, 30 bp, Homo sapiens; identical to SEQ ID NO: 45167
  chr17:73091437-73091467
  hypo

SEQ ID NO: 81027 - DNA, 30 bp, Homo sapiens; identical to SEQ ID NO: 45168
  chr17:73124882-73124912
  hypo

SEQ ID NO: 81028 - DNA, 39 bp, Homo sapiens
  chr17:73128817-73128856
  hypo
gaacagggccaggtgcggtggctcacgcctataatccca

SEQ ID NO: 81029 - DNA, 120 bp, Homo sapiens
  chr17:73135899-73136019
  hypo
aagactccgtctcaaaaataaataaatgtctgtccagtcagaagtactccacccacagaggagggaggtttgtttgtttccagcccataatgagataagtacaggaattgagagtaagtg

SEQ ID NO: 81030 - DNA, 25 bp, Homo sapiens
  chr17:73138356-73138381
  hypo
agaaagcagtagaaccggccgggcc

SEQ ID NO: 81031 - DNA, 35 bp, Homo sapiens
  chr17:73145732-73145767
  hypo
attacaggcatgagccaccacgcccagccaaaaaa

SEQ ID NO: 81032 - DNA, 35 bp, Homo sapiens
  chr17:73179829-73179864
  hypo
caggcgtgagccaccgcgcccggcctacagtgtct

SEQ ID NO: 81033 - DNA, 101 bp, Homo sapiens
  chr17:73236201-73236302
  hypo
gaaagggtggtgagccgagggcgggtggggagggcctgccgctggaacggggcgcagccctccaaggactgcacggaagacagccccggaggcactcattg

SEQ ID NO: 81034 - DNA, 45 bp, Homo sapiens
  chr17:7343074-7343119
  hyper
ctgctgtccaaggtgcgactgtgcggggggcggcccgcgcggccg

SEQ ID NO: 81035 - DNA, 123 bp, Homo sapiens
  chr17:73464698-73464821
  hypo
ctgtatctgagccttcgaggctggctcagctttgaaaggcaggggtggaagagacgtggttgctcagcctagggcaccagcatgggtgccaccttgagaggaattgggcggggttttggagtg

SEQ ID NO: 81036 - DNA, 226 bp, Homo sapiens
  chr17:7348747-7348973
  hyper
ggaggtcaggccagccgaccggccgggggcgtggctttaggcaaggccggaccagggacaggctgggggcggggcctgggacgagaccaggctgagatggaccagcctttggtgaagattggatcgaaatcagaccaatggacaagctctggccgtgggtggtggacgggcctggagtagaactgggtagggtgaaggacggacctgtgatcggaccttaaagtgg

SEQ ID NO: 81037 - DNA, 33 bp, Homo sapiens
  chr17:7349226-7349259
  hyper
caggtcttaaactaacgccgcttctgggaggtg

SEQ ID NO: 81038 - DNA, 63 bp, Homo sapiens
  chr17:73518223-73518286
  hypo
gcaccacgcggaggccgcgcagttccaggaagatgtcaacgccgatcccgaggtgcagcggtg

SEQ ID NO: 81039 - DNA, 15 bp, Homo sapiens
  chr17:73522412-73522427
  hyper
ccgcgggagggactt

SEQ ID NO: 81040 - DNA, 117 bp, Homo sapiens
  chr17:73545911-73546028
  hypo
cagcctttgcccactcgctccccttccgggacctggaaaggagtcccagagcccaggagagacgggccttctcccctactccaggctaacgttgcagtctggcggcttctgcaaatc

SEQ ID NO: 81041 - DNA, 14 bp, Homo sapiens
  chr17:73584937-73584951
  hyper
gggctcctcgggac

SEQ ID NO: 81042 - DNA, 559 bp, Homo sapiens
  chr17:73585942-73586501
  hypo
gctccctccttgccccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttattgaatccttagaaggatgggcttgaaccctcctggcaggaaggggcaggtaaggggcaacaggtgctacgtccccaggaccgc

SEQ ID NO: 81043 - DNA, 48 bp, Homo sapiens; identical to SEQ ID NO: 45172
  chr17:73592635-73592683
  hypo

SEQ ID NO: 81044 - DNA, 79 bp, Homo sapiens
  chr17:73606380-73606459
  hypo
gctgcctgagctggccgagctggccaaatcccagcagcgttgaccctctcagcccggcctcgcacgggctgtggcttca

SEQ ID NO: 81045 - DNA, 109 bp, Homo sapiens
  chr17:73608267-73608376
  hypo
tgtctcaccatagagcgttactggagataacagttggtgttattgaatgggagacgttatttagatccacgatgccacacctttgttgtacctgcggtagtgccctgct

SEQ ID NO: 81046 - DNA, 62 bp, Homo sapiens
  chr17:73613362-73613424
  hypo
accctttcagcagagcgtcgttgtaaggaaccacatttctcctgcgccgtgggcttcactgg

SEQ ID NO: 81047 - DNA, 658 bp, Homo sapiens
  chr17:73615929-73616587
  hypo
acctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggtaagtgtggggcacgggttgagaggccgggcagacagccctcaccgatgctgcatctccctgtccgtcttccctgtgggggcaggggctgggagtttgggccaaatccctggaagtctggggtgctaggtggaggggcaggccagcagggggagcaggtgggcaggcaggacagggaggcacaggcagacttgctgctccaggccctcgcctgcttgcccacaggactccggctatgtcatcgccctgcgcagctacatcactgacaactgcagcctcctcagcttccaccgtggggacctcatcaagctgctgccggtggccaccctggagccaggtatcgccagaggccggcaggggctcacacagggagggcatccacttggcagaggctgcccgggggcagagggtccagtgggtgagccacatccctgggtgccttccaggctggcagtttggctctgccgggggccgttccggactcttt

SEQ ID NO: 81048 - DNA, 30 bp, Homo sapiens; identical to SEQ ID NO: 45176
  chr17:73635801-73635831
  hypo

SEQ ID NO: 81049 - DNA, 359 bp, Homo sapiens
  chr17:73636032-73636391
  hypo
tctcactgtcctcaccggcttcctccaccctgagctgtgtcagctgggtggggactgagggccaccactaggtggaagtcaccaggggtgcaatgtgtgagacctgacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagt

SEQ ID NO: 81050 - DNA, 37 bp, Homo sapiens; identical to SEQ ID NO: 16241
  chr17:73638388-73638425
  hypo

SEQ ID NO: 81051 - DNA, 30 bp, Homo sapiens
  chr17:73639482-73639512
  hypo
aacaactgctgagtccgcacaggattcggt

SEQ ID NO: 81052 - DNA, 30 bp, Homo sapiens
  chr17:73641552-73641582
  hypo
tgcttcattggttcccgggatgttaaattc

SEQ ID NO: 81053 - DNA, 275 bp, Homo sapiens
  chr17:7368947-7369222
  hypo
agccccacccactgccgcccttgttcctatgaccgctgagtgccagcctccagccgctcccccgccagcctggatcactcacctgcgctcccccgtgtgccacacttcatgcttcgtgcggtactccgccagagcaaacactttctcacaatagcggcaggggtacttcctccgccacgagtgtacattgctgtgtctcttcagactggacagggtcacgtaggaacgctcgcaggccgcgcacacatacagcacgtggccgcccaccaccttca

SEQ ID NO: 81054 - DNA, 259 bp, Homo sapiens
  chr17:73690259-73690518
  hypo
ggctcctgcctcctgcggtcttgcctcggtggctcactgactccagccctgggggttctgagcccagggaccacctggaagcgctgccccagtagtcagtccttcccacccaggcttcctcccagtagggcctttctgctgggagttctgctacaaagcctgttctccttttccagaactaaaggagctaggaatcgttcattctatttgtcttttgaagaaggattgggtgggaacacggtaacgctgagcagcccag

SEQ ID NO: 81055 - DNA, 35 bp, Homo sapiens
  chr17:73693131-73693166
  hypo
caggtgtgagccaccgcgcccggcccctcctctta

SEQ ID NO: 81056 - DNA, 138 bp, Homo sapiens
  chr17:73719889-73720027
  hypo
tgctcacctttgccccggccttgcaggcctggatggctctgccgccagcctcttttcttgtccaggcttcaggctgagcatctcttagagggcctcagggatgtccagtcctgccctgaaggccgctgaggacttagg

SEQ ID NO: 81057 - DNA, 30 bp, Homo sapiens
  chr17:73805937-73805967
  hypo
aaccagcggcgccgccggtccatccgccgt

SEQ ID NO: 81058 - DNA, 30 bp, Homo sapiens
  chr17:73811184-73811214
  hypo
gaaggggagcctgcccggccttccctcagg

SEQ ID NO: 81059 - DNA, 47 bp, Homo sapiens
  chr17:73879974-73880021
  hypo
taaacaggccaggtgcggtggctcatctgtgacgaggagtttgagac

SEQ ID NO: 81060 - DNA, 30 bp, Homo sapiens
  chr17:73895697-73895727
  hypo
ggggaggtagggacacgtcacctgtccttc

SEQ ID NO: 81061 - DNA, 216 bp, Homo sapiens
  chr17:73909942-73910158
  hypo
ggaggctgggggtgccgggggcaggggcgccatacactcagggagccttgcctggtgcatgtgctgctcctgcttccgcagccgctcctgctgttgctgcaccgcctgcaaccgggcctgctgctctgcctgcacctgctgggcctcgcgcaatgcccgctccccctcctcgtacttctcggaggccacctgcagggaggccgcctgggtcagggc

SEQ ID NO: 81062 - DNA, 110 bp, Homo sapiens
  chr17:73913787-73913897
  hypo
ggagggccaggaggacgggcctcacctgctccagcagccggctctgctcattcagccgtgcctccatcttcccgatgacctcctgttgccggctccgctcctcctccatg

SEQ ID NO: 81063 - DNA, 30 bp, Homo sapiens; identical to SEQ ID NO: 45180
  chr17:73931814-73931844
  hypo

SEQ ID NO: 81064 - DNA, 30 bp, Homo sapiens
  chr17:73934350-73934380
  hypo
gtagctttggctgggcgccatggctcacgc

SEQ ID NO: 81065 - DNA, 149 bp, Homo sapiens
  chr17:73993427-73993576
  hyper
ccacacccccctccccggcgccaccacagctagtccagaaattcccctgcctcacaagaacccacttcctctcctcccctgtccctcccggcttattgctttatgagccagctagaatcgaggccacaggcagccgttcttcctcctac

SEQ ID NO: 81066 - DNA, 69 bp, Homo sapiens
  chr17:73996851-73996920
  hypo
tcagaggaggctgagcgtcgtcacacgggccgggctgaggccctgggccctgaccgtgcagcctaagac

SEQ ID NO: 81067 - DNA, 42 bp, Homo sapiens; identical to SEQ ID NO: 45181
  chr17:74005455-74005497
  hypo

SEQ ID NO: 81068 - DNA, 74 bp, Homo sapiens
  chr17:74028304-74028378
  hypo
aggttagagatgaaacgatccctggggctgctcaaccctctgccagccatgactttgcgcggcagcttactcac

SEQ ID NO: 81069 - DNA, 154 bp, Homo sapiens
  chr17:74047840-74047994
  hypo
ctagtaaagcaaacacggccaccattcactcctggaaccaccagagcagcaccatccaatagaactctctgccacgggcaatgtcctctacgtgcaccgtccaatgaacacctgagcactcggaagttttattaatttatctatctttttatta

SEQ ID NO: 81070 - DNA, 30 bp, Homo sapiens; identical to SEQ ID NO: 45183
  chr17:74062044-74062074
  hypo

SEQ ID NO: 81071 - DNA, 95 bp, Homo sapiens
  chr17:74070385-74070480
  hyper
gactccggggcccctcatccgcctccgccccgcgtttcctccccccgatctcccaggggtcctcttttgagggcaccccagcccctcgacggtcc

SEQ ID NO: 81072 - DNA, 1020 bp, Homo sapiens
  chr17:74070709-74071729
  hyper
cgcgccgggaccactccgcagcccttcccccagcgccgccggccgctgctggggacaacctcgccctcctgtctcttgctcctcctcctgaccccagcgcacccccatccccgccccagatgaggcaaggctccctccgccttcagcccggcagagtcgcactaggagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 81073 - DNA, 17 bp, Homo sapiens
  chr17:74072049-74072066
  hyper
cgcgggactcaggtgga

SEQ ID NO: 81074 - DNA, 103 bp, Homo sapiens; identical to SEQ ID NO: 36765
  chr17:74072477-74072580
  hyper

SEQ ID NO: 81075 - DNA, 473 bp, Homo sapiens
  chr17:74072998-74073471
  hyper
cgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcc

SEQ ID NO: 81076 - DNA, 30 bp, Homo sapiens
  chr17:74076403-74076433
  hyper
acctggccctcgccacggagaccaactgca

SEQ ID NO: 81077 - DNA, 30 bp, Homo sapiens
  chr17:74081696-74081726
  hypo
gcacagctgcacagccgaggggaaggtgag

SEQ ID NO: 81078 - DNA, 193 bp, Homo sapiens
  chr17:74117868-74118061
  hyper
gcatccagagggtcccgggaacgcgacctgggggttggacaggaaaccaggggtcggggcagcctgctgggggcgtctcgtgccccccaccctccattcctctgaaccagtccggaaggggggttcggctggcaagccgcggtggcgtcagcctctggcacccgctgctgcccggcccgtggctccaggcaac

SEQ ID NO: 81079 - DNA, 183 bp, Homo sapiens
  chr17:74128189-74128372
  hypo
ctactttcctgggagcgcgggtcctggggctcagacctctctgtcctcagaacagggtggtgcggcccaagggcaggtgaggggctggtgggagtcagttcagggctgtactggaaggctatcaggggccagtagggagaccctcatccccgacagccccttccgttacggtcccccaacctc

SEQ ID NO: 81080 - DNA, 146 bp, Homo sapiens; identical to SEQ ID NO: 36768
  chr17:74136296-74136442
  hyper

SEQ ID NO: 81081 - DNA, 176 bp, Homo sapiens
  chr17:74136570-74136746
  hyper
cgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctctaacatcatccccgcagctggggagga

SEQ ID NO: 81082 - DNA, 74 bp, Homo sapiens
  chr17:74172769-74172843
  hypo
ccagcagaggagcagcgtggcagaagagcagcgcggtagggcaaagaggagccccgaggcggagctgggccttg

SEQ ID NO: 81083 - DNA, 37 bp, Homo sapiens
  chr17:74187103-74187140
  hypo
aaaaagaaaaaaaaaaaagttacgatatggattagca

SEQ ID NO: 81084 - DNA, 30 bp, Homo sapiens
  chr17:7419628-7419658
  hypo
aatgcccacctatggcggtgcaagagaacc

SEQ ID NO: 81085 - DNA, 74 bp, Homo sapiens
  chr17:74269861-74269935
  hypo
cggcccagctggtcccggggccaggagtctccctgtccccagtgcagtgtccagccctccgaagccccggcgcc

SEQ ID NO: 81086 - DNA, 37 bp, Homo sapiens
  chr17:74299237-74299274
  hypo
tacaggctggagccaccgcgcccggcccctcttgcaa

SEQ ID NO: 81087 - DNA, 22 bp, Homo sapiens
  chr17:74299969-74299991
  hypo
aaaaagtcgccaccagcaaagg

SEQ ID NO: 81088 - DNA, 30 bp, Homo sapiens; identical to SEQ ID NO: 45185
  chr17:74362291-74362321
  hypo

SEQ ID NO: 81089 - DNA, 68 bp, Homo sapiens
  chr17:74378890-74378958
  hyper
cgcagccagtaccctcgaaggctgagatctcggggagcacagcctccgattcgcgttttctaggcacc

SEQ ID NO: 81090 - DNA, 96 bp, Homo sapiens
  chr17:74390363-74390459
  hypo
gcatagtgcttggctcgatgcacaggcccagtaagggactgcggagtcaacaaggtggcaggcaaacgggcttgcctgttccggaaggatgcactc

SEQ ID NO: 81091 - DNA, 38 bp, Homo sapiens
  chr17:74459661-74459699
  hypo
ttacaggtgtgagccaccgtgcccggccttttctggaa

SEQ ID NO: 81092 - DNA, 70 bp, Homo sapiens
  chr17:74533488-74533558
  hyper
ggatggccacccccacgtcctcgcagttggcatagagccgggcccacatagcctgcaccgccttcctctc

SEQ ID NO: 81093 - DNA, 689 bp, Homo sapiens
  chr17:74533674-74534363
  hyper
cgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggtatatgtgcggggggcgggggacagccagcggtggggcggggatgtggtctgctggaaaatgtttaaaaaaacaaatccgctccaaacccccagccccgtgtgggtaagagccaatgccggcaaggtgaaggctgcgcggggtgggggcgacgcgactgccgcccgcccacccgcaggccacggcggagttgcaccgcggggcggggctcgggtaggtgtggccggggcgctgggggtcccgggaggaatgggcggtcacgcggcgctgggcggcgcgggccgcacaggagtgcgctggggcgggcgcgggccgggagcgctgggttccgggtcccagtgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccg

SEQ ID NO: 81094 - DNA, 46 bp, Homo sapiens; identical to SEQ ID NO: 36774
  chr17:74534387-74534433
  hyper

SEQ ID NO: 81095 - DNA, 190 bp, Homo sapiens
  chr17:745634-745824
  hypo
agtgctgcacatggccgggagcccgggtccggctgtgggctgcagttccgtgatcccggcggggaaggccacgtgggttactggggaggatgaaggatgaacacggggccgcgtctcacatgcaacccaccttcgaagacgccaaccagaggcacctacggcacatcccgagacacgtgggggcccgtct

SEQ ID NO: 81096 - DNA, 658 bp, Homo sapiens
  chr17:74581043-74581701
  hyper
ccacctgctagaggccggctcccaggttctcctcgtgggacacccaggaaagtgcctagggaggaggagggagtggagcgcaggacgcggcgcggggaggagaacgcggatggagccaggagtcacccctctttccctcgggcgcccgcctcttcgcggatcgcgcccgcactgggcttatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttggacccaggcaaaggccgcggggtccgggcagcgcgaggtcaaggctgggagagggttctggcgacaaagggccgcggccgagtcctcgctgagagctgccccagaggggtccacgcggaggttgggctgagggctgcgggccgccggggagccctgggc

SEQ ID NO: 81097 - DNA, 30 bp, Homo sapiens
  chr17:7460469-7460499
  hypo
ggtgtgctggccctgcgctgcctggaggaa

SEQ ID NO: 81098 - DNA, 30 bp, Homo sapiens
  chr17:74636168-74636198
  hypo
tcctttctaggatcacgtctcccactgccc

SEQ ID NO: 81099 - DNA, 270 bp, Homo sapiens
  chr17:7466705-7466975
  hypo
ctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctcca

SEQ ID NO: 81100 - DNA, 35 bp, Homo sapiens
  chr17:74823893-74823928
  hypo
ggccctttgccgtgccgtgccgtgccgtgccatgc

SEQ ID NO: 81101 - DNA, 43 bp, Homo sapiens
  chr17:74835961-74836004
  hyper
gctggctgctggctgcggtgttggacagcgcctcctaggaggc

SEQ ID NO: 81102 - DNA, 38 bp, Homo sapiens
  chr17:74854240-74854278
  hypo
acaaaaattaataaaataaaattcgaagatccccccaa

SEQ ID NO: 81103 - DNA, 425 bp, Homo sapiens
  chr17:74864643-74865068
  hyper
cgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgc

SEQ ID NO: 81104 - DNA, 225 bp, Homo sapiens
  chr17:74865069-74865294
  hyper
tccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacgttcaagtcctggtggcagagggggcggttcacacttcaa

SEQ ID NO: 81105 - DNA, 800 bp, Homo sapiens
  chr17:74865520-74866320
  hyper
tcctcaccccgcggacggtcccatccgggtggcaaagttagtgtgcggcgccttggagctccccctccggtccctcccgtcccgcccgtctgcccctaggtcggctaccccccaacccctccgcctgtgccaccctctccccagcctttggtggcactgctctcctccccgcggggctcgggcctggctccgacgagagggtcccgagattagagcgaggactcgctcatcccaggattcgcccccgatcgcaggcgtcggagaggcgggggcaggggcggcgctgcagggctacggggcggctggagccgaggctgcggcggagcgtggtgggcgggcggtggcgaaggcgacacgcttcgggcggccaacacctgggggcccaggccaggcagggctggggccgcgcgggactcactggacccagccaggggcccccagggcccagcggtgccggggcagccccctctcctcccaggcatccgcggaaccggcccgcagcggggtggggagggggcgctgcccagtggacgcccggcggggcccgagtgtcaccccgtgggtagctgggcagcgaggaagctgggggagtgaccgccccggcgcgggggccggactcgggacgtggccacaggtgggctccgggcgcgggaaggagcccgagaaggcggagcttgcaggggccctgaactcttgccctccaggtctcggcccagccccactgtggtccccctgccggctccagacggggatgggggcggggagacggtggctcacctggagcccgcctcccagcacac

SEQ ID NO: 81106 - DNA, 84 bp, Homo sapiens
  chr17:74908730-74908814
  hypo
ggctcactggagtgacgtttggggcaatgtgcaggatctacatctggctttgctgctgcaagatgcttccggggtgagggaggt

SEQ ID NO: 81107 - DNA, 30 bp, Homo sapiens
  chr17:7491930-7491960
  hypo
gcagacagggtagagcgtgccacccaccca

SEQ ID NO: 81108 - DNA, 52 bp, Homo sapiens
  chr17:74920557-74920609
  hypo
tggcctgcagcagctcgcggcctcagccagccctgggcgccaggagctcagt

SEQ ID NO: 81109 - DNA, 33 bp, Homo sapiens
  chr17:7493033-7493066
  hypo
cccctcaacgtgaagcgtcgatcctgaaaatgg

SEQ ID NO: 81110 - DNA, 506 bp, Homo sapiens
  chr17:74965247-74965753
  hyper
gctccgggtcacctgcggtgttgatgaggtattcaagaggaaaaagcgccggagcggcagcttcatttgcaagggaaatgacttgacgaggcccttcatttgcatctttcggcccagaggttctgattagctgcggaggaaaagcccgcctgttttatgcatgaggagctctgcctggagaccctcggctgctcacccgccccagccctgccttctcctcctaagtcggggaggaggagaggggtccccagagggcaggatccaaggctgaagcctaagaccaacccttggtggtgaaaatagaaatttcttgaggcaaggctgccataaagtgcagtgagactcatcggtgaggggggcactgtgcgatctccatccggggtcttcagggcaattgcatgagctcagcctgctaagagcctggcaggcagcgcgagctcccctggagttccggccgctccgcccagtggctctgtgcagcgcttcccgcccggagaacctagtgc

SEQ ID NO: 81111 - DNA, 18 bp, Homo sapiens
  chr17:75047191-75047209
  hypo
aatcatccgcttggccgg

SEQ ID NO: 81112 - DNA, 291 bp, Homo sapiens
  chr17:75049728-75050019
  hypo
agccaccaccacttccgtcatggtcggtatcatatagcggggcagagattgggctttggagcccagagaggcctgtgttcaaatcgactctgctctgacttgtggtgtggacttggccgcgggactgagcgcggggcctgctcaggggccagcgtcacagggaagacagtccgagcaagcatgggtcagggcgctgaggcttcctcctgcgagccaaagggaaactcagccacggggactcagggaggcctgtggggcaagtctgagcctccctctcggtggccagtgggc

SEQ ID NO: 81113 - DNA, 30 bp, Homo sapiens
  chr17:75054527-75054557
  hypo
cgtgcttagacttgccgtataagtactcat

SEQ ID NO: 81114 - DNA, 30 bp, Homo sapiens; identical to SEQ ID NO: 45189
  chr17:75207839-75207869
  hypo

SEQ ID NO: 81115 - DNA, 30 bp, Homo sapiens
  chr17:75326544-75326574
  hypo
tgctcttggcgatggcgtggactcagccag

SEQ ID NO: 81116 - DNA, 187 bp, Homo sapiens; identical to SEQ ID NO: 36780
  chr17:75368715-75368902
  hyper

SEQ ID NO: 81117 - DNA, 188 bp, Homo sapiens; identical to SEQ ID NO: 12903
  chr17:75368903-75369091
  hyper

SEQ ID NO: 81118 - DNA, 366 bp, Homo sapiens; identical to SEQ ID NO: 36782
  chr17:75369092-75369458
  hyper

SEQ ID NO: 81119 - DNA, 418 bp, Homo sapiens
  chr17:75369492-75369910
  hyper
cgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttcctt

SEQ ID NO: 81120 - DNA, 157 bp, Homo sapiens
  chr17:75370185-75370342
  hyper
cgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagta

SEQ ID NO: 81121 - DNA, 253 bp, Homo sapiens
  chr17:75370564-75370817
  hyper
agggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggt

SEQ ID NO: 81122 - DNA, 30 bp, Homo sapiens
  chr17:75385196-75385226
  hyper
catgggaagaagcaccgagcagccttgctg

SEQ ID NO: 81123 - DNA, 30 bp, Homo sapiens
  chr17:75411816-75411846
  hypo
cctgtctggagctgacgtgcgaccaaggca

SEQ ID NO: 81124 - DNA, 30 bp, Homo sapiens
  chr17:75413782-75413812
  hypo
ttcacaaatgtttgccgtcttttctgtcta

SEQ ID NO: 81125 - DNA, 265 bp, Homo sapiens
  chr17:75447462-75447727
  hyper
tccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgt

SEQ ID NO: 81126 - DNA, 257 bp, Homo sapiens
  chr17:75523015-75523272
  hypo
cctgggctcgggctgcgagcagccattttggaacatgtgaaacggattttaaattccctctttgcagtttgagaagatggcggcctgaaccggagtccttcttcccctcctccctctccgctgctgcaatgcccaggccccccgcaacgttcctcgtctgtaatggtgccagaggctttaaatcttgcagaagccacatctgctgcctgcaggtaaacctccctggctgagcccactgcgcacgcctccacgttctg

SEQ ID NO: 81127 - DNA, 419 bp, Homo sapiens
  chr17:75524585-75525004
  hyper
cccccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggc

SEQ ID NO: 81128 - DNA, 189 bp, Homo sapiens
  chr17:75525005-75525194
  hyper
ggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctct

SEQ ID NO: 81129 - DNA, 102 bp, Homo sapiens
  chr17:75544144-75544246
  hypo
caggcgtgagccaccgcacccggccaagctggatcttaagcttgcttaccggtgacttgttgacctcatcttggctcaaagaagacacggccccaggtgagt

SEQ ID NO: 81130 - DNA, 202 bp, Homo sapiens
  chr17:7554591-7554793
  hyper
agcaccccttttcatcgcagttggggggcctaggatcggtgcatcttccgccgcgctgccagcaccccgcagcgcgtggtcgtgcaccccggaatctgcagcagctgcatatctgaggggggtctcctttgcccgcgccgccttcgctccccgtgcttttgggtgtgtggagggcttcagcgcgcggcgcccccgcttctcc

SEQ ID NO: 81131 - DNA, 33 bp, Homo sapiens
  chr17:75548384-75548417
  hypo
tagaatttgtaacatcgacgagtgcaaacctga

SEQ ID NO: 81132 - DNA, 66 bp, Homo sapiens
  chr17:7555185-7555251
  hyper
gggggtcgccagctccgcctgcgtgtccgcgccggcgctcacactccctctcggggcctgtccgct

SEQ ID NO: 81133 - DNA, 79 bp, Homo sapiens
  chr17:75557167-75557246
  hypo
tttgaatttcaaagacgttcaaatccccatctggctgttacacttttaggctattgagagtgaaaacaagcactgacat

SEQ ID NO: 81134 - DNA, 30 bp, Homo sapiens
  chr17:75587520-75587550
  hypo
agtgccccggattggcgcatctgaagctga

SEQ ID NO: 81135 - DNA, 56 bp, Homo sapiens; identical to SEQ ID NO: 45192
  chr17:75630378-75630434
  hypo

SEQ ID NO: 81136 - DNA, 41 bp, Homo sapiens; identical to SEQ ID NO: 45193
  chr17:75733967-75734008
  hypo

SEQ ID NO: 81137 - DNA, 30 bp, Homo sapiens
  chr17:75748192-75748222
  hypo
ttccattcccacagtcgctttgggtggcca

SEQ ID NO: 81138 - DNA, 33 bp, Homo sapiens; identical to SEQ ID NO: 45194
  chr17:75770731-75770764
  hypo

SEQ ID NO: 81139 - DNA, 30 bp, Homo sapiens
  chr17:75792358-75792388
  hypo
tgatggagtacgtgtcggccctgaagcggg

SEQ ID NO: 81140 - DNA, 30 bp, Homo sapiens
  chr17:75797195-75797225
  hypo
ttcctgaccagatgacgccaacaactgtaa

SEQ ID NO: 81141 - DNA, 30 bp, Homo sapiens; identical to SEQ ID NO: 45195
  chr17:75840791-75840821
  hypo

SEQ ID NO: 81142 - DNA, 30 bp, Homo sapiens
  chr17:75849397-75849427
  hypo
cccccagactccaaacgttcccagccaagc

SEQ ID NO: 81143 - DNA, 91 bp, Homo sapiens
  chr17:75893341-75893432
  hypo
catgagaccctacctcggcctctccttctcgctgagacatctcctccctccctggtcctccaccttcaggtcctcacggctgagagcccct

SEQ ID NO: 81144 - DNA, 30 bp, Homo sapiens
  chr17:75895459-75895489
  hypo
aggttgaatgctcagcgacttcgggaatgc

SEQ ID NO: 81145 - DNA, 43 bp, Homo sapiens; identical to SEQ ID NO: 45196
  chr17:75905178-75905221
  hypo

SEQ ID NO: 81146 - DNA, 30 bp, Homo sapiens
  chr17:75925908-75925938
  hypo
gatcttccaaagccccgaactgctccgtag

SEQ ID NO: 81147 - DNA, 30 bp, Homo sapiens
  chr17:75927761-75927791
  hypo
gcagcagggaagaggcgggtccaggccctg

SEQ ID NO: 81148 - DNA, 238 bp, Homo sapiens
  chr17:75953744-75953982
  hyper
gctagcctgcttctgcgaccttgcatgaaaatggagaaaattcttggtttcaaaatcttctcctggcttgaaccgaaagttaaaaagggacttttcgaattgcacattgcgcctgaccttacctaccactaatgaataatggatatcgaggagccgtggaatggaggatcacggcggcgtacggagcaccggggaggaatcgtggggtgcgtaggcgccggagcgcccgggttcggcc

SEQ ID NO: 81149 - DNA, 57 bp, Homo sapiens
  chr17:75955156-75955213
  hyper
actcgcccgcgccgccgccgcagccgccgccgccgcccgcgccgggacctgagtccg

SEQ ID NO: 81150 - DNA, 79 bp, Homo sapiens; identical to SEQ ID NO: 45197
  chr17:76021242-76021321
  hypo

SEQ ID NO: 81151 - DNA, 27 bp, Homo sapiens
  chr17:76026881-76026908
  hypo
tagaaatgcaaattccggccgggcatg

SEQ ID NO: 81152 - DNA, 30 bp, Homo sapiens
  chr17:76034067-76034097
  hypo
aaacagatgtatacacggagagttgcagat

SEQ ID NO: 81153 - DNA, 30 bp, Homo sapiens
  chr17:76073363-76073393
  hypo
gggtgggattgcctccgggctgggcatgca

SEQ ID NO: 81154 - DNA, 30 bp, Homo sapiens
  chr17:7608216-7608246
  hyper
gagcctttctggattcgagagaggaagatt

SEQ ID NO: 81155 - DNA, 97 bp, Homo sapiens
  chr17:7608731-7608828
  hyper
tctggtggggctgagcgctctgccgcgggggcgcgggcacagcaggaagcaggtccgcgtgggcgctgggggcatcagctaccggggtggtccgggc

SEQ ID NO: 81156 - DNA, 205 bp, Homo sapiens
  chr17:76098484-76098689
  hypo
agaagtggggagggccgcactatccactggcacggggccttgtcaaccaggttctcccctcttgttgcaggttctgcctggagcaccgacacctcaggaagaaccagcagctggctcgttcttcgaaacctcactccccaggtgcaatatggtgcccctgcatcactgagcatgatccagggagggttcccgcttggcccccaat

SEQ ID NO: 81157 - DNA, 91 bp, Homo sapiens
  chr17:76101037-76101128
  hypo
gtccaggactgaagacgaaccttggccgcagtccttgcgaactgttcgcaaaacagtgcgggctgcggtgggtcagcgtcacatgctaatg

SEQ ID NO: 81158 - DNA, 34 bp, Homo sapiens
  chr17:76123797-76123831
  hyper
ctcagggctcaaagtcggccgggttgaagggcgc

SEQ ID NO: 81159 - DNA, 30 bp, Homo sapiens
  chr17:76131445-76131475
  hypo
aaccctcacgtgacccgtgaagtccagacc

SEQ ID NO: 81160 - DNA, 92 bp, Homo sapiens; identical to SEQ ID NO: 45199
  chr17:76134317-76134409
  hypo

SEQ ID NO: 81161 - DNA, 122 bp, Homo sapiens
  chr17:76134633-76134755
  hypo
cacttggccatctctcgccagcatccactcctcctgggactgcggcctcttcaccaactactcagcaccctggcaagtggtcccggagctggtggcccttgggctcccgcccattggccagc

SEQ ID NO: 81162 - DNA, 87 bp, Homo sapiens
  chr17:76135474-76135561
  hypo
aggaagagaacagctcgggctcctgagaccaggagccagacctggtaagtacatgaccttaggggctgggcctttgcctgtaatccc

SEQ ID NO: 81163 - DNA, 87 bp, Homo sapiens
  chr17:76136101-76136188
  hypo
aacaagagcaaaactccgtctcaaaaaaggaaaaaaggataacatggctgagtgcagtggctcacgccgaggcgtgaagagtgcttg

SEQ ID NO: 81164 - DNA, 333 bp, Homo sapiens
  chr17:76137857-76138190
  hypo
tcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttcc

SEQ ID NO: 81165 - DNA, 120 bp, Homo sapiens
  chr17:76138614-76138734
  hypo
gttcaccaacaaacacgattcagtgctgctagtgctgggtcctgttctgggggctggtgatgaggccaagagggaaagagggagctctgtgttccatcgagggggcgacaagcctggacc

SEQ ID NO: 81166 - DNA, 19 bp, Homo sapiens
  chr17:76146895-76146914
  hypo
agcctacactccaaacggc

SEQ ID NO: 81167 - DNA, 39 bp, Homo sapiens
  chr17:76211240-76211279
  hypo
tgcacttcacactttcggaggctgaggcgggcggatcac

SEQ ID NO: 81168 - DNA, 99 bp, Homo sapiens
  chr17:76211519-76211618
  hypo
aaaaagaaagaaagcatatacttcagtgttgttctggatttttttcttcaagatgcctagttaatgacaatgaaattctgtactcggatggtatctgtc

SEQ ID NO: 81169 - DNA, 89 bp, Homo sapiens
  chr17:76211992-76212081
  hypo
gtcccttggggaacccggggcaataatgcccttctctgcccttaatccttacagtgggccgggcacggtggcttacgcctgtaatacca

SEQ ID NO: 81170 - DNA, 58 bp, Homo sapiens
  chr17:7621433-7621491
  hyper
tactgctggcccctgcggtatttcctagtactagagtgagccccgacttagcagagca

SEQ ID NO: 81171 - DNA, 55 bp, Homo sapiens
  chr17:76217079-76217134
  hypo
gtggaagctgaggcccggccatccagggcgatgcattgggcgctgattcttgttc

SEQ ID NO: 81172 - DNA, 413 bp, Homo sapiens
  chr17:76227749-76228162
  hyper
tggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcg

SEQ ID NO: 81173 - DNA, 161 bp, Homo sapiens
  chr17:76228213-76228374
  hyper
cggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaaccccgccctgctcgtgtt

SEQ ID NO: 81174 - DNA, 18 bp, Homo sapiens
  chr17:76254836-76254854
  hyper
cgccggggaggctgctgc

SEQ ID NO: 81175 - DNA, 125 bp, Homo sapiens; identical to SEQ ID NO: 45208
  chr17:76395588-76395713
  hypo

SEQ ID NO: 81176 - DNA, 66 bp, Homo sapiens
  chr17:76396807-76396873
  hypo
tcctgcaggactgtgcggagattgccgacttcttcacggagctggtggacgcggtgggggatgtgt

SEQ ID NO: 81177 - DNA, 44 bp, Homo sapiens; identical to SEQ ID NO: 45209
  chr17:76404759-76404803
  hypo

SEQ ID NO: 81178 - DNA, 35 bp, Homo sapiens
  chr17:76405095-76405130
  hypo
ggttgccagtaagctcgcttcgaggtcttgagagg

SEQ ID NO: 81179 - DNA, 114 bp, Homo sapiens
  chr17:76419325-76419439
  hypo
tggccacctcactgccgtgtcctgcatcagcccagccacagagtcctacaggtccggggcttgcttgtgggaacggcttgttcttctagactctgggggcgggggcttgggtgt

SEQ ID NO: 81180 - DNA, 23 bp, Homo sapiens
  chr17:76441957-76441980
  hypo
attgaccattttggccgggcaca

SEQ ID NO: 81181 - DNA, 165 bp, Homo sapiens
  chr17:76455024-76455189
  hypo
ggcagcgcgagcaagcggctctggtgtttcgcagggacgggagcgagccggcacttacggcaatcttgtttttgatccgggacagcttctcttgtgcctctgccagctctgcattagcctcctccagtgcctgcctcttgggcgccacgtcgcagtagacctcgt

SEQ ID NO: 81182 - DNA, 30 bp, Homo sapiens
  chr17:76458828-76458858
  hypo
ccagtgtgaccagcccgtggatgcctgtga

SEQ ID NO: 81183 - DNA, 94 bp, Homo sapiens
  chr17:76490678-76490772
  hypo
tcaaaattcaggtcccgtttccgaggcacgtccagagccgggaagaggtccccgatcagtcccatgaatacgggcaggtcgtctgtcacaatct

SEQ ID NO: 81184 - DNA, 83 bp, Homo sapiens
  chr17:76498516-76498599
  hypo
tttggcctgtggaaacgacggttttgcggggctcagcctccgagaagaagccgctccaggtactcgcccggcaggtttcagaa

SEQ ID NO: 81185 - DNA, 71 bp, Homo sapiens
  chr17:76498901-76498972
  hypo
gaacgcaaagaaactcgccccttatctcagccacgaggcgccgccgagcccccacccgcctcagacctggg

SEQ ID NO: 81186 - DNA, 329 bp, Homo sapiens
  chr17:76501454-76501783
  hypo
gtttgtcactggcatcgagccggaacttcagtttacacaggctatcgaagagtttggacaggtggcggctcacctgggaggaggcaagaagcgggaattatgcaacgggggatttgaaaggcatgtgcgtggcttgggctttccgtgggtggttttaggcatcgttctttttggaatatactccccatctttgatcaacgttgactaaacatgactaagtcaacaaaaggaaccagcgaagactgctctgagtcaggacacagaaaccaggccaggaaccgcagcccttctaagccaaacatccattctggaagatttctttttggtgg

SEQ ID NO: 81187 - DNA, 66 bp, Homo sapiens
  chr17:76526194-76526260
  hypo
gacagagcaggtgctcggtacaccgggtttggagaagggataatgtttgctcgcagcccggtgaca

SEQ ID NO: 81188 - DNA, 63 bp, Homo sapiens
  chr17:76526566-76526629
  hypo
cctcatacagcttctcgtaggagtcgatctggaaaacacggccaccggcggcctgtcatagcc

SEQ ID NO: 81189 - DNA, 86 bp, Homo sapiens
  chr17:76557425-76557511
  hypo
ctgcagccgtccctgcgtccaccgtgaagcctccccggcccctggctgtccaggagacttggccaagtgcacgcaacagtggctca

SEQ ID NO: 81190 - DNA, 30 bp, Homo sapiens
  chr17:76562886-76562916
  hypo
cctgctgagaggactcgggactgaggcgca

SEQ ID NO: 81191 - DNA, 109 bp, Homo sapiens
  chr17:76670709-76670818
  hypo
ggccctgtgaaaacccgcagctcctccacctgcctcctcagggctgcgccctgcaccgccctggtccagggtcctgtggaggggcggggcgagacggccagacagccag

SEQ ID NO: 81192 - DNA, 172 bp, Homo sapiens
  chr17:76676165-76676337
  hypo
agcacagaagagatgcgggcggcatgtttaaccactaagatgatcaacacctggtgaggtgagggctgcaccaggcgcgcactgccctttctcagcagtcacttacttaatgcacttaatccactcctccttctcctcgggcgtcggagctgagatccggtaaacagtgtgg

SEQ ID NO: 81193 - DNA, 30 bp, Homo sapiens
  chr17:76702385-76702415
  hypo
ccccagcaaccacctcggaggcagcactgt

SEQ ID NO: 81194 - DNA, 21 bp, Homo sapiens
  chr17:76779848-76779869
  hypo
ccaccacgcctggctggattc

SEQ ID NO: 81195 - DNA, 185 bp, Homo sapiens
  chr17:76897086-76897271
  hypo
ctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattc

SEQ ID NO: 81196 - DNA, 30 bp, Homo sapiens
  chr17:76932264-76932294
  hypo
gactcactgctactccgatgattggaaaca

SEQ ID NO: 81197 - DNA, 33 bp, Homo sapiens; identical to SEQ ID NO: 45218
  chr17:76958740-76958773
  hypo

SEQ ID NO: 81198 - DNA, 36 bp, Homo sapiens
  chr17:76967407-76967443
  hyper
atcccagagcaacctcgagggcgtcctggtgcttac

SEQ ID NO: 81199 - DNA, 30 bp, Homo sapiens
  chr17:76970826-76970856
  hypo
ccagggacttgcagtcggccagtgaggcct

SEQ ID NO: 81200 - DNA, 36 bp, Homo sapiens
  chr17:76972067-76972103
  hypo
ccagagcctgggtggcgttctcgaagcccagggccc

SEQ ID NO: 81201 - DNA, 374 bp, Homo sapiens
  chr17:76974125-76974499
  hypo
atggtttctctggctcggtaagaatcctgtgatacctgacactgtcccctcagttcagcaagcctggggcaggcctctgggtggcactgctgtgggcaccggctgggagtctgggcctggtgaccttgaggctgcttggagggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccccttgtcggggctccccgggcaccactggaggccttaccgtgaccctgagaac

SEQ ID NO: 81202 - DNA, 30 bp, Homo sapiens
  chr17:76975153-76975183
  hypo
aaggggggggggcaacgaagcacctggcag

SEQ ID NO: 81203 - DNA, 38 bp, Homo sapiens
  chr17:76975538-76975576
  hypo
gaggggtgccctggccgggcgcggtggctcacacctgt

SEQ ID NO: 81204 - DNA, 190 bp, Homo sapiens
  chr17:76991522-76991712
  hypo
tgatccccaactccccgctcctcaagctgtaaccccaaccttaggattatccttaaaggctagaaaagctgaaaagtgacagcactctgaaggggcacgtgtgtcccaggggagtgcgggtgctgccctcggccacacctgaggtctcaccgagcatcactctaactccagtggccggagaggggcttgg

SEQ ID NO: 81205 - DNA, 61 bp, Homo sapiens
  chr17:76993358-76993419
  hypo
ctgtgtccaggtctgcgataactgcgattcgataccgaatcccagccggtgtcctttgtgg

SEQ ID NO: 81206 - DNA, 85 bp, Homo sapiens
  chr17:76996482-76996567
  hypo
ctcaccatgccatgccggctgcctccctccacccctcctgcctctccgcccctgacactcccataccccccgccatgaagttgcc

SEQ ID NO: 81207 - DNA, 62 bp, Homo sapiens
  chr17:76996979-76997041
  hypo
agccccagcacctgacgcactgccaggcagggagcagacagtctgcacgcattggctgaagg

SEQ ID NO: 81208 - DNA, 30 bp, Homo sapiens; identical to SEQ ID NO: 45221
  chr17:76997571-76997601
  hypo

SEQ ID NO: 81209 - DNA, 526 bp, Homo sapiens
  chr17:77002640-77003166
  hypo
tgtctatggtgtgggcgcacagcttcagaaccctctacggtttgcagttactgccttgtaaagaggctgtgtctgcttaatttgtatcatcgatgttacacctggaggaattttagccaaaaggcgaccttctcagttgaaaggcacattccaaatggcaccacacatctgggaaggtgtccttttccagagtgtgtgaaaataacgggatgggatcatcgccccatggacctggatcagggctgccttccacaccgcggtggcacctgcacgagcccacctgcttactgccaccttctctcctcacgctttcctccaggctcggctcccgggacacaaaggccgaatcgccaggactttcactcaacccggcaacaccctcagagccattctggggggtcccagtctcacctctgccccactcccacatggtggcatcacgcactgtcttaagtcttaagccagacttcaacgccttcttcacttcccataaaaccatcccagaggaacgcggggagcagcgtcc

SEQ ID NO: 81210 - DNA, 69 bp, Homo sapiens
  chr17:77020197-77020266
  hyper
cggctgctgtttggacgaaaagcgctgggggtgttggaggctcctcgctgctcacatctggctgggctt

SEQ ID NO: 81211 - DNA, 113 bp, Homo sapiens
  chr17:77020313-77020426
  hyper
cgagaaaccgcgcttccgcttctggtcgcagagacctcggagaccgcgccggggagacggaggtgctgtgggtgggggggacctgtggctgctcgtaccgccccccaccctcc

SEQ ID NO: 81212 - DNA, 30 bp, Homo sapiens
  chr17:77084562-77084592
  hypo
ggctccccagcccaccgccatgcagggctc

SEQ ID NO: 81213 - DNA, 203 bp, Homo sapiens
  chr17:77104080-77104283
  hypo
tttattggcttccttcgccttcccgcctcaattccatgctgccccttaggggttttgggagatcatctcccaaatacaccctgtgcatttgaatctttggctctgggcctcctgacactcccagtggacagctggagaccacacacggagaacccctcctcagaggccatgtggcttctgggacaggacgccagccgaaggta

SEQ ID NO: 81214 - DNA, 235 bp, Homo sapiens
  chr17:77104986-77105221
  hypo
gggctgtggagcacacgtgtccacgttcctgatgcagctctgtcccctgcgttgaacagcgaggatgcagcacacaccccacagcgtgggaaccgctgtcccgatgctcacctgggcatgcgctgcaggacctgtctcagcagacgcgccatgtggtatgctgtcccaattccgacaagcatgtgttctgagctgtacgtgttcccaaggtgtgaggctccgggtggatcctgca

SEQ ID NO: 81215 - DNA, 30 bp, Homo sapiens
  chr17:77114143-77114173
  hypo
cctgggcaacccagccgtgccctgctccct

SEQ ID NO: 81216 - DNA, 48 bp, Homo sapiens
  chr17:77126443-77126491
  hypo
gggtgagcagggctccgaggcccacagtcacttcgcaagccaacaacc

SEQ ID NO: 81217 - DNA, 30 bp, Homo sapiens; identical to SEQ ID NO: 45226
  chr17:77126850-77126880
  hypo

SEQ ID NO: 81218 - DNA, 53 bp, Homo sapiens
  chr17:77127124-77127177
  hypo
tgtacttgtgtgtaccgtgagccatgtgctgcgtgtcccgtgtgtgctgtgtg

SEQ ID NO: 81219 - DNA, 30 bp, Homo sapiens
  chr17:77135204-77135234
  hypo
cagcacatgcgttcacggtcctgccttggc

SEQ ID NO: 81220 - DNA, 72 bp, Homo sapiens; identical to SEQ ID NO: 45228
  chr17:77135878-77135950
  hypo

SEQ ID NO: 81221 - DNA, 212 bp, Homo sapiens
  chr17:77143891-77144103
  hypo
gcaagctttgccaagcgccttcgatccagcctctctctcatgctaatgactgtcaacatgaaacagaggctgtgaaggggaagaaaattactccctgaaaaggaattgactgatccccatcatttctcaaggaatcactgacctgtgaatatttcattacccaaaatgctgcaccatccatccagagccgccgctgccgtggggccccgggg

SEQ ID NO: 81222 - DNA, 154 bp, Homo sapiens; identical to SEQ ID NO: 45230
  chr17:77145129-77145283
  hypo

SEQ ID NO: 81223 - DNA, 233 bp, Homo sapiens
  chr17:77147053-77147286
  hypo
tgctggtggccgccccgctgctgtgcggctctcaccagggcaaggccacctccccagtccacgctccgcaagtgctcagcacacacacatccctccaccatgctgggccctggactctcagaaccacaataaatgcagctcttggcgcagattctgggtttgatcctcgcgctgctccccctactcggggcaagcaacaaagccggcatcagaccctgcgtgctgaccacccc

SEQ ID NO: 81224 - DNA, 182 bp, Homo sapiens
  chr17:77174854-77175036
  hypo
cccagggagtgagggcgcaggaccgctgcgtgggttcattcagaataaacatcacccgacctcaactacttgtctggttaaattctccagtgaacaggacaatttttcggatgtggctgcagccagcagaccagacctgggcagcaatggatgctgccgcgggtgcacgagctgctgttcag

SEQ ID NO: 81225 - DNA, 292 bp, Homo sapiens
  chr17:77178580-77178872
  hyper
cgcattgggtggcagcgcaggacccccgtcccctcccccaacgccccggccggccggcgggcaggcggctgctgatgctctgtgcgcacctccccacggggcatcctggggatctggtggctcagagtcgccgactttcctgcccccacccaaccccaactcgccagccggagcttcctgcgcagcccccaagattgcaaaagtctggccccagccccctccccggccagagctcctggggcctccctcgccaggcgggtggcccacctcccccgcctccccggaggcccgg

SEQ ID NO: 81226 - DNA, 102 bp, Homo sapiens; identical to SEQ ID NO: 4505
  chr17:77178962-77179064
  hyper

SEQ ID NO: 81227 - DNA, 249 bp, Homo sapiens; identical to SEQ ID NO: 4506
  chr17:77179081-77179330
  hyper

SEQ ID NO: 81228 - DNA, 75 bp, Homo sapiens; identical to SEQ ID NO: 4507
  chr17:77179380-77179455
  hyper

SEQ ID NO: 81229 - DNA, 27 bp, Homo sapiens
  chr17:77179456-77179483
  hyper
gcaggggggcgcccggcggcggctctg

SEQ ID NO: 81230 - DNA, 92 bp, Homo sapiens; identical to SEQ ID NO: 4509
  chr17:77179617-77179709
  hyper

SEQ ID NO: 81231 - DNA, 67 bp, Homo sapiens; identical to SEQ ID NO: 36799
  chr17:77179710-77179777
  hyper

SEQ ID NO: 81232 - DNA, 443 bp, Homo sapiens
  chr17:77179799-77180242
  hyper
cgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgcgctggggaaggctt

SEQ ID NO: 81233 - DNA, 211 bp, Homo sapiens
  chr17:77188723-77188934
  hyper
gagagctggaaggaccgggcacgagagtgagaccgtcagcaccagggacagctccagccagaccctggagccgccgtggctgcctacacctctgtctccctgggcccaaacaagcacgggtgtcagtgaactctctgttttgcaggggtggccagcggctagccctgctgatggccaccttttaccaaaacatcctcgcctgttgagttag

SEQ ID NO: 81234 - DNA, 65 bp, Homo sapiens
  chr17:77200378-77200443
  hypo
gcgggcgccggggagcgggtacacaccagcgggtgccggggagcagggggcgtaggtggggttgg

SEQ ID NO: 81235 - DNA, 179 bp, Homo sapiens
  chr17:77216294-77216473
  hyper
tccacagcaggctcccggggaggaggggaggagacccaatcagggaagcggccgctggcggcaggttggtgggggtaggggcttggtcccccaacgctggcactcagtttagctgtcacttgcagctgtcttaggaagtgcggctctcctctctgcctcccgctcgctcctgctcactc

SEQ ID NO: 81236 - DNA, 198 bp, Homo sapiens
  chr17:77240121-77240319
  hypo
tgaaggagataccaccgcacagggcagaatggtgtccccagagtccatgtccatccggaaccttatttggaaacaggttctttgcaaatgtaattagtgaagatgaggtcatagtggaacagactgggccctacatccaatgcccggggtcctcatcagttgaggagaggacacagagagacacgcattgggtgaggg

SEQ ID NO: 81237 - DNA, 93 bp, Homo sapiens
  chr17:7727249-7727342
  hypo
accaaccttggctcccgcttcatcgagccgcctgtgctgaatatgaagtcggtcggtggctcggcttccttgtccccacggcccatgggtctt

SEQ ID NO: 81238 - DNA, 143 bp, Homo sapiens
  chr17:77290782-77290925
  hyper
cacgcggccgaactccggactgggggccacgtggaggaggccttggttcagctctgccccatgcctcacgggacacacatttatcacctggaaacagcggccagtgctcaggaaggctcatgccattgcggatctgccttcat

SEQ ID NO: 81239 - DNA, 30 bp, Homo sapiens
  chr17:77306065-77306095
  hypo
ttcatttgtgcacaacgccctaaaacggaa

SEQ ID NO: 81240 - DNA, 40 bp, Homo sapiens
  chr17:77356491-77356531
  hypo
gctgctcaccagccccgccaagcgccgcaccctggggccc

SEQ ID NO: 81241 - DNA, 183 bp, Homo sapiens
  chr17:77365331-77365514
  hypo
ccacctccccaggcacggcgccacctccacatctgtacccaaaggcaccggagtttctaccacagtctgcccccactccccggggaggggctgatgggggctcaccagaggggttgccctggaccctgaccgtgacccttgccgtgactgctgggggcaaaggacacgcgtttcggagggttt

SEQ ID NO: 81242 - DNA, 45 bp, Homo sapiens
  chr17:77390958-77391003
  hypo
agaagggcctggagacgcaacacaggcgctcggggcgtgtgcagg

SEQ ID NO: 81243 - DNA, 171 bp, Homo sapiens
  chr17:77772124-77772295
  hyper
ccagtgcgggctgggcgagagggtctcacgcgcgaagatggcgggctcctggaaagggacaagggccggccgcgaccgccttgccgtgcgcacacaagcacgtgcaccgccgaccctgccgccagctaggctaccggtgacccgtggcgggggcggcgctggggacagcag

SEQ ID NO: 81244 - DNA, 364 bp, Homo sapiens
  chr17:77772527-77772891
  hyper
gcaggaagcccagagcggaaaactggcctcctgtccaaagtgaggcgcgcgcaggcggcggcagccgcgaggtcctcgacccgccgggcaagcggggcgcttcgcccatcttccctcccagtcgtgccccagcctctggaaacacgggtttcaggttttggccttgttcctaaacttcacaaggtggccgcttgtcgaacagtcccatctctccggccgttctgtctgaacgaacagcgcgtcgaggacgctcagatctcccagtgaccctcgcgggccgcccgtgggaggccgccgacggccgcgtccttaatcataaaaagtcattcccggtaacaaatagtttcgtcggccggtgccagcg

SEQ ID NO: 81245 - DNA, 30 bp, Homo sapiens
  chr17:77773662-77773692
  hyper
caaaactatcgcttgcgaaaagtctgagtt

SEQ ID NO: 81246 - DNA, 52 bp, Homo sapiens
  chr17:77774368-77774420
  hyper
ccgctgctcaggctgcggctgccaggttggcgtgcgccgcctctgcagtaaa

SEQ ID NO: 81247 - DNA, 165 bp, Homo sapiens
  chr17:77774622-77774787
  hyper
ttacggaaatgcgggcgcccgccctcctagggacacctgcttcccaaacccctaggtctccggccctgttccgcactcttctggcgacctgggcgcacggcccgcgactgcccttcccgacaaagggtctgcgacctgctcccgggagcccgccctacccttggc

SEQ ID NO: 81248 - DNA, 39 bp, Homo sapiens
  chr17:77775268-77775307
  hyper
gcctgccgcctgctgcgggaatgccgcagggtgacccga

SEQ ID NO: 81249 - DNA, 27 bp, Homo sapiens
  chr17:77776539-77776566
  hyper
cttgggcatctggaccggttgggccac

SEQ ID NO: 81250 - DNA, 317 bp, Homo sapiens; identical to SEQ ID NO: 36806
  chr17:77776679-77776996
  hyper

SEQ ID NO: 81251 - DNA, 597 bp, Homo sapiens
  chr17:77777052-77777649
  hyper
cgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcatgagaaaggcggggagcaccaaccctcccacgggaaaacacggggagaggctgggcgagtcaaggaatggtggcaccagagcctgggcgcagagaggcagctggacctcctgggctcccttgagccggagctccgccagggtgggcacttctgcctccagcgatgctgggtgccacagtcctcccgcctcctcctggaccacacgcggctctccagagtcccagggaagctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgcc

SEQ ID NO: 81252 - DNA, 254 bp, Homo sapiens; identical to SEQ ID NO: 4512
  chr17:77777650-77777904
  hyper

SEQ ID NO: 81253 - DNA, 88 bp, Homo sapiens
  chr17:77777943-77778031
  hyper
cgacgcctttcctcgcagccccggtacagggcttcctcggtgcacccctagccgttgccccgggaggaggcgccgtctgggacacgaa

SEQ ID NO: 81254 - DNA, 624 bp, Homo sapiens
  chr17:77778434-77779058
  hyper
catctggggctgtcccgcgccgctaccggcaccgtcttattcatcctgagagccgcactccctcatttgcataataatggcttatctagaataacacagcaatcagaggcaaaattaattttcttcagctagtccttgagatcctaaaaacagaggaggcttatggcaagaaaagccggtttagcagagggtgtagggttcctgaccaggaccaaggagagagaaagtttaaagcagtggaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagctccggggtctgggtccggaccttccagggactcagttccgcaccctttgaacagatcaagacagagcacttccttgctctgggatggtcgcctcagccaccgagacagcagaagt

SEQ ID NO: 81255 - DNA, 30 bp, Homo sapiens
  chr17:77786072-77786102
  hyper
ccccaggagcagaagcgctcccgaatctgg

SEQ ID NO: 81256 - DNA, 338 bp, Homo sapiens
  chr17:77786467-77786805
  hyper
tcccctgccctggtgcgcccccgggccctgccctgagcccatgccccaggccgggtgtccagttcaccctgagctccccttggcgcccggagaagggtgctcgggcccgggtgctggggagcggcggggtggccgccggcgcctcttcggcgcggatggctctcggcggggccgaggagggggtcgcagagcggctccccgccgagaggagggtgggcgctcggcacctgctgagctacggtggtggctgcggtttatggcgcccgaggatccacccggatcttctccgcggagttccgggcttggctcgtctgtagtcagcacgcacacagctttgt

SEQ ID NO: 81257 - DNA, 27 bp, Homo sapiens
  chr17:77789473-77789500
  hyper
cgtccagccagccgccttgtccatgag

SEQ ID NO: 81258 - DNA, 569 bp, Homo sapiens
  chr17:77807459-77808028
  hypo
ctagaactctgaggccgggcgcagagctgccctgtccgttccgggggtccatctccagcggggaagggcaggagagggcgagccccgccggcaccgcgtggaaggggcctccgcccaggtctgacagccgccgcagggggaacatggttacctccgctccgggcgtcctcaccctgggggccagcctgggtctctcgcggttggcgggttggcgagaggggagcccgccccgaggccccaggtgctcagctccccgcccccccgcgggaatggcgcttccccttccgacgccctccggctacaccgtcacgtactccttgaaagtaacggtgaggcagttcgcggtgacgtcggtgataattatattcccaaagaagggcttgaactcgctcagcgactctgcaggttcgtcctgggcctcggctggaggcttctccgccgtcgtggtgggtgccgctgccgccgccaccgccaccgccgccgacgccggtgtctcgggcttcacctggagggagctgggcggctccccggcctcgctgcgcgtcttgacgcagcgcaagtctatgggt

SEQ ID NO: 81259 - DNA, 375 bp, Homo sapiens
  chr17:77808375-77808750
  hypo
aaaggcctccttggtcggggacagcttgcgggagccggcatcctggggctgcggatcgctaaccccggacacctcctcctccctcctcttgggcggcgcctccaccttcttctcctctgcgcccgccgcctttttaaaagtcctgtcggcaggagggtggcgctcgtcggctgcccgcttcttgtggctgggggagcgagcctccccctctgccacctcgccggacttgatcttcaccgcctgcatgccgttctccatgtatttgctcatcacgatcacgatgcgtccgttcttgttcttgttcttgactatcttcatcttgcccccaatcccgttgcccgtcacagcctctttgggggccggcatcattccgtt

SEQ ID NO: 81260 - DNA, 80 bp, Homo sapiens
  chr17:77809064-77809144
  hypo
tcttgctgttgagctcgtactgatgcccctggcccttcccctgcgcgcccaaatccagcttggcacggttgtcagtggag

SEQ ID NO: 81261 - DNA, 121 bp, Homo sapiens
  chr17:77814048-77814169
  hyper
aagctaggcgagaggcgtaggaggcagagagagcgggcgcgggaggccagggtccgcctgggggcctgaggggacttcgtggggtcccgggagtggcctagaaacagggagctgggagggc

SEQ ID NO: 81262 - DNA, 179 bp, Homo sapiens
  chr17:77814750-77814929
  hyper
ggagggaggagcctgcgcggggctcgtgttcgcccaggaatcccggagaagctcgaagacggtctggtgttgaacgcacacgtggactccatttcattaccaccttgcagctcttgcgccacggaggctgctgctgcccggcggctgctacccaccgagacccacgtggcccctcccca

SEQ ID NO: 81263 - DNA, 785 bp, Homo sapiens
  chr17:77815150-77815935
  hyper
atatttttctcctgccgtgtttggctttttcctggcatttttgcccagggcgaagaactgtcgcgcggggcagctccaccgcggagggagaggggtcgcgaggctggcgcgggaagcgctgtaggtggcagtcatccgtccacgccgcacaggccgtctgcgccgtcggaccatcgggaggtctgcagcaactttgtcccggccagtccccttgtccgggaaggggctgagcttcccgacactctaccctccccctcttgaaaatcccctggaaaatctgtttgcaatgggtgtttccgcggcgtccaggtctgggctgccgggggaggccgagcggctgctgcagcctccctgctgccaggggcgtcggactccgcttcgctcactacgcccaggcccctcaggggcccacgctcaggacttcggggccacacagcaggacccggtgccccgacgacgagtttgcgcaggacccgggctgggccagccgcggagctggggaggaaggggcgggggtcggtgcagcggatcttttctgttgctgcctgtgcggcggcaggaagcgtcttgaggctccccaagactacctgaggggccgcccaagcacttcagaagcccaaggagcccccggccacccccgctcctggcctttttgccaacgactttgaaagtgaaatgcacaagcaccagcaattgacttcccttccgtggttatttattttgtctttgtggatggtgggcagatggggagagaggcccctacctaacctcggtggctggtccct

SEQ ID NO: 81264 - DNA, 30 bp, Homo sapiens
  chr17:77818158-77818188
  hyper
acacctggggggtcccgatgcctctgcagg

SEQ ID NO: 81265 - DNA, 534 bp, Homo sapiens
  chr17:77825231-77825765
  hypo
accacctgatcactacggtcccagccctgtccccaccaacactcccaatctccttattcctgcttacatagcaccctcacctccttacagacagtatcctctggatgttgatggtgtttccagcctgcatctcctgttggaacataagagctgcaagcgtcggggcgtgtccacacccttgtccgacgtgtccctggcatctggcacagtgcccagcacgtacctgtcagatgaatgttgaattaataggatttgtgtgaggaccgagtgagctcacacagccagatgaagctggtccacccgtacgggctggcaagagccgttggccacattctcagacattttgtgaacccgttgttgaacccagccatgattacaaattaaatgattggcatttacaattaaattatgtaaagaacaacaataataaatgctcactactgactccttcctagtgatttcctcagattcacatgttcccgggttctttgtgtcccctgtgtgtggtggaaaacgccacgcaggggcagctgc

SEQ ID NO: 81266 - DNA, 44 bp, Homo sapiens
  chr17:77827279-77827323
  hypo
gactggcctattttattatttgtgaatggcgtgctatgcatcct

SEQ ID NO: 81267 - DNA, 23 bp, Homo sapiens
  chr17:77837400-77837423
  hypo
gagacagagtcttgccgtatcgt

SEQ ID NO: 81268 - DNA, 30 bp, Homo sapiens
  chr17:77899529-77899559
  hypo
gccacatagctatgccgcccaggggctggg

SEQ ID NO: 81269 - DNA, 313 bp, Homo sapiens
  chr17:77904151-77904464
  hyper
cggctcggtggggttcgcggcgcacggaccccgcccccaaggcctcaggtgggccgggggctccgggaggcctccgccgccctccgtcccaggagagcagttcccggtgagaagcccgggctctgcagacaccccacagcagttctgcgtctcggaaaacgcggcgccttcatcaggaccgcacgaaggagggggtggggaggcgggtccagcctcgcgaggagccggccggggtctggggggccgtggcagaggggagtcccgctttctgtctaagcctccctgtgccaagtaggcccgaaccccacctttg

SEQ ID NO: 81270 - DNA, 106 bp, Homo sapiens
  chr17:77926452-77926558
  hypo
tacctgaagaaaaggcggagggagcgcatgtggcccaggtccacgcggaacacgccgcaaatctgctccagggcgcacacccgctgcggctcgtcccagcgtgggg

SEQ ID NO: 81271 - DNA, 221 bp, Homo sapiens
  chr17:77948898-77949119
  hypo
aaggccacaaacacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtac

SEQ ID NO: 81272 - DNA, 181 bp, Homo sapiens
  chr17:78010865-78011046
  hyper
ggggctgttggataccgcccctgaccttgctccggggccactcgctgtggccggagaccagcccggccccgcgcctccctcctgcaaggacagatcccctctcgcaggcttgggggtgacccgcgatgggaggggtccctgcggttaggcggcccgcgatagtccgcggtcaccgtcctgg

SEQ ID NO: 81273 - DNA, 30 bp, Homo sapiens
  chr17:78041466-78041496
  hypo
atccgcgaatgctaacgctcaccaggatgc

SEQ ID NO: 81274 - DNA, 159 bp, Homo sapiens; identical to SEQ ID NO: 36819
  chr17:78045491-78045650
  hyper

SEQ ID NO: 81275 - DNA, 138 bp, Homo sapiens
  chr17:78059751-78059889
  hypo
agtcactgcgcccagccctaattttgctttttgatgaatatccggtctagggggaagaagtggggcccctggagcttgaaatcaaaaggctgagcaagctgatcgacgagcacgatggcaaggcggtccaggcccagg

SEQ ID NO: 81276 - DNA, 71 bp, Homo sapiens
  chr17:78073436-78073507
  hypo
cagcgcctggacaagcgactggctctcatcgccaccatcctggaccgcgtgcgggacgagtacccccagtt

SEQ ID NO: 81277 - DNA, 279 bp, Homo sapiens
  chr17:78078871-78079150
  hypo
gacatcctgaccctgcggctggacgtgatgatggagactgagaaccgcctccacttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatc

SEQ ID NO: 81278 - DNA, 71 bp, Homo sapiens
  chr17:78083747-78083818
  hypo
ctgccatcagcagctcgggccctgccgggagctacaggccctacgacgagggtctgcggaggggggttttc

SEQ ID NO: 81279 - DNA, 93 bp, Homo sapiens
  chr17:78112862-78112955
  hypo
tcatctccagaatctcgtgtggcagcgtggcactgatgagaaccacctgtgtggctggaggcaggtacctgtatacatcgtaaatctgctctt

SEQ ID NO: 81280 - DNA, 30 bp, Homo sapiens
  chr17:78122014-78122044
  hypo
tgctttttgtttgttcgtttgtttgttttg

SEQ ID NO: 81281 - DNA, 89 bp, Homo sapiens
  chr17:78122164-78122253
  hypo
aggtgtccacgcgcagccactaaccgctttcttatctgacactttaagtgcttcttcgtacccagctcctctaacgccttttgaagcag

SEQ ID NO: 81282 - DNA, 81 bp, Homo sapiens
  chr17:78143912-78143993
  hypo
acggaggggctcagccgacacaggtctgatggggcccgagagtggtcccaggggagtgggaggggccggcatcttcctcat

SEQ ID NO: 81283 - DNA, 178 bp, Homo sapiens
  chr17:78151768-78151946
  hypo
ttcagcattcttttgcggggggccacaatcagtgacaccctgactcgcaagcctcaatcacctgttccagtgagaaacaggactgagatcagaaggaatgaggcagagctgccctcgattggttctcctctcctcctcacctgcccaccccggcctctgcgcccgtcactgtcctctc

SEQ ID NO: 81284 - DNA, 58 bp, Homo sapiens
  chr17:78152480-78152538
  hypo
tgggacggcttctggcgctgctcctgcacacacgactctccaacgatcattttccatg

SEQ ID NO: 81285 - DNA, 30 bp, Homo sapiens
  chr17:78439146-78439176
  hypo
cagaagtgtgcaagccgagaacagtttcag

SEQ ID NO: 81286 - DNA, 63 bp, Homo sapiens
  chr17:78447061-78447124
  hypo
cctggccgggcacagcgtaggagaagggcgtgcccacacctggcgtggcgctggacttgagcc

SEQ ID NO: 81287 - DNA, 30 bp, Homo sapiens
  chr17:78447361-78447391
  hypo
tctggagacgcagagcgggtagcttcccag

SEQ ID NO: 81288 - DNA, 1512 bp, Homo sapiens
  chr17:78449408-78450920
  hyper
tccagggtgttcacccgggacagcacctgcctctccagctcatcgatcttgctctgcagcagatccttgaggctgttggtctggctggaggaattgaggcggctgtactgctgcggggtgcaagggcgggggaaaccacaccgttaggcgaggcgcggggaccgtgctggaaggcccgcggcgcggtcccctctgggcgactgcgggggcggcctggcagggagctggggcgagtggccgccgcggggcctcgcaggcgcggggaggcaccggccgggcacccgcgcggctgaggcgagggcgggggatgcctggccgggtagggaacggggtgggggagggcagaggggcgagcgagccggagggggaaccggagccgagggcgcgcgcggacctcgaggttctccaggcgggttttgagcgattgcaaagtttgcccgagttggctgagcgtctcggcggccggtgtccgggacaggtcgcccatggtgttcttgcccgagccgggctgcttgcggccgccgcccgcccgggcctcgccggctccggggtccagcgtgctctggctctcgcagcggcccagcttggcggtcagctcgcggatggtctccttctggctcaggatggtctccttctgctgcagcaccgtctcgcggagctgcagcacgctgctccggagctcctcggcgccgccggcggccacggacgcggcgcacatgtcggcgtccacgggcaccgaggtgcagatgaagcgcgtcggcccgaaatcctgggccccggcgcccaggaggcagagggcgagcagcgcacaggtgcgcgcggcgcggccggccggcatggctgcgggcaccgggcgctccgggcccggctcggctcggctggggctcggctccggctgggacccggctcgggctgtggctccgcgagcggcccgcgctctgggcgccgcgctcttcggccgcgcggtccacaccgccgcgctatcaggcccccactgccgcctgcgctgcggagcccgcgccttttatgccgccgcgggaggggcctcgagccgccgacgtcagcgggggaggaatcccgctttaattgtccgcggcccgggcccgcggcgcggcgggggtctcacgagcgcgccaccggggctgcctccgctcgcgtcccccccgcccttctgggagctgccgcggccccctcctcccccgcccccgcctgggccggcgctgctgccccgaaggctccgagagctcagggggaaggaagtcgggctccggccccggactcgaggatggaccacctgcgtggtgtccccgaacctccgacggggctccaggcgggcgggaaaccaccgcgtccgggagatagaattcggttcggccctcctggctgcactgaacacccttgggccggggtcgtttggagccgggctgggtgcccaaggacccaggtcgtcaacacccgagtgcccggtggtcaacggctcggagtggggcctcgcggcgccactaagtccag

SEQ ID NO: 81289 - DNA, 652 bp, Homo sapiens
  chr17:78451302-78451954
  hyper
gggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctg

SEQ ID NO: 81290 - DNA, 877 bp, Homo sapiens
  chr17:78452108-78452985
  hyper
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggatggtgttgtgaacagccagtgatcccggccctgcctgagt

SEQ ID NO: 81291 - DNA, 79 bp, Homo sapiens
  chr17:78496397-78496476
  hypo
tgtttcactgcttttcgaggctaaataaggttccattgtatggagacaccaagttttgcgtatccgttcacctagcaat

SEQ ID NO: 81292 - DNA, 33 bp, Homo sapiens
  chr17:78517569-78517602
  hypo
gattataggcgtgagccacggtgccctgcctac

SEQ ID NO: 81293 - DNA, 145 bp, Homo sapiens
  chr17:78518203-78518348
  hypo
tatgaaaaaattaaagagaaaatctgattgacactgtggaggacactacactccaaaaaaaaaagtactatattttctaatattatcagtgctttttaatattttctaatattatcagtgaagcttttgccgctttttcaaaatc

SEQ ID NO: 81294 - DNA, 33 bp, Homo sapiens
  chr17:78539654-78539687
  hypo
tctttgggtgttaagcggcgagccaggagctgc

SEQ ID NO: 81295 - DNA, 75 bp, Homo sapiens
  chr17:7856906-7856981
  hypo
tgctcgcttgaccgccgctcacctcgtgctttgcagtccgattccaaacagtccacagaccgctactgattggtg

SEQ ID NO: 81296 - DNA, 153 bp, Homo sapiens
  chr17:78587674-78587827
  hypo
agtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcact

SEQ ID NO: 81297 - DNA, 346 bp, Homo sapiens
  chr17:78599426-78599772
  hypo
ggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgatt

SEQ ID NO: 81298 - DNA, 370 bp, Homo sapiens
  chr17:78667873-78668243
  hypo
cgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacaatctctcag

SEQ ID NO: 81299 - DNA, 52 bp, Homo sapiens
  chr17:78772792-78772844
  hypo
cgttcacatctgtgccggcatgacctccctggggaagcgtttgcattgctgc

SEQ ID NO: 81300 - DNA, 49 bp, Homo sapiens
  chr17:78773568-78773617
  hypo
caccccttccctccccggcgaccctcgttgggagcgtgtgaaggatggt

SEQ ID NO: 81301 - DNA, 30 bp, Homo sapiens
  chr17:78792696-78792726
  hypo
tggggtgtgggacctcgtgggaagctcttt

SEQ ID NO: 81302 - DNA, 30 bp, Homo sapiens
  chr17:78794230-78794260
  hypo
gcagccacccctgttcgcgctggcgcttga

SEQ ID NO: 81303 - DNA, 65 bp, Homo sapiens
  chr17:78820077-78820142
  hypo
tcccttcgtgcaccccgcaggctctccctctttggcatgcccagagcgcccgcttctcagccgcc

SEQ ID NO: 81304 - DNA, 42 bp, Homo sapiens
  chr17:78861192-78861234
  hypo
ctgactccaggggtgcgcctccatcctcgtcatagagtcctg

SEQ ID NO: 81305 - DNA, 65 bp, Homo sapiens
  chr17:78867045-78867110
  hypo
gtgccagggtgtgtgcgccagggtgcgtgtgtaccagggtgtgtgtgcgccgggtgtgtgtgtgc

SEQ ID NO: 81306 - DNA, 30 bp, Homo sapiens
  chr17:78869491-78869521
  hypo
gccccaggccttccacgggatcctctgttc

SEQ ID NO: 81307 - DNA, 96 bp, Homo sapiens
  chr17:78872638-78872734
  hypo
ggttcctggggatggcggtccagccacaatgacagcagcgcatgacaggagcccaaagacccgaaacagacgcagggcatccgccaaggcagttcc

SEQ ID NO: 81308 - DNA, 158 bp, Homo sapiens
  chr17:78874417-78874575
  hypo
ccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatca

SEQ ID NO: 81309 - DNA, 83 bp, Homo sapiens
  chr17:78897683-78897766
  hypo
ctgctgggtgtgtcccggtccctctgcctgcactctttaggagcactgctgggtgtgtcccggttctccgcccctggttctgg

SEQ ID NO: 81310 - DNA, 39 bp, Homo sapiens
  chr17:78946490-78946529
  hypo
tgaaagccctgaccacgtgcaggatgcccatcctcacag

SEQ ID NO: 81311 - DNA, 30 bp, Homo sapiens
  chr17:78957836-78957866
  hypo
aaccttagagcagagcggggggaagtgggg

SEQ ID NO: 81312 - DNA, 43 bp, Homo sapiens
  chr17:78968896-78968939
  hypo
ggaggccatggtaggcggccgggtgcttcgccctggagtgcag

SEQ ID NO: 81313 - DNA, 77 bp, Homo sapiens
  chr17:78975561-78975638
  hypo
aggctgcagacacttcgctggaaggcacacttgccacggggcaggcagtgtggcagtcagaaatgtgtgggatggaa

SEQ ID NO: 81314 - DNA, 16 bp, Homo sapiens
  chr17:78975938-78975954
  hypo
gcgggtccatcctgga

SEQ ID NO: 81315 - DNA, 15 bp, Homo sapiens
  chr17:78977598-78977613
  hyper
gctgggtaatactcc

SEQ ID NO: 81316 - DNA, 131 bp, Homo sapiens
  chr17:78977693-78977824
  hyper
cggggctgtgagagcggagtttcctctctccggtgaccctgagctgcgcctttctcagccgcctcccgaggccccaggcgctctgcgggggctctggcggggttggtgggggtgggcgttctcgttgtttc

SEQ ID NO: 81317 - DNA, 392 bp, Homo sapiens
  chr17:78978124-78978516
  hyper
cgcccttcctggctgcggctggacccggctgcgcggggcgcgaggctgcctttcccgggatcaccagggaccacccggcgcgctccccgggaatccgcacccctggccccagcgctccggagcgacccgggtcagcccctggctgcctgcaatgggcccccgggcgaaccccgggcggacccaggagtgagcacccggtgcgcggcaacgatgatcccgcaagggaagctcacgggaggcaggagctgtggcagccgccccaggatggggcgcggggagcgcgctgagctgtcctttcccgcagcggccccgcggttgaagcgtgggcttgggttttggtttttcttctgtggcaacagttctgttgagatattactcgcctgccatacaac

SEQ ID NO: 81318 - DNA, 30 bp, Homo sapiens; identical to SEQ ID NO: 45252
  chr17:79001034-79001064
  hypo

SEQ ID NO: 81319 - DNA, 30 bp, Homo sapiens
  chr17:79001300-79001330
  hypo
actaattatactgagcgttaagcaaagttc

SEQ ID NO: 81320 - DNA, 52 bp, Homo sapiens
  chr17:79001565-79001617
  hypo
ctgcccagctccagacgtgtggctgaagcggccagctcggccagttcgtccc

SEQ ID NO: 81321 - DNA, 96 bp, Homo sapiens
  chr17:79009595-79009691
  hyper
tggggctcctccaggcgcggttgcgcgagcctcgggcacttcattctcaacaggctttcccttcccacaactcctgcccggcgcccatgctggggc

SEQ ID NO: 81322 - DNA, 74 bp, Homo sapiens
  chr17:79035028-79035102
  hypo
gtttaaactcatgtacggtgttatctgatgatataaattcttttcatggctaaggcagacggtgtattatgatg

SEQ ID NO: 81323 - DNA, 30 bp, Homo sapiens
  chr17:79048658-79048688
  hypo
tgtggcaaagcacaccgccagggaacctcg

SEQ ID NO: 81324 - DNA, 160 bp, Homo sapiens
  chr17:7906254-7906414
  hyper
atcccatgggttactcgggcttggagaaactcggggttacggggagaaccctaggggaggccggggtctcagtcgctcagcctgctccgtctgtgttcgcagaagccggcaatgaccgcctgcgcccgccgagcgggtgggcttccggaccccgggctct

SEQ ID NO: 81325 - DNA, 142 bp, Homo sapiens
  chr17:79066660-79066802
  hypo
gtttatcagtgtgtccgcggggcgtggtcacagcctggtccagctcctccttagaacagaggggtgtggctgtgtccacagggcccggaatggggctgagagcagagcccagcctgtgcccaccgctcgggggcagggagca

SEQ ID NO: 81326 - DNA, 525 bp, Homo sapiens
  chr17:79093956-79094481
  hypo
cgcgacccccagccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcctcgctaggctcctggacgctgtagcagcggagctcctcgtcagactcgtcgctgtcctcactgtcctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 81327 - DNA, 46 bp, Homo sapiens; identical to SEQ ID NO: 45255
  chr17:79094742-79094788
  hypo

SEQ ID NO: 81328 - DNA, 317 bp, Homo sapiens
  chr17:79096940-79097257
  hypo
caggataccccatctcggcctggctgtccgggacagggcagtggggccctcaccagcggtccgacagggtcagctgcagctggggcttgggcagcttgagctgctgctcccggaccgtgtacgccagcacctgctggtccgagtgctggggatagggctgcgtgcccagctcaaagagctcccagatggtcacgcccagggacctgtggggcgacagccgtgagccagggctgggcacagcctgccacagcaaggaccgcgcaggatccccggggcgccgaatggggcagctcccgccatcacgccagtgcctcagg

SEQ ID NO: 81329 - DNA, 48 bp, Homo sapiens; identical to SEQ ID NO: 45257
  chr17:79098155-79098203
  hypo

SEQ ID NO: 81330 - DNA, 188 bp, Homo sapiens
  chr17:79099741-79099929
  hypo
gttggagaggacagccgtgcggcgtctggggctgacggggccacgtgtccttcgccacttcttccagcatgtccccccggggtccccaggggctgggcatcctggcccaagcaggacagaaccctccctccagggtccttcgaagcagggtctgtctccctcaagccccaaagcgagggcttagcaga

SEQ ID NO: 81331 - DNA, 75 bp, Homo sapiens; identical to SEQ ID NO: 45259
  chr17:79100184-79100259
  hypo

SEQ ID NO: 81332 - DNA, 352 bp, Homo sapiens
  chr17:79104807-79105159
  hypo
ccagcacctgggccccggagggaggccaccccatctccccacccagccctcacctgagcgcccaggctgcttggccatgggcaaggagacctccgtgagtggcaggacgtacacgtcgggcccgttctgtgctgccgtggccggggagccctgcgccaggtcggctgcgtactcgtccccctccgcattctcaaactcctgcgggccgggccgggcatgagcggggcttctcgcaggtcaaggaagggtgtggctgggcctggaaaggcccctttcttccagggccgagctcccagggcagggcaggagggggtgctcggcccagagttggagccaccgcccctgcaggcca

SEQ ID NO: 81333 - DNA, 30 bp, Homo sapiens; identical to SEQ ID NO: 16265
  chr17:79107633-79107663
  hypo

SEQ ID NO: 81334 - DNA, 84 bp, Homo sapiens
  chr17:79127888-79127972
  hypo
aaaacaaaacagagcagtgccatgtagaagatgaatgtgagcgtcttctccaaggagagccacagcctacgagaaaaaaagcag

SEQ ID NO: 81335 - DNA, 30 bp, Homo sapiens
  chr17:79130785-79130815
  hypo
cctctgggacagcaacggtgcccccacagg

SEQ ID NO: 81336 - DNA, 141 bp, Homo sapiens
  chr17:79131533-79131674
  hypo
cacctggaatgcccccggttccccaggaggctgatccctgacagtggagaagcctccaaggggcaggcagctccagctaaggtcccacagcccccatctcttcgctcctggcctgtctctgctcgacgcacactgtccccc

SEQ ID NO: 81337 - DNA, 30 bp, Homo sapiens
  chr17:79133024-79133054
  hypo
gggccctcactccagcgtccacgatagcag

SEQ ID NO: 81338 - DNA, 256 bp, Homo sapiens
  chr17:79139708-79139964
  hyper
gcgcgcaggccgggccgccagggactcaccggggtcgaagtgcgagctgaaggcgaagctggggttgaagaaggacgacgacatggccgggccagcggccggcgggcatcccgggagggcgctgcgctcaggacgcccgcggccccggcccgagccgccgcatcacccagcggccgccgcaggtgcggagcgcgccggcccccgcgccccgcgccccccgccgcagccgcagagcccgcaccggtgggggcggcgg

SEQ ID NO: 81339 - DNA, 105 bp, Homo sapiens
  chr17:79155470-79155575
  hypo
cttcattgagtggaacgagatcaagtaatggctggcggccacggaggggtggggcccaggccacccagaccacgccgaatgcccacatggcggacccggccttcc

SEQ ID NO: 81340 - DNA, 168 bp, Homo sapiens
  chr17:79158112-79158280
  hypo
ctcctgatgcagccacgtggcccccttgcctcctcagccaggcgccaccttgccctggggcctttgcacctccagccctcagcctggcatgctcttccctagacatccggctgcaagacagactctctcttcttcgatgttttctgcaaatgtcgaatcccaatgagg

SEQ ID NO: 81341 - DNA, 256 bp, Homo sapiens
  chr17:79166315-79166571
  hypo
tcagccctcagggctcgggtcagtgcagagctgctctcctccagctgctgcctcagctcttccagctccgcccgctgcctgcggccagggaggagtcagcaggtgaggggtcatcgagtaaggagtcagggatgggagaggtcagcgggtgagggggcgggggggaggggtcagccagcgaggggtccctgggagagggcgtggtgcccccgggcggcacctggctgcctgctggcccagccgctccctctcctca

SEQ ID NO: 81342 - DNA, 30 bp, Homo sapiens
  chr17:79178454-79178484
  hypo
gagcagagcaatgcacgaaacctgctcctg

SEQ ID NO: 81343 - DNA, 43 bp, Homo sapiens
  chr17:7919589-7919632
  hyper
cgcctgacctgcaaccggggtgaggggccggcctccgcggcag

SEQ ID NO: 81344 - DNA, 40 bp, Homo sapiens
  chr17:79197382-79197422
  hyper
tctccaaagttttaacgctgcgccccgtgcgtagccgctc

SEQ ID NO: 81345 - DNA, 212 bp, Homo sapiens
  chr17:79205207-79205419
  hypo
cattcactggtcccacgcaggtggcaggtcagcagctgcagcacggcctcacagttgagcagtccacacctgcacagaggggacacctgggtggcgggtgcggcccgttccctcctccctcgcccacggttggggctgaggcagagcagggcgggtccgggcgcactcacgctttgatgaagtgctgtgcctcctcgcggctcaggaaggcg

SEQ ID NO: 81346 - DNA, 125 bp, Homo sapiens; identical to SEQ ID NO: 45263
  chr17:79211706-79211831
  hypo

SEQ ID NO: 81347 - DNA, 30 bp, Homo sapiens
  chr17:79220179-79220209
  hypo
cagctgccctgggggcggcatccttctggc

SEQ ID NO: 81348 - DNA, 30 bp, Homo sapiens
  chr17:79220690-79220720
  hypo
tgggtttatcctcctcgtcctcctgcctct

SEQ ID NO: 81349 - DNA, 30 bp, Homo sapiens; identical to SEQ ID NO: 45264
  chr17:79226304-79226334
  hypo

SEQ ID NO: 81350 - DNA, 39 bp, Homo sapiens
  chr17:79257246-79257285
  hypo
agtcgccgatcacgacgtagaaggcgatgcaggtgccca

SEQ ID NO: 81351 - DNA, 18 bp, Homo sapiens
  chr17:79292579-79292597
  hypo
ggccgggcatggtggcgg

SEQ ID NO: 81352 - DNA, 77 bp, Homo sapiens
  chr17:79292717-79292794
  hypo
gtctcaaaaaaaaaaaagaaaagtttcccacggcctggggttttcagtgctaataccgggatcgccctgggcaaact

SEQ ID NO: 81353 - DNA, 38 bp, Homo sapiens
  chr17:79309612-79309650
  hypo
atgggtaggcatggccgagggcacgaggtggtcacagg

SEQ ID NO: 81354 - DNA, 390 bp, Homo sapiens
  chr17:79316623-79317013
  hyper
gagccggggccgcctcgggagcccctcgctggctcctgggcgccccactcggctcagcaatgtccgggccagacaaaggagtcgccagggaggggttaatccgcccctcacccttctccgtccttccttccgcccccttctcaggcggcgcggaggagagaagatgcggcccctaataatgtgtttggtttaacctgcggggtgtgggtatttgctgcgctttcttgggtgagggttgggccccttcccttccaccttcctccactcctgtgcatgataccctggctggggcctggggcgtcctgcgctggccagaagtcagggtcaccagggactctccgttctcgctcccgaagaggggacttgcgcggacggcgaggaggatcgatg

SEQ ID NO: 81355 - DNA, 94 bp, Homo sapiens
  chr17:79317370-79317464
  hyper
ggtggcccttctagccgctaggcccacgacaggacttctagggaggggtccctgcaaatgcccttgggcgaagagaggacggaaagaatattct

SEQ ID NO: 81356 - DNA, 57 bp, Homo sapiens; identical to SEQ ID NO: 36829
  chr17:79317833-79317890
  hyper

SEQ ID NO: 81357 - DNA, 36 bp, Homo sapiens
  chr17:79318173-79318209
  hyper
ataacattcttctttcgactccggcttccgagccca

SEQ ID NO: 81358 - DNA, 41 bp, Homo sapiens
  chr17:79505417-79505458
  hypo
ggccacaccgtggtccgcaggctccccgagaagctgattgt

SEQ ID NO: 81359 - DNA, 221 bp, Homo sapiens
  chr17:79544089-79544310
  hypo
tgccaacaaaccccacggcctgctgagtaagcaatgcctggccacagcaaggggcagtgggttcctcagagataccctctggcccctccacagctggctccttgaaggaacgctgttcccttgctgctcctatgtcccctcagctccccacggcgctctgacccgccccaccccatcactgtgtagtcctcgccagactgcctgtccgcacagctctccag

SEQ ID NO: 81360 - DNA, 161 bp, Homo sapiens
  chr17:79609256-79609417
  hypo
actcaactgtgactccggcatctgggtagggctcgcacctcccccattcccatgcccagggctgcactgttcacagactagcccagggccgcagtcaggaccagcccagcagcccagccacagaggagccagcgaacctctcccggcgcctgtgctggggg

SEQ ID NO: 81361 - DNA, 48 bp, Homo sapiens
  chr17:79612764-79612812
  hypo
ccacatgcatgcacacgtatacccacatgtacacgcatatccacactg

SEQ ID NO: 81362 - DNA, 34 bp, Homo sapiens
  chr17:79615102-79615136
  hyper
ctccggcggtggctgcgcgcgaacctggctgcct

SEQ ID NO: 81363 - DNA, 28 bp, Homo sapiens
  chr17:79615434-79615462
  hyper
cgggtgacttcgccgcaggacctaccca

SEQ ID NO: 81364 - DNA, 256 bp, Homo sapiens
  chr17:79619054-79619310
  hypo
tgtgagtgtgcctcacgtgcatatgtggaggtgtgagcgtgtttgtgcataagagtgtcatgcccgtgtgtgcgcacacgtgtgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtggcagtggttgtatt

SEQ ID NO: 81365 - DNA, 104 bp, Homo sapiens
  chr17:79626311-79626415
  hypo
acctgggtgacagagcgagacctcaactctgaaatagtaaaataggccaggcatggtggctcatccctgtacttttggaggacgaggtggctggaccacctgag

SEQ ID NO: 81366 - DNA, 104 bp, Homo sapiens
  chr17:79626655-79626759
  hypo
ttaaacggtgatgtggaacactctttaaattgtcgttcaccacattttcatatcttcacaataatgcaaaacacagtcacttgcagaaccggttctgatgactt

SEQ ID NO: 81367 - DNA, 82 bp, Homo sapiens
  chr17:79634674-79634756
  hypo
tgccagacccaactattgtttctcttactgattctgcttgtgctttacttgggacgggtctcacccccgtgttctttctccc

SEQ ID NO: 81368 - DNA, 30 bp, Homo sapiens
  chr17:79635057-79635087
  hypo
cgctgtggttccagacgaggcttggaagga

SEQ ID NO: 81369 - DNA, 30 bp, Homo sapiens; identical to SEQ ID NO: 45271
  chr17:79643888-79643918
  hypo

SEQ ID NO: 81370 - DNA, 37 bp, Homo sapiens
  chr17:79663023-79663060
  hypo
gcaggcgtaggtgcccgcgccacggggcctcggctca

SEQ ID NO: 81371 - DNA, 87 bp, Homo sapiens
  chr17:79668241-79668328
  hypo
cagtggggattgtcccgtacgtctgctcacagggggagacgcatacccgaggccccttctcagcagacagaacgaggacacaagtct

SEQ ID NO: 81372 - DNA, 145 bp, Homo sapiens; identical to SEQ ID NO: 45272
  chr17:79668589-79668734
  hypo

SEQ ID NO: 81373 - DNA, 226 bp, Homo sapiens
  chr17:79677781-79678007
  hyper
agcccaggcttggtgcgggcagtgctgcactgcactctcctggttgcctcctgagcacctccacccgcttccccaccaggcgtggctgtgttttcacccccagtgtccatctggcacccttctcgattgccaggtagttacggtctgtgtgggcaacacctgagggacccaaccaaaccaaggtccaggacacacttccgggcaggggtaccgcctctggttagct

SEQ ID NO: 81374 - DNA, 30 bp, Homo sapiens
  chr17:79691709-79691739
  hypo
ccactatggcctgagcgtctgccttatcat

SEQ ID NO: 81375 - DNA, 36 bp, Homo sapiens
  chr17:79695465-79695501
  hypo
ggccagctctagctggttttacgggtgaatttttac

SEQ ID NO: 81376 - DNA, 228 bp, Homo sapiens
  chr17:79761585-79761813
  hyper
aagggggcgagggggcgcccagggaggcggagggagcgagaggaaggggggctgagccacggcccccacgcccgcgcgcccctccgcgtcccagggcgtcccctcccggagctgggacccaccgcgaccaccacctgctgggccagggtccgcgggctcaggggtctgcaggattagggtctgcggaaccaggacccgtgggacaaaggtctgtggggcgcgggtccg

SEQ ID NO: 81377 - DNA, 839 bp, Homo sapiens
  chr17:79761833-79762672
  hyper
cgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccgg

SEQ ID NO: 81378 - DNA, 49 bp, Homo sapiens; identical to SEQ ID NO: 36363
  chr17:7976269-7976318
  hyper

SEQ ID NO: 81379 - DNA, 455 bp, Homo sapiens
  chr17:79769238-79769693
  hypo
ggacagggaggaggacgggcgctgactggctgtgcccacagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 81380 - DNA, 95 bp, Homo sapiens
  chr17:79774960-79775055
  hypo
atcaagaataattcacgttagaaataaaaatacagagcaaaatttaaaaatgcaaagaatgaggtgaagagttcaaagtggtcacctcggggccg

SEQ ID NO: 81381 - DNA, 125 bp, Homo sapiens
  chr17:7982585-7982710
  hyper
atctctcaaggataacgagagacggctgaatacatgcaggtccacacgctcacataagcgcgcgcacactcggaggagcattcgcgcacacagaggctcagcggcagcgccgcctgcagcccagg

SEQ ID NO: 81382 - DNA, 52 bp, Homo sapiens
  chr17:79826977-79827029
  hypo
gcggccccgcttccccgcctggcagcacgcacccaagcggccccctctgccc

SEQ ID NO: 81383 - DNA, 34 bp, Homo sapiens
  chr17:79847763-79847797
  hypo
agtgtggggatactccggccgcaggcacacagcg

SEQ ID NO: 81384 - DNA, 751 bp, Homo sapiens
  chr17:79859940-79860691
  hyper
cttgcgcgcctccagcgctcgcccgcgcggctggttcctttgggatgcggaggtgcgacggctcctccgcgcgcgcccgctgcaccccagcccgcccgccgcccctcccggccctccgcagcctcggcccgccctcgccgcagatataaggcggcccaggcggtggctgctccgagcccggacgccgccgcccaccagtcagccggcgtccccatggcccggtccgcgacactggcggccgccgccctggcgctgtgcctgctgctggcgccgcctggcctcgcgtggtacaagccagcggcggggcacagctcctactcggtgggccgcgccgcggggctgctgtccggcctccgcaggtccccgtacgcgcggcgctcccagccctacagaggggcggaacccccgggcggggccggcgcctccccggagctgcaactgcaccccaggctgcggagcctcgtgagtccggcgtgccggggactgatggggggcggcggcaggacgtgggtgggggtgcggcggcccctcagcctttgcttgcctgccccccaggctgtgtgcgtccaggacgtcgccccaaacctgcagaggtgcgagcggctccccgacggccgcgggacctaccagtgcaaggcgaacgtcttcctgtccctgcgcgcagccgactgcctcgccgcctgagcccggacctctcctggcaccgctgggggccccccgcccccaccgtcccactcggtgaccccaggcc

SEQ ID NO: 81385 - DNA, 147 bp, Homo sapiens
  chr17:79870402-79870549
  hypo
tctgcttctgcacagcgacttccgactgtggctgccttcttcaccagcacgcaggggagtcgccagtgagaaaatgggatcctgccacctgccaaaaagggaaagcggcatcaggcgggcctgggagcctctcgcagtcacacctgc

SEQ ID NO: 81386 - DNA, 391 bp, Homo sapiens
  chr17:79874636-79875027
  hypo
agcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaatctcacccatccttcaaggcccaatcaaggccacctcccacaaaaagccaacgcaggtgggtttcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacacccc

SEQ ID NO: 81387 - DNA, 58 bp, Homo sapiens
  chr17:79886467-79886525
  hyper
ccgagccccacagcacgttgtcgccgtgtgcgctgtggggctgcgtgtggttcttacg

SEQ ID NO: 81388 - DNA, 30 bp, Homo sapiens
  chr17:79887265-79887295
  hypo
ttgtagaaagagtatcgagggaggggaggt

SEQ ID NO: 81389 - DNA, 259 bp, Homo sapiens
  chr17:79887590-79887849
  hypo
gcacactcatctccacgaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcagcttctgtgggactgagccccgcaggcacctccccggcatcctcccgcc

SEQ ID NO: 81390 - DNA, 77 bp, Homo sapiens
  chr17:79892813-79892890
  hypo
gctgccactgagccccgtgacggcatcaatcaggtcctcttccacctccgtgcagaagcccacgctgctcagcagct

SEQ ID NO: 81391 - DNA, 97 bp, Homo sapiens
  chr17:79899293-79899390
  hypo
cagcggatacaggaccgcagccgtcgcgcatagcagggtggccagcatggcgaaggcggcggtgaagttgccccaggagagccgcaggcagccgtgg

SEQ ID NO: 81392 - DNA, 23 bp, Homo sapiens
  chr17:79913143-79913166
  hypo
actgcgcccggcctacaagacct

SEQ ID NO: 81393 - DNA, 30 bp, Homo sapiens
  chr17:79913444-79913474
  hypo
gcctcccctgacccccgctgctgcccccac

SEQ ID NO: 81394 - DNA, 197 bp, Homo sapiens
  chr17:79914766-79914963
  hypo
acggcggatggcctccgtgggcgcgcacgtgatcgtgtcgacgcagtctgtgtggcgatactgcttgttgtccaggaaccagccggagtcagccaggcctcgcacctggatggctgggtagcccagcttctccagctgctcagccacacggtccacattcaggagcaccccggtgccccccgcgctgcaaggagggc

SEQ ID NO: 81395 - DNA, 66 bp, Homo sapiens
  chr17:79917369-79917435
  hyper
cgggagctcatgaggcgccgcatggtgtcgtatctggagtcgcagttctcgcggttgaagcagtac

SEQ ID NO: 81396 - DNA, 140 bp, Homo sapiens
  chr17:79918501-79918641
  hyper
agtaggaggtgcaggcgcaggtcctcgttgagctgctgcgcggagcaggggtacagggactgcgccaggctcttgacttgcgccatgaagctgtccatgttaccctccacggccgtgaagtccagcgggaagctctccac

SEQ ID NO: 81397 - DNA, 30 bp, Homo sapiens
  chr17:79926633-79926663
  hypo
ggtagaaactagattcgtttaatgaaataa

SEQ ID NO: 81398 - DNA, 87 bp, Homo sapiens
  chr17:79950224-79950311
  hypo
ccctccctgagatcccgcatgagggagggaatctgatccctctggaggagccgcacatcaaagccgggctggcgtttgatgtcacgc

SEQ ID NO: 81399 - DNA, 30 bp, Homo sapiens
  chr17:79952351-79952381
  hypo
ggagccagtgctgctcgcccctcctgtgcg

SEQ ID NO: 81400 - DNA, 30 bp, Homo sapiens
  chr17:7996014-7996044
  hypo
tccctccctgaccaccgtccctcatgtttc

SEQ ID NO: 81401 - DNA, 76 bp, Homo sapiens
  chr17:79973168-79973244
  hypo
tcgtccgagcagtggcgatccctcccgagtcaaggctgggcacaagcacgtggggacaggccgggtaggctgcctg

SEQ ID NO: 81402 - DNA, 30 bp, Homo sapiens
  chr17:79977416-79977446
  hypo
ggcccttgtgggaaacgggaaaacacgtct

SEQ ID NO: 81403 - DNA, 30 bp, Homo sapiens
  chr17:79982080-79982110
  hypo
ctgaaaaggggcccacggggagggccttgg

SEQ ID NO: 81404 - DNA, 54 bp, Homo sapiens
  chr17:79987004-79987058
  hypo
aaggccatgcaggagcgggtgcagaggctggaggcggcgcggctgtccctggag

SEQ ID NO: 81405 - DNA, 622 bp, Homo sapiens
  chr17:79988475-79989097
  hyper
gccctgcagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgatacattctggccccgcctctccctccaaacgcgcgaccgtccgtgcctctccaaacgcgcggccctctgccc

SEQ ID NO: 81406 - DNA, 30 bp, Homo sapiens; identical to SEQ ID NO: 45281
  chr17:80163670-80163700
  hypo

SEQ ID NO: 81407 - DNA, 63 bp, Homo sapiens
  chr17:80186555-80186618
  hyper
gacgttgggacctgccgcgctgcgctccgaggcggggaaacggagggacggcggggcggaggg

SEQ ID NO: 81408 - DNA, 231 bp, Homo sapiens
  chr17:80188720-80188951
  hyper
gccacgccgggcagccgcacgcaacggaaccgaaccgccgggctcctgctccgagacccgcagttcacgagtcgacgcccccgagtcccgagccgcgcccactggtcccacctctgcagcaagtggagtcggccccgccctgtggcttcgaggccccgacgcctggcgcggctcccgggctccgctgaccccggtggacccgcgcgccggcaattacggtagcgtccagta

SEQ ID NO: 81409 - DNA, 30 bp, Homo sapiens
  chr17:80192672-80192702
  hypo
aggggtctgcggacacgcttgcaggaggaa

SEQ ID NO: 81410 - DNA, 30 bp, Homo sapiens
  chr17:80193470-80193500
  hypo
cagaatcatggtgtgcgtggtccctgccca

SEQ ID NO: 81411 - DNA, 157 bp, Homo sapiens
  chr17:80194730-80194887
  hypo
ccactggggtcatcacgggtgagtggggccggccggtgggccgcacgtgccaggaggggcaggggccgtgcacttctgctcctgggtccaggcctctggaggacagcagggcgggtggctgcggggtgtcccggccccacctcgttgtccccctctc

SEQ ID NO: 81412 - DNA, 30 bp, Homo sapiens; identical to SEQ ID NO: 45282
  chr17:80201941-80201971
  hypo

SEQ ID NO: 81413 - DNA, 30 bp, Homo sapiens
  chr17:8021183-8021213
  hyper
cccattcgatctagccgctgcttggggctt

SEQ ID NO: 81414 - DNA, 30 bp, Homo sapiens
  chr17:80222132-80222162
  hypo
ggagggctccacagacgtggcacagccact

SEQ ID NO: 81415 - DNA, 90 bp, Homo sapiens
  chr17:80229870-80229960
  hypo
gatcttggaataactcgtgcattgcacaatcccactaacaagtgcggaaaattaagttactttaaaattacaaacttgggccaggcgcgg

SEQ ID NO: 81416 - DNA, 29 bp, Homo sapiens
  chr17:80230200-80230229
  hypo
caagagcgaaactccgtctcaggaaaaaa

SEQ ID NO: 81417 - DNA, 252 bp, Homo sapiens
  chr17:80240815-80241067
  hypo
gttccaccctccctgcgcagggctgggcacaccgggcgccgtcagtacactgtctgcaatggccgagaaggcagcgctccatgcaggaggaacgatgcgtccttgccactgccctcatttgtgacttgggacagctgctcccagcaggatggtgtcctttcctccagagccaggggaggagtgaggcctggtgcccgggcggtacctgcctcacccaggtcgcagagagctattcctcggcagcctctgcca

SEQ ID NO: 81418 - DNA, 46 bp, Homo sapiens
  chr17:80246775-80246821
  hypo
cagagggacaccctccgacacacctggccagcgctcctcaaaactg

SEQ ID NO: 81419 - DNA, 99 bp, Homo sapiens
  chr17:80251905-80252004
  hypo
tgacttaggtatatacgcatggggggaatcctcgtaaggcaagaacgtgctgcacattctggggactgggacaggataagcacacgagtagatctaagt

SEQ ID NO: 81420 - DNA, 259 bp, Homo sapiens
  chr17:80254257-80254516
  hypo
ctgcgggacagacccggcattcttcgttatccattcattcgttgacggacacttaggcgagttccgtaccttgattgcagtgactaatgctgccctaatggcatttcattggaaatgaactattacaggagggtttttgaagtggcttatgatccagaaaaggaatcttccaatacctctgtgccccaaaaccttgggtaaaataccaacagtgcagttggtctaaaaggcaccacttaaattgcgttgcagatgacgt

SEQ ID NO: 81421 - DNA, 30 bp, Homo sapiens
  chr17:80268179-80268209
  hypo
gaatcttggggagcacgggcctgagcacaa

SEQ ID NO: 81422 - DNA, 30 bp, Homo sapiens
  chr17:80272271-80272301
  hypo
gcagcatgggagctgcgctggctggggaag

SEQ ID NO: 81423 - DNA, 63 bp, Homo sapiens
  chr17:80274115-80274178
  hyper
gaggaaggagatcaccgccagggccgcagggagggcagaggctgctggcgggtcagggagggc

SEQ ID NO: 81424 - DNA, 35 bp, Homo sapiens
  chr17:80277765-80277800
  hypo
tgtgtgcagagaagggtgcacgtgactcacgcgtg

SEQ ID NO: 81425 - DNA, 50 bp, Homo sapiens
  chr17:8027872-8027922
  hyper
ctgggtgaatctgtccgactcaaccgaagctctgccgggaggttggagag

SEQ ID NO: 81426 - DNA, 80 bp, Homo sapiens
  chr17:80281051-80281131
  hypo
caggaggagagggggcgcaggaccagaggtggaaggagacccagagcgcaggtgtgtcggggcagcgagggaaacatcta

SEQ ID NO: 81427 - DNA, 156 bp, Homo sapiens
  chr17:80287972-80288128
  hypo
cagggggcctgggtccggctccctcaccccacgctccacgatgccagctcagccacccaccttggaaccgtgcagatggacagcagggagggtcggggctgctgggggctcccccactgctctccgcaccaccccgccgaccgtgtccgggagggg

SEQ ID NO: 81428 - DNA, 497 bp, Homo sapiens
  chr17:80289234-80289731
  hypo
ggcagcaggtgtcagcgactttgggttgctgtgggaatttgctccgtttatcagaagaaaacgcaccctggcaacacaggcccctctcaggtcaccaggcacatctggtcacatctgagtctcagataaacaaccaatgatgtcctggtgaaagcttgtcccgtgggacactcgggacacacttatattaaaacacgattaacgatctcaaactcagatgttactgggtatcctgcgtttttgttggcagctctgccactctgcccgtctgcctgagtcctctcctgccatcctcctgaccagaggcgtgggcttgagttgaatgccacgcagtggctaaaaatcagagagagggcaggcggcagggcgcggccccagggaaagtggccaggtgggcggtgactggccgggcagctccgtgtgtggcacagggagacctggcacagggagaccaggtacagggagacgaggcgcacggagcctcaaaacttctagag

SEQ ID NO: 81429 - DNA, 76 bp, Homo sapiens
  chr17:80290031-80290107
  hypo
caaaaaacaaacttctagagcgggaaaagatggaggcggcaatcagatttctctcaaaccacgaacacaggggtcg

SEQ ID NO: 81430 - DNA, 43 bp, Homo sapiens
  chr17:80291659-80291702
  hyper
gggccagggaggaggcggcggacccgcgcgggacccacctccc

SEQ ID NO: 81431 - DNA, 30 bp, Homo sapiens
  chr17:80294443-80294473
  hypo
gagccactgtgctggcggcatttgcttttc

SEQ ID NO: 81432 - DNA, 135 bp, Homo sapiens; identical to SEQ ID NO: 45289
  chr17:80300182-80300317
  hypo

SEQ ID NO: 81433 - DNA, 750 bp, Homo sapiens
  chr17:80329251-80330001
  hyper
tttctatgaccctctcggggtttaggggtgttcctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggc

SEQ ID NO: 81434 - DNA, 57 bp, Homo sapiens
  chr17:80330164-80330221
  hyper
cgcgcacaactggggagcccggtgcaccctcggcttctgcgccgtcccctgggtgag

SEQ ID NO: 81435 - DNA, 43 bp, Homo sapiens
  chr17:80332249-80332292
  hypo
ctggcagctctgtgccggagccgcctggcggccccaacgcaac

SEQ ID NO: 81436 - DNA, 191 bp, Homo sapiens
  chr17:80333050-80333241
  hyper
accaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccc

SEQ ID NO: 81437 - DNA, 30 bp, Homo sapiens
  chr17:80336816-80336846
  hypo
atgtcagcacggggccgatgaggacagaat

SEQ ID NO: 81438 - DNA, 151 bp, Homo sapiens; identical to SEQ ID NO: 45290
  chr17:80338743-80338894
  hypo

SEQ ID NO: 81439 - DNA, 30 bp, Homo sapiens
  chr17:80344822-80344852
  hypo
cctcacaaggggctacgggggaaggaaagc

SEQ ID NO: 81440 - DNA, 49 bp, Homo sapiens
  chr17:80394753-80394802
  hypo
cagcccatggtgcctcgggacggccaccgtgcaccggtgcctcacctcc

SEQ ID NO: 81441 - DNA, 46 bp, Homo sapiens
  chr17:80395100-80395146
  hypo
ccttcaagggtgccacggggcccagccaggccgtgccccctgttga

SEQ ID NO: 81442 - DNA, 216 bp, Homo sapiens
  chr17:80447977-80448193
  hypo
acaggcgtgagccactgcacctggcaaaaaatttttttttaaaaaggagaaagcagtttaaccacaaacagtgaaacagagctggcagacgcctgaaactccatggaaccatgcagctgtaccctagggctcctcccaggaaaagagagatgtcaacgtggcccaaggtgtcctgaagcactgggattggattaactcgagcgatggccttcccag

SEQ ID NO: 81443 - DNA, 53 bp, Homo sapiens
  chr17:80448677-80448730
  hypo
ccacagctggcctgccgtgaagccgcccctgcaggtcgcgtggggaggccagg

SEQ ID NO: 81444 - DNA, 30 bp, Homo sapiens
  chr17:80453489-80453519
  hypo
actgaaagtatgagccgggacactcaaagg

SEQ ID NO: 81445 - DNA, 30 bp, Homo sapiens
  chr17:80453917-80453947
  hypo
acgttgccaagagcacgggagggaggggag

SEQ ID NO: 81446 - DNA, 56 bp, Homo sapiens
  chr17:80455848-80455904
  hyper
gcgcagtgactggcccggaattccgcgcgtcttcccggtagcgtttttcctttgtc

SEQ ID NO: 81447 - DNA, 180 bp, Homo sapiens
  chr17:80479365-80479545
  hypo
acgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgcggtggctcac

SEQ ID NO: 81448 - DNA, 32 bp, Homo sapiens
  chr17:80485937-80485969
  hypo
tgctgggattacaggtgcgagccaccctgcct

SEQ ID NO: 81449 - DNA, 30 bp, Homo sapiens
  chr17:80517466-80517496
  hypo
atcctgctggaacctcgtgccaggctggtc

SEQ ID NO: 81450 - DNA, 84 bp, Homo sapiens
  chr17:80518273-80518357
  hypo
attacaggagtgggccaccgtgcccggccctcctcgctgttatttaagggaagcggtctcactgtgtggcgcaggctggctttg

SEQ ID NO: 81451 - DNA, 30 bp, Homo sapiens
  chr17:80526057-80526087
  hypo
caggtggagacagcccgaaggtaaaggctt

SEQ ID NO: 81452 - DNA, 64 bp, Homo sapiens
  chr17:80535317-80535381
  hypo
gcagggcgtggcgggcggccgggttaaggtctcgcagccaaagctgcggcgtgctcactgccca

SEQ ID NO: 81453 - DNA, 657 bp, Homo sapiens
  chr17:8055166-8055823
  hyper
tgagcattttctgagcgccaggggaaaagggaaggttgtggccaacagcaggaaccagcgctgggaacgggatgttctagtccgaagtgggctgacatcacaggcggcgcagggccagggactggagaacagagacacggggagcgctgaaagcctaatagggtcctggtaccggggcaaacctggggcccctcgagtaacgagcaagaagaccggggcatgcccgctgagagtcggctgtggggccgggaaagctgggacggggaggtggggacaagctggaggtaagatgagtgggtcaggagtgcagactcccggtgcaagatttcgaggaggacttcggtccttgggggcagggagagggtgggtagcggtaaggacgacagtgtgccctctgcctgggccgaaagtagcccatcagattggaagtggcagcggtccggctcagggacggagatcggccccaggatggccgcagagatgcctacctggtcgcaggagtgtcctccgcacgcctgcccgccgccgctccagcccgcagccgagtggaagctccaccgggcgggcggggaggcgggttgcataatgccgggcactgccccctcattggcctcttgccgacggagccgcaggccccgcccccgattggctggggat

SEQ ID NO: 81454 - DNA, 75 bp, Homo sapiens
  chr17:80572274-80572349
  hypo
tgaagctccaggctccgcacccagtgaccctggcttccaccttgtcctgtcacaggccggcgcctcttcaggccc

SEQ ID NO: 81455 - DNA, 95 bp, Homo sapiens
  chr17:80603615-80603710
  hypo
agccaaaaactggaacgtacccaaatgcccaaccatggtagactggatatatgaattgttgtatgtctgcacaaaagaacattgtacatcaagaa

SEQ ID NO: 81456 - DNA, 444 bp, Homo sapiens
  chr17:80654726-80655170
  hypo
tatctagaaatgtgacgaatggaagctttttgttttctttccttctaattacacttccacagccacacgtggctcatggcatcctactggacaccacggtcctagagacctgccaccgagcggggaggggggtaggacatgcgggggcagcggcgcctggggacaggtagagacgcaggctcccctcctgccccacggagcacactctgcacccaccagctgccagagactcccccgcatgctgcagtttcaggaggcctctgggtgctggtcgtgagcccaagcccatctcagctgctcccccaaactctgcccattcctcaccccgtcccctaagctgaggtgtggccgggcacctgagtcccaccccacgctccacagtctcaggccaccccctccagccgtgccacactcccttggtgctcacgccgcctgcctggagct

SEQ ID NO: 81457 - DNA, 222 bp, Homo sapiens
  chr17:80655505-80655727
  hyper
ctcctcactcccagccgaggtgttcgcctctgcgcgttcccccttctcctgggttcctgcccccgcctttctttccccggagccgtccaccccctcgccgggcgccggctttcaagcctcaaacttgggggatccccgggctgcctgcctgggagctctgggcgctccggcctcccctcgccctggaacccgctctccggccgctgtcgtggggggtcccct

SEQ ID NO: 81458 - DNA, 47 bp, Homo sapiens
  chr17:80657047-80657094
  hyper
ggtccagttggcggacgcggccggaaggcccccgcaggccgcctcgc

SEQ ID NO: 81459 - DNA, 21 bp, Homo sapiens
  chr17:80659786-80659807
  hypo
agactccgtctcaaaaaaaaa

SEQ ID NO: 81460 - DNA, 30 bp, Homo sapiens
  chr17:80661495-80661525
  hypo
gatgagtgcttggggcgcttctccatccac

SEQ ID NO: 81461 - DNA, 30 bp, Homo sapiens
  chr17:80673406-80673436
  hypo
acacacagaaaagtgcgtgaacacacacat

SEQ ID NO: 81462 - DNA, 20 bp, Homo sapiens
  chr17:80692466-80692486
  hypo
aacctcatgcatggccgggc

SEQ ID NO: 81463 - DNA, 80 bp, Homo sapiens
  chr17:80692846-80692926
  hypo
tgcagcctgggagacagagactccatctcttaaaaacacaaaaaacaaacaataaaaaaacctcacgtcaaatgacttca

SEQ ID NO: 81464 - DNA, 76 bp, Homo sapiens
  chr17:80693424-80693500
  hyper
cgcgccgcgcgctcccgccccgccccgccccgcagcgcctcagccgacaggggcttccgagcgagcagagtcccgc

SEQ ID NO: 81465 - DNA, 35 bp, Homo sapiens
  chr17:80712937-80712972
  hypo
tgtaagatgtacattggtctcgtcagggaaggcgg

SEQ ID NO: 81466 - DNA, 44 bp, Homo sapiens
  chr17:80744257-80744301
  hypo
ctctgcaggggaggccgttagccctgccccgagtgtgggtgctg

SEQ ID NO: 81467 - DNA, 232 bp, Homo sapiens
  chr17:80747022-80747254
  hypo
agcatttgggtgaaacgaggtaccccaggccacgctggttcggtctcctcgtggcgttaaggaaagacctggagcagccagctcctaacactcatttcccatcactcagcattttatgtggggcgggcacagtgccgtgagtcttacagaaacctgcatggtgagccgcacgcctttgagtccccatcagccctggcccatccctgctgaggtggcgcgacctgctcacaga

SEQ ID NO: 81468 - DNA, 74 bp, Homo sapiens
  chr17:80747816-80747890
  hypo
ggctcatccccgagacgccgtgttccctcccgctgtccgctcacacctgcctgtgtggacgtggctctgacatg

SEQ ID NO: 81469 - DNA, 18 bp, Homo sapiens
  chr17:8075326-8075344
  hypo
aaacaagagatgggccgg

SEQ ID NO: 81470 - DNA, 69 bp, Homo sapiens
  chr17:80772872-80772941
  hypo
ctgttgctgccatctcgactcgtggatggtgagtagctgaagcacggtcagctgcgtcaccaggctgtc

SEQ ID NO: 81471 - DNA, 1155 bp, Homo sapiens
  chr17:80797664-80798819
  hypo
gtcctgagtaatcctcggagcccagagcaaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgggaaaggaggtgggatgagctggtgtcaggcccttggatgagcctgaggctgcagggcagaggctgcagggctgtggcatagggacgagctggccaggac

SEQ ID NO: 81472 - DNA, 30 bp, Homo sapiens
  chr17:80820683-80820713
  hypo
ttatggaagtccaggcggccaccccaggcc

SEQ ID NO: 81473 - DNA, 593 bp, Homo sapiens
  chr17:80832203-80832796
  hypo
ctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 81474 - DNA, 36 bp, Homo sapiens
  chr17:80847858-80847894
  hypo
accagcctggccttgcggggacgcagacctgacccc

SEQ ID NO: 81475 - DNA, 38 bp, Homo sapiens
  chr17:80859827-80859865
  hypo
ttacagatatatgcccgtagcgtcggagctgtgggact

SEQ ID NO: 81476 - DNA, 30 bp, Homo sapiens
  chr17:80879262-80879292
  hypo
ctcaaaggttaccatcgactttaagattag

SEQ ID NO: 81477 - DNA, 41 bp, Homo sapiens
  chr17:80879980-80880021
  hypo
aagaaaccatgggcccggcgcagtggcgggtggatcacttg

SEQ ID NO: 81478 - DNA, 95 bp, Homo sapiens
  chr17:80882906-80883001
  hypo
ttccttctgaaaggccggctccagcaggtgaggctggccacgcgcagtggacggggcctagggcgagggtgtgggagcctcgtgtgttggggcat

SEQ ID NO: 81479 - DNA, 131 bp, Homo sapiens
  chr17:80965822-80965953
  hypo
acagcagtaggaaggcgtggattccagacagaccaacagcgcccagccgcgatgctgccggcaccttcctctgcaggagacctcgcgctctcaagaggaggcgcagggaagaggcacgctctcaagaggag

SEQ ID NO: 81480 - DNA, 35 bp, Homo sapiens
  chr17:80970418-80970453
  hypo
acggtttccagctcacgggccggcacagggtctgc

SEQ ID NO: 81481 - DNA, 57 bp, Homo sapiens
  chr17:80972313-80972370
  hypo
ggaggccagtacttacgctcgacgggtgctgaacggcagcctcgtgttgcagcctca

SEQ ID NO: 81482 - DNA, 315 bp, Homo sapiens
  chr17:81008590-81008905
  hypo
cacggggaaggtgttcggggcttaagggcaggtttttagggcacgtgtttggggtaagtgtgctgggcacacaggcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgaggttgtgtgggggcacacggacaggtgtgcag

SEQ ID NO: 81483 - DNA, 30 bp, Homo sapiens
  chr17:81014892-81014922
  hypo
cccagaacgcagagccggagtcaggggctt

SEQ ID NO: 81484 - DNA, 166 bp, Homo sapiens; identical to SEQ ID NO: 45303
  chr17:81015300-81015466
  hypo

SEQ ID NO: 81485 - DNA, 79 bp, Homo sapiens
  chr17:81015900-81015979
  hypo
cacatctggacagtgcgtgaagccagtccaggggccacaccgggacctgccctcagctctgccacgtcctggccaagtg

SEQ ID NO: 81486 - DNA, 36 bp, Homo sapiens
  chr17:81021220-81021256
  hypo
ctccagggcaggctgcgtgtccgggcagtcccagcc

SEQ ID NO: 81487 - DNA, 125 bp, Homo sapiens
  chr17:81024242-81024367
  hypo
tgaagagctccagatcgcagacaccgtgccgtgcccgccacgcagatgcagtttccactcagccccacagtgcgggcttcctgggcccgtgtccggctggaggagcaccccgggtccgagccagc

SEQ ID NO: 81488 - DNA, 30 bp, Homo sapiens
  chr17:81032806-81032836
  hypo
ggccggaccttagcacgtcatcactgggct

SEQ ID NO: 81489 - DNA, 30 bp, Homo sapiens; identical to SEQ ID NO: 45307
  chr17:81033487-81033517
  hypo

SEQ ID NO: 81490 - DNA, 30 bp, Homo sapiens
  chr17:81034580-81034610
  hypo
agctctccgattccacggctcagcctcaac

SEQ ID NO: 81491 - DNA, 37 bp, Homo sapiens
  chr17:81040640-81040677
  hypo
acagaccatgagtctcggacttcgtgccgaggtctgc

SEQ ID NO: 81492 - DNA, 29 bp, Homo sapiens
  chr17:8104161-8104190
  hypo
gggtgcggtggctcacggctgtaatccca

SEQ ID NO: 81493 - DNA, 167 bp, Homo sapiens
  chr17:81043026-81043193
  hypo
actgctggtaccagacggggacggcaggcccggccgggtgcagtgttttggcctggagcagggcggcctgttcgtggaggccacgccgcagcaggatatcggccggaggaccacaggcttccagtacgagctggttaggaggcacagggcgtcggacctgcacgagc

SEQ ID NO: 81494 - DNA, 209 bp, Homo sapiens
  chr17:8104430-8104639
  hypo
ttccgtcttgagaaaaagcaaaaaccttgcctttatctcgtttgaattcttgccctcgagaaaacagaggagagaggttgctgcagagttgcaactccggagtttcccggatagctgcaggcttacccgcaggtaacagtagaagtaggagtcagcgttaaggctgtgggaaaataggtgtccttcattattgccggtgggagtgtaaa

SEQ ID NO: 81495 - DNA, 59 bp, Homo sapiens
  chr17:81047898-81047957
  hypo
gtgactcacagagggcgaagtgctagggcttgcataccctcacgcgcccaggccccggg

SEQ ID NO: 81496 - DNA, 30 bp, Homo sapiens
  chr17:81048443-81048473
  hypo
cagtgaggggaccctcgggtggactggggt

SEQ ID NO: 81497 - DNA, 251 bp, Homo sapiens
  chr17:81048783-81049034
  hypo
gggtgggccacaccccggggcccccataggagagcgcaccgggcggcttccagcttgggggtcaggaggcccccgtggtgggggctgcagtgtgagtctgtacacatcagcaggaaggggatttggccagaagctcccattctggagggttgctgggatggcagaggtgcccccccagtgccaggctggaccggcctcaaggtgctcagcagtgccaggctggaccggcctcgaggcgcccccagtgccag

SEQ ID NO: 81498 - DNA, 28 bp, Homo sapiens
  chr17:8104911-8104939
  hypo
tataggctgaaaggccgggcgcggtggc

SEQ ID NO: 81499 - DNA, 317 bp, Homo sapiens
  chr17:81050023-81050340
  hypo
atccggggaaggggccgggccgatggccctgactggaactcactgccctgctgggtgaggccccacgccggtggcaggtggacgcgtcgctgcctgcttagggatccccttcctggaatcttggcctcgctggcccttccagccacatggggggtcccgcgggatgggatcctccttttgggtgccgctgccgtcgcgacccagggaagtgggcagcagagctgtggggagtgtctgcccttcgaggaagctgggaaatgagggtggtcccggcgccgtgggccgtggaggtgggttgggggcgactctgggaggtg

SEQ ID NO: 81500 - DNA, 63 bp, Homo sapiens
  chr17:81050653-81050716
  hypo
tggtccaggtggggccgaggggtcccctgggtgagaccccgtcgtggtcgaggttgtgttttc

SEQ ID NO: 81501 - DNA, 78 bp, Homo sapiens
  chr17:81050921-81050999
  hypo
tccctgcagtgacaccgaggtgctcctagccgtctgcaccagcgacttcggtgagtgtctgctcggcagcttctacct

SEQ ID NO: 81502 - DNA, 294 bp, Homo sapiens
  chr17:81062099-81062393
  hypo
gagaggaaaggatcacgcgaccatgggtacgttggccacctgaaggttgagtcccgcagcctagagactggagcgtggggaccaggaggagcttcttagcggaactgggctggggctcatgcagccctccaggagcccccgacgcgacgccctggctcatcccgggtgaagaggctgctgagtctgaactgatgacagtggacgggtggccgccggttcccaacgcatggttgggcctggaacccaggtgactctgggagatgtggtcacagtcacagccgtctgtgggccttt

SEQ ID NO: 81503 - DNA, 102 bp, Homo sapiens
  chr17:81065766-81065868
  hypo
tgcacgatccttcctcgctgcaggatccttcctcgctgcacgatcattcctggttgcacgatccttcctcgctgcacgatccttcctcgctgcatgatgatt

SEQ ID NO: 81504 - DNA, 138 bp, Homo sapiens
  chr17:81068653-81068791
  hypo
agcgggcagggctgacgggcgcgaaactgggagcgtagctctgggaggtggcctcggggaaccattttcccaccgggcgggcccttttgttctcctgtctgtgcgcgcagggcagccaggtcccgggatggaccctat

SEQ ID NO: 81505 - DNA, 82 bp, Homo sapiens; identical to SEQ ID NO: 45316
  chr17:81076347-81076429
  hypo

SEQ ID NO: 81506 - DNA, 33 bp, Homo sapiens
  chr17:81081890-81081923
  hypo
gggcgacgctcagggcggccgtgcgggcatccg

SEQ ID NO: 81507 - DNA, 30 bp, Homo sapiens
  chr17:81084673-81084703
  hypo
cgcttcattaatacccgggggaaggtcctg

SEQ ID NO: 81508 - DNA, 138 bp, Homo sapiens
  chr17:81087463-81087601
  hypo
ggcagaagttgcttacgagctcgctcagtggcttggcaggggttgttggggttccccaaggctgttctcctgagggccgcgggtcccgactggctgtttgctggaggcttctcctgagggccgcgggtcctcactggc

SEQ ID NO: 81509 - DNA, 120 bp, Homo sapiens
  chr17:81087901-81088021
  hypo
tgctggaggcttctcctgagggccgcgggtcctcactggctgttctcctgagggccacgggtcctggctggctgttctcctgagggccgtgggtcctggctggctgtttgctggaggctt

SEQ ID NO: 81510 - DNA, 78 bp, Homo sapiens
  chr17:81088141-81088219
  hypo
tggctgttctcctgagggccgtgggtcctggctggctgtttgctggaggcttcgcctgagggccgcgggccctcgctg

SEQ ID NO: 81511 - DNA, 25 bp, Homo sapiens
  chr17:8123524-8123549
  hypo
cccatcccaccggttttgtttttca

SEQ ID NO: 81512 - DNA, 392 bp, Homo sapiens
  chr17:8229958-8230350
  hyper
gccctcttccccccacgccccggcccccaagcctgctcactagctctctcctcctccttccacccgcaaggaaccctccagcccacttcctgtgatcctttccggagcccttcagcctggctggctctccagccatctcggaaagcttctctttcctaaaccctccatactcgcaggttcagctacagaggtaactgcaggctcaggttctccagggtggccagcccaccagcccaccgtcccggtgcagcagtgcctctccagcgacagctccaccgcgagcctggcgggctcccgaccttgctccccagcacgtcgtctccaagccacggtctcaccaccctccatcagcctcgggcgacaccaaggggaacagagcgctggagctcctc

SEQ ID NO: 81513 - DNA, 491 bp, Homo sapiens
  chr17:8230351-8230842
  hyper
aagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctccacgcccgatggagtttttca

SEQ ID NO: 81514 - DNA, 37 bp, Homo sapiens
  chr17:8287722-8287759
  hypo
ctgcaaatggtttctgaggcagcggcagtgcagcagg

SEQ ID NO: 81515 - DNA, 186 bp, Homo sapiens
  chr17:8296142-8296328
  hypo
cccagggcaggatggcggccaccacggccaccacagcgatgagcgtgatgagcagcagggcccgcgatcggcagcagaaggcgcgggcggagcggggcgccagggaggcctccgagagctctgccaggctgcggcggggcagcacgctgtcctgctcccccaggggcatcccgtggcggctgatga

SEQ ID NO: 81516 - DNA, 30 bp, Homo sapiens
  chr17:8328350-8328380
  hypo
ccttagcccttttcacgagggtgctcgttt

SEQ ID NO: 81517 - DNA, 45 bp, Homo sapiens
  chr17:8338095-8338140
  hypo
aatgcaagatggggccgggcgctgtgtctcacgcctgtaatccca

SEQ ID NO: 81518 - DNA, 30 bp, Homo sapiens
  chr17:835911-835941
  hypo
gcttctgagaggcaccgacttttgccatca

SEQ ID NO: 81519 - DNA, 30 bp, Homo sapiens
  chr17:8365197-8365227
  hypo
cataaatggataggtcggacaggtgcctgt

SEQ ID NO: 81520 - DNA, 391 bp, Homo sapiens
  chr17:8384513-8384904
  hypo
gcagcccaggcccagcgagggaggagcaaaccacccgctgatgccaggtgtgtggacacctccagccttctcagcagtgcgcgtgcctgagggcgaagaacccacccccggccgtgggagactcacttgccagaggcgctgttggtgatctcgtccgccagctcatctctctcctgctcggcgtgtcggcgggctcgctcagatgaggcaagttcctaagcagtggagactgcgttaagctctggctgtgaatagtttcctcacctgtggaatctgacagtgcctggagctacagcgaccttgctcctgtcactgtttacctgcacctcaagctgtcatttagatttgagaaattaaactgtcaagaaaatctgctcggtgcaggccagcc

SEQ ID NO: 81521 - DNA, 36 bp, Homo sapiens
  chr17:8397135-8397171
  hypo
tcctcttccagctgccggatccgactgctcaggttt

SEQ ID NO: 81522 - DNA, 97 bp, Homo sapiens
  chr17:8398223-8398320
  hypo
ctccgaggccacccacgtgcctgccagacacacgaaccccaggggctctacatcaagacactgagcttccagggagaaatcccgagtagcaaggctg

SEQ ID NO: 81523 - DNA, 44 bp, Homo sapiens
  chr17:8409685-8409729
  hypo
gagctcatcaatctgcgcctgcagctctgcgatctggtcctgca

SEQ ID NO: 81524 - DNA, 30 bp, Homo sapiens
  chr17:8456005-8456035
  hypo
tatatgagaggcactcgcccttcacactca

SEQ ID NO: 81525 - DNA, 18 bp, Homo sapiens
  chr17:8464515-8464533
  hypo
ggggcctctcctctccgg

SEQ ID NO: 81526 - DNA, 30 bp, Homo sapiens
  chr17:851863-851893
  hypo
gtgaaaaccatcactcggtgcttcacggaa

SEQ ID NO: 81527 - DNA, 30 bp, Homo sapiens
  chr17:8532918-8532948
  hyper
gcttcaacttccctccgaaccaattccagt

SEQ ID NO: 81528 - DNA, 38 bp, Homo sapiens; identical to SEQ ID NO: 36367
  chr17:8533161-8533199
  hyper

SEQ ID NO: 81529 - DNA, 170 bp, Homo sapiens
  chr17:8533692-8533862
  hyper
aaggacttcattccccgctcctccgggagtctctccatctccacccactgaggtcccagtgcccccagcccaggaccctgctcaaactaacctaaggtccccgcagcacaaaccctacagctcagaagcccctctgtcttccccagctcccgcttcggtcccccgttcct

SEQ ID NO: 81530 - DNA, 88 bp, Homo sapiens
  chr17:8572343-8572431
  hypo
ggtgctgctttacatttccgcattccctttccccacttgcacagttgttcttgaataaccgggcctggggaaacgtcagtgggtgagt

SEQ ID NO: 81531 - DNA, 76 bp, Homo sapiens
  chr17:8586787-8586863
  hypo
attgtctttgatgtccagtttccattcttcctgcttttggtaatagtcgcccatttccatccggcaaaatacccct

SEQ ID NO: 81532 - DNA, 30 bp, Homo sapiens
  chr17:8624511-8624541
  hypo
agatctcaccaccatcgctcacttgccttt

SEQ ID NO: 81533 - DNA, 30 bp, Homo sapiens; identical to SEQ ID NO: 44992
  chr17:8732186-8732216
  hypo

SEQ ID NO: 81534 - DNA, 80 bp, Homo sapiens
  chr17:876820-876900
  hypo
gtatcagtaatatcccgggactttaaggcactgtatttgttgtttcattcttctaggtctttcttcgcagttataatctc

SEQ ID NO: 81535 - DNA, 30 bp, Homo sapiens
  chr17:8774759-8774789
  hypo
ctttacttccagcagcgttatttggcagag

SEQ ID NO: 81536 - DNA, 102 bp, Homo sapiens
  chr17:8789475-8789577
  hypo
ctccacagagctccacgtttcgcgtcccaggccccgcctcaccgtctgtctctgctcaggcagtacccacctgacgccttgatggcacgtgtggcagcggag

SEQ ID NO: 81537 - DNA, 71 bp, Homo sapiens
  chr17:8789780-8789851
  hypo
agggaggccttacctcggtctgatagacttgcagcagcaccggtctggcggcaaagcggcagtagtagagt

SEQ ID NO: 81538 - DNA, 30 bp, Homo sapiens
  chr17:8849594-8849624
  hypo
gaagccactagaccacgtgttcagaaaagt

SEQ ID NO: 81539 - DNA, 86 bp, Homo sapiens; identical to SEQ ID NO: 36368
  chr17:8868582-8868668
  hyper

SEQ ID NO: 81540 - DNA, 399 bp, Homo sapiens; identical to SEQ ID NO: 1275
  chr17:8868814-8869213
  hyper

SEQ ID NO: 81541 - DNA, 257 bp, Homo sapiens; identical to SEQ ID NO: 36370
  chr17:8869214-8869471
  hyper

SEQ ID NO: 81542 - DNA, 1025 bp, Homo sapiens
  chr17:8906188-8907213
  hyper
gtgtcccaagttacacgcatcctatcttggcccagctccactggagcccgagcggcggggcgcagggtgcgagcgggaggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgcc

SEQ ID NO: 81543 - DNA, 514 bp, Homo sapiens; identical to SEQ ID NO: 36372
  chr17:8907214-8907728
  hyper

SEQ ID NO: 81544 - DNA, 62 bp, Homo sapiens
  chr17:8907776-8907838
  hyper
cgggtgacggaggctttatcctttgatcccttctggatccggtgacgcgctaagtgttgggc

SEQ ID NO: 81545 - DNA, 30 bp, Homo sapiens
  chr17:8924243-8924273
  hyper
ggaccccgggggcttcgggcaaaaatggag

SEQ ID NO: 81546 - DNA, 243 bp, Homo sapiens
  chr17:8925590-8925833
  hyper
ggcgggctggctgagcgcagctcccttctctccgcaggcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccaccc

SEQ ID NO: 81547 - DNA, 42 bp, Homo sapiens
  chr17:8926060-8926102
  hyper
actacctgcagttcccgcacaacgtcacgctcacactgtccc

SEQ ID NO: 81548 - DNA, 63 bp, Homo sapiens
  chr17:896321-896384
  hypo
ctggaggaccccatccggagcctggagtgctctttatcaccggctgcccgtgggaacccacga

SEQ ID NO: 81549 - DNA, 83 bp, Homo sapiens
  chr17:9029329-9029412
  hypo
ggcagggccaggcatcgtccccagccagcctgattgcagaagcagagtcaggatggctgaatgaacgacgcatggggtggaga

SEQ ID NO: 81550 - DNA, 30 bp, Homo sapiens
  chr17:9065719-9065749
  hypo
ctggcaacgtcctcacgggatctctcctcc

SEQ ID NO: 81551 - DNA, 44 bp, Homo sapiens
  chr17:9143066-9143110
  hyper
cagagcctgtggatccgctcgcgggacatcgcctgcaagtgtcc

SEQ ID NO: 81552 - DNA, 39 bp, Homo sapiens
  chr17:9143465-9143504
  hyper
cctgcgcgctctgggcgggagccgcgtgcacgcggggcg

SEQ ID NO: 81553 - DNA, 426 bp, Homo sapiens
  chr17:915591-916017
  hypo
acacgtgccctttcccgaggggccgccagtccccgttggtgccgagcccaaacgtaggcccccggctgacagagcttcccgcttgttacgaggagcagacgatctgggatctcacaagagaccttccagcgtttaggtgctggctcgcgtgcttctgaagtgtcctgtgagcgcctctgcggccactctagatccacaccggccatctgccaccgccgagcggggggtaactgattaggtgccaggatgggcaccggcggggagggctggggggcccgggctgggggggacccggggcaccgacgccaggactgggagacccgaggcagcacctacttcgtcaccacgctgatcttcacaccgaagacgccggtctgctttttggacggggtcctcttcaggctcatatctcggctggtgaatttc

SEQ ID NO: 81554 - DNA, 192 bp, Homo sapiens
  chr17:938024-938216
  hypo
atggtccccttccctcgggctgggtcccaggccacagggtgcagactgcgagaatgcacgcccctccctgccgccgggtgtgggggagaagggggccgtgtgaatcccgttcccaaggcccggcactcatctgtcttaggtaccacaggctcaatacttgtctaggtaaagcaagctcggactggatgaacg

SEQ ID NO: 81555 - DNA, 58 bp, Homo sapiens
  chr17:9547977-9548035
  hyper
tcattcaacaaggatcgtgcgttaaggagtgaaccagaaaccgcgtagggggcgcgcc

SEQ ID NO: 81556 - DNA, 36 bp, Homo sapiens; identical to SEQ ID NO: 44995
  chr17:9808139-9808175
  hypo

SEQ ID NO: 81557 - DNA, 188 bp, Homo sapiens
  chr17:9810166-9810354
  hypo
ggaagggagggtgggcgtgcactttccttagcggagcgcagtgctcgaggggacacactcagaaccccagccttgccaccgtggatggagagttgtctctttttgccctggggtgagaatgatgaagaataaaccccacggtctccaggcaggtaaactggtttttttttagacggagtctccctctg

SEQ ID NO: 81558 - DNA, 42 bp, Homo sapiens
  chr17:9851040-9851082
  hypo
tgagctgagatcatgccattgtacgaacgaaactatgtctca

SEQ ID NO: 81559 - DNA, 26 bp, Homo sapiens
  chr17:9913746-9913772
  hypo
gcatgagccaccgcgcccagcctgat

SEQ ID NO: 81560 - DNA, 90 bp, Homo sapiens
  chr18:10132081-10132171
  hyper
cagctgctgccgccccgcccgctccgccgcggcccccacacgctctgcaacgcgtccttggcaacctgaaagaatcggccttcttgtcct

SEQ ID NO: 81561 - DNA, 30 bp, Homo sapiens
  chr18:10414395-10414425
  hypo
gagccacggcacttccggttgctgtccacg

SEQ ID NO: 81562 - DNA, 578 bp, Homo sapiens
  chr18:10454592-10455170
  hyper
cgcggccaggctgcccggccggcggcgcgctggaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggcggagggcagagcgcgcgcccagttgcccgggcaccaaatcggagcgcggcgtgcgggaggccccagagcaggactggaaatgtcctggccgcgccgcctcctgctcagatacctgttcccggccctcctgcttcacggtgagttcccgagggccactcgagcgctcccagccggcggaggcagcccgggcgccgcggagcccgcggaggcgtcgggtctggatcgcggcacggcctacactgtccccttggcggggcgggtccgaggggag

SEQ ID NO: 81563 - DNA, 46 bp, Homo sapiens
  chr18:10474416-10474462
  hypo
aaacaccaaaaagcacggggagccttgagtgcgaggtctgagtgag

SEQ ID NO: 81564 - DNA, 30 bp, Homo sapiens
  chr18:10562257-10562287
  hypo
gagttacacagagatcgttaggcagtaagt

SEQ ID NO: 81565 - DNA, 543 bp, Homo sapiens
  chr18:10589037-10589580
  hypo
gaggcttgtgtttctcgtgtgctccgggagtgtgagccccagcttctgctttcactgaattctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 81566 - DNA, 30 bp, Homo sapiens; identical to SEQ ID NO: 45335
  chr18:10664802-10664832
  hypo

SEQ ID NO: 81567 - DNA, 149 bp, Homo sapiens
  chr18:10696211-10696360
  hypo
gaccatcaccaaaaacggccccgggacctggtcctctgacagtgaagaggtgatgtctgcagctgctgagtgtttctggggaagagacaacaaattcatgcccaagagaggcaattcatggcaggaagcgccatcgccatgggtcaggg

SEQ ID NO: 81568 - DNA, 25 bp, Homo sapiens
  chr18:10809544-10809569
  hypo
tgtgagccaccgcacctggcatctc

SEQ ID NO: 81569 - DNA, 30 bp, Homo sapiens; identical to SEQ ID NO: 45337
  chr18:10832633-10832663
  hypo

SEQ ID NO: 81570 - DNA, 25 bp, Homo sapiens
  chr18:10906877-10906902
  hypo
tgtcttttgtcgccttcctgagccc

SEQ ID NO: 81571 - DNA, 89 bp, Homo sapiens
  chr18:10907451-10907540
  hypo
aaaagatgtatttgtttcaagcatcatgttgagatgaaagcactgtgagaatgcagcctaccaatgacacaccccgtggaggcgagctg

SEQ ID NO: 81572 - DNA, 86 bp, Homo sapiens; identical to SEQ ID NO: 45339
  chr18:11009583-11009669
  hypo

SEQ ID NO: 81573 - DNA, 87 bp, Homo sapiens
  chr18:11074158-11074245
  hypo
tatcaagtgtgatactgcctttgttcaagatctggagacatttaaagcacattcattccttttcataacgagcgaccatattctcgc

SEQ ID NO: 81574 - DNA, 36 bp, Homo sapiens
  chr18:11103949-11103985
  hypo
gagtagctggaactacaggcacgcaccaccacaccc

SEQ ID NO: 81575 - DNA, 35 bp, Homo sapiens
  chr18:11148401-11148436
  hyper
acgccgctggcctcccgaatcgaaccccagagcac

SEQ ID NO: 81576 - DNA, 353 bp, Homo sapiens; identical to SEQ ID NO: 36899
  chr18:11148741-11149094
  hyper

SEQ ID NO: 81577 - DNA, 141 bp, Homo sapiens; identical to SEQ ID NO: 36900
  chr18:11149115-11149256
  hyper

SEQ ID NO: 81578 - DNA, 262 bp, Homo sapiens
  chr18:11149498-11149760
  hyper
gccgccttgcagcctcgccctcgcggcgcagccggggctccccggcggcgcgcgcttctccaccttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctg

SEQ ID NO: 81579 - DNA, 213 bp, Homo sapiens; identical to SEQ ID NO: 36902
  chr18:11149779-11149992
  hyper

SEQ ID NO: 81580 - DNA, 30 bp, Homo sapiens
  chr18:11211262-11211292
  hypo
gttcatcagggactccgtaggcatcttcat

SEQ ID NO: 81581 - DNA, 30 bp, Homo sapiens
  chr18:11214264-11214294
  hypo
atagagcccagtgcccgcagcaaacagttt

SEQ ID NO: 81582 - DNA, 88 bp, Homo sapiens
  chr18:11232104-11232192
  hypo
aaaacaggcaatgaccgtgtattcaatcatcaaggatacaggagaatcattttactatcatgtgtatcttatatacttttttttgaga

SEQ ID NO: 81583 - DNA, 27 bp, Homo sapiens
  chr18:11263248-11263275
  hypo
tgtgagccaccacgcccagcctaaaat

SEQ ID NO: 81584 - DNA, 30 bp, Homo sapiens
  chr18:11378497-11378527
  hypo
tggtacagcaccattcggagggtggtaaga

SEQ ID NO: 81585 - DNA, 46 bp, Homo sapiens
  chr18:11379033-11379079
  hypo
gcctgggggaaggggcgcacagatgagaggccgctcctcaggccct

SEQ ID NO: 81586 - DNA, 129 bp, Homo sapiens
  chr18:11401631-11401760
  hypo
ttcaatcatcagagacgttgatcctatcatcctcctcccgccagcgaaggatattttgttggtccgctgcattagtgacatcacaaagatgggacctgatgctagaaaaatcatcggtaccttagatgc

SEQ ID NO: 81587 - DNA, 175 bp, Homo sapiens
  chr18:11430289-11430464
  hypo
accagtatgccccatcgcggggggtgagggggaggcggggaggcaagaggataattccacctagcccagtttcaacccctactcatgtaaagcatgcagtacagggtccttggtatcgcccatcccagtccaacaccattggcacctaggcactactccccggggcccgggggcc

SEQ ID NO: 81588 - DNA, 458 bp, Homo sapiens
  chr18:11533257-11533715
  hypo
tgtcactgccttcagcggggggctggttaggagtcctatccatggctgcatgggtcaccgcagggagagggttgggggcgctatccggggctgcgctgcccacagcaagagcaggttggggcgctatctggtgctgtaatgtcggaggcagggatgtgttggggtgctatgggctactacactgcgtggcgaggaggtggggtgttaggggcgctatcgggctgccctgccaacaggggcagaggttgcagcaacagcagtggtctccaagaaaggaggcttcctcctctccccagactccagactctagagggcgacctcctcctgctcctgctccagtggcacgcgtgcacaacgtttccacgggaatcctgggtacggcagggcccccacatccgccgtgattcccaggcctgcttcctctctctctgtgttgcagagaccggctgggacccctg

SEQ ID NO: 81589 - DNA, 173 bp, Homo sapiens
  chr18:11546891-11547064
  hypo
agactcctcaagcttcggctgtgtgtagactagtcagcttccagtgtgactagagcagggcttgatgactcctcaatcttcagccttgtgtagactggccggcctcctgattggccagagcaggactgtcgtctttctctgcagtggtttggttccatcgcaggatcagtcag

SEQ ID NO: 81590 - DNA, 30 bp, Homo sapiens
  chr18:11571295-11571325
  hypo
gagtccctgatgagacggacagcgggtggc

SEQ ID NO: 81591 - DNA, 82 bp, Homo sapiens
  chr18:11580091-11580173
  hypo
attcggggtcgatgtcggccactggcgggcgggacacgggctcctgacacattttctcattataacccggagtcttgtgtta

SEQ ID NO: 81592 - DNA, 39 bp, Homo sapiens
  chr18:11689795-11689834
  hyper
cgagcagctgagtgccgaggagcgcgaggcggccaagga

SEQ ID NO: 81593 - DNA, 30 bp, Homo sapiens
  chr18:11749664-11749694
  hypo
gatgggtgagaccagcggagaatctggtgc

SEQ ID NO: 81594 - DNA, 235 bp, Homo sapiens
  chr18:11751397-11751632
  hyper
actgcacaggagaaacgggggctggaggtaaagacaggaggctcgggaggcggcgacgtgggcgagctggaatagtctagaagctgagcagaacaaaggcggtgtgactggtgagcctcggagggatcctcctccctgctagaatatgcatgatcctccgcgagtcttcgcccgccaggagcagggacgcgtccgagccaacacggggcgcgcgcccagacgcactttcccggct

SEQ ID NO: 81595 - DNA, 478 bp, Homo sapiens; identical to SEQ ID NO: 36904
  chr18:11752127-11752605
  hyper

SEQ ID NO: 81596 - DNA, 129 bp, Homo sapiens; identical to SEQ ID NO: 36905
  chr18:11752640-11752769
  hyper

SEQ ID NO: 81597 - DNA, 36 bp, Homo sapiens
  chr18:11822332-11822368
  hypo
gtggtacacacctgtcgtccccgctgctcgggagcc

SEQ ID NO: 81598 - DNA, 37 bp, Homo sapiens
  chr18:11877710-11877747
  hypo
tgtggggcctttccacggggaccggcactccagcctg

SEQ ID NO: 81599 - DNA, 20 bp, Homo sapiens
  chr18:11921463-11921483
  hypo
ctggccgacaggttctaatt

SEQ ID NO: 81600 - DNA, 18 bp, Homo sapiens
  chr18:11942728-11942746
  hypo
tttttttttttgagacgg

SEQ ID NO: 81601 - DNA, 120 bp, Homo sapiens
  chr18:11942866-11942986
  hypo
acccaccaccacaccctgctaaatttttttatgactcatgcatgagtcactgcacctggccattagtaaccaattataaactaaaaccaaggctgggcatggtggctcatgcttgtactc

SEQ ID NO: 81602 - DNA, 239 bp, Homo sapiens
  chr18:11947249-11947488
  hyper
ggaggaaccacaaaccgcgtagactcaggccagccgctgggcctgggcctgtgtgtccctcaggcggcgacctttggcccacttcaggccggccgtatttaccagcttagaggcgccgcggcgttggcgagtcctttttcacccaccccttccctccgttctcaggcttgaacttgaacaggcactcatgactcagcaaacggtacttgatagggttctttacacgtcagtcaggctat

SEQ ID NO: 81603 - DNA, 30 bp, Homo sapiens; identical to SEQ ID NO: 16298
  chr18:11979044-11979074
  hypo

SEQ ID NO: 81604 - DNA, 102 bp, Homo sapiens
  chr18:11979855-11979957
  hypo
cgcacccggcctctgtcttaaacatcataaaaacataagaacccaaaaaagatggaggggagtgcgcccttagctgccccaaactggcgtggtgggaggcag

SEQ ID NO: 81605 - DNA, 168 bp, Homo sapiens
  chr18:11989272-11989440
  hypo
cctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaac

SEQ ID NO: 81606 - DNA, 30 bp, Homo sapiens
  chr18:11995477-11995507
  hyper
gaaggggagactggacgtttggggtcaaat

SEQ ID NO: 81607 - DNA, 30 bp, Homo sapiens
  chr18:12005824-12005854
  hypo
cagttttctttccaccgcttcagtttccta

SEQ ID NO: 81608 - DNA, 19 bp, Homo sapiens
  chr18:12072041-12072060
  hypo
actccgtctcaaaacaaaa

SEQ ID NO: 81609 - DNA, 30 bp, Homo sapiens; identical to SEQ ID NO: 45345
  chr18:12076093-12076123
  hypo

SEQ ID NO: 81610 - DNA, 151 bp, Homo sapiens
  chr18:12208462-12208613
  hypo
tttggtcttttccaagtttattggcgtagtggtgagaactgtctctatgggcttatgagggtgccgcgttgtttaaagatgatctttcccaaaacaccttttctgcctctgcatctgccaaacatcacagcttctgcgttggattagtcag

SEQ ID NO: 81611 - DNA, 30 bp, Homo sapiens
  chr18:12245897-12245927
  hypo
agccgggtgcagagccgccgcaaccccaca

SEQ ID NO: 81612 - DNA, 301 bp, Homo sapiens
  chr18:12253591-12253892
  hyper
cctaattgcgtcttccgatgggaacaaccatgagagcagggtgtggacggaagtcccccagccccagcggggttcactctttgcctcctcactctgcgagggtcccttactacagctaaaaggcaattcatgcagtccaaaggctcctttcccctcccgttctgcatgcccttctcactgtccccaaatgctcatgacatggccttgagagcagcgcagcgggcaggaagcccaggcgcctcggagaacctgaagggctgcaggtcccggtgtctgcggcagcttccgcatccctgcaggg

SEQ ID NO: 81613 - DNA, 43 bp, Homo sapiens; identical to SEQ ID NO: 12992
  chr18:12254104-12254147
  hyper

SEQ ID NO: 81614 - DNA, 326 bp, Homo sapiens
  chr18:12254304-12254630
  hyper
cgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaat

SEQ ID NO: 81615 - DNA, 167 bp, Homo sapiens
  chr18:12258116-12258283
  hypo
ttcctccagcagtgacgcagctcttggtttggaaatgctacaggtgagaacaataggtgttttttcactgacgatggcaatcttgagggcaggtgaaggcagggagaaccagaaatggttgccagctcttatcttgtcagacaggtaaagaccgcaggaacctggaa

SEQ ID NO: 81616 - DNA, 171 bp, Homo sapiens
  chr18:12287792-12287963
  hyper
atgagctttggacaacgtggttcctcccgttgaatcaggttctgaccgagtccgctgcagctgcaggcgggggcgccctgccgagcagatacccagcggagctccggggccccgtttctactgtaagcagctgggggccaaatgtgcgcccgggcacgtctcttggcctct

SEQ ID NO: 81617 - DNA, 607 bp, Homo sapiens
  chr18:12307602-12308209
  hyper
cgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggaggg

SEQ ID NO: 81618 - DNA, 30 bp, Homo sapiens; identical to SEQ ID NO: 36912
  chr18:12308897-12308927
  hyper

SEQ ID NO: 81619 - DNA, 27 bp, Homo sapiens
  chr18:12375267-12375294
  hypo
ttaggagacagagtccgtcacccacgc

SEQ ID NO: 81620 - DNA, 120 bp, Homo sapiens
  chr18:12375354-12375474
  hypo
gccttggccccccgagttgctgggactatagtcataagtcactgagcccaggtaagaaaaaaaaaaaaaaaacaatttgtagaggccaggagctgtggctcaggtctgtaattccaacac

SEQ ID NO: 81621 - DNA, 120 bp, Homo sapiens
  chr18:12375952-12376072
  hypo
ctgggcgaagaagcaaaaccccgtctcttaaaaaataaaaataaaaataaaaatcgtagatcggagggtctgctaccctacccaagctggtttccaactcctggagtcaagcgattctcc

SEQ ID NO: 81622 - DNA, 29 bp, Homo sapiens
  chr18:12376132-12376161
  hypo
ccttacagtgaagacgttgagctgactac

SEQ ID NO: 81623 - DNA, 96 bp, Homo sapiens
  chr18:12408021-12408117
  hyper
gggccgcggtggggccgtccagacgccggctcctgctcccgagcccggctggagcggtccaggaaaggccggacctcacagcgggcctcgcggaga

SEQ ID NO: 81624 - DNA, 62 bp, Homo sapiens
  chr18:12420148-12420210
  hyper
tgctgagccggcggccggggagggctcgcgggactcctcagatttgtcggaccagcctttca

SEQ ID NO: 81625 - DNA, 59 bp, Homo sapiens
  chr18:12657095-12657154
  hyper
cccgcgtgaagcctgcgatgccctccccaccccgtgaacccggccgtgtgtcagcagcc

SEQ ID NO: 81626 - DNA, 30 bp, Homo sapiens
  chr18:12700987-12701017
  hypo
tcaatgattcctcgacgtctaagggctttg

SEQ ID NO: 81627 - DNA, 30 bp, Homo sapiens; identical to SEQ ID NO: 16300
  chr18:12701811-12701841
  hypo

SEQ ID NO: 81628 - DNA, 145 bp, Homo sapiens
  chr18:12911076-12911221
  hyper
caggttggggcaggccgggtggggcccagcgagtgggcgggggcgcgagcgggagcggaagcgggcccgggccgcactgctgccgcgtctagccgcctcccaggctgcctgcgccgcgtggctcgcccccgggacttgccagcag

SEQ ID NO: 81629 - DNA, 157 bp, Homo sapiens
  chr18:12949178-12949335
  hypo
tctaatgtggggatgctacatgagatttaggaacctcccagatgtgttgcaggatgaatgaaagctggagtgcggattatttggttctcgacaactccagagtaactggaaatctgaaggatagtttatcctttttcacattcgagtttgataccag

SEQ ID NO: 81630 - DNA, 35 bp, Homo sapiens
  chr18:13036778-13036813
  hypo
ctcccagtctttgtccggaccggggtttcctggga

SEQ ID NO: 81631 - DNA, 19 bp, Homo sapiens
  chr18:13135175-13135194
  hypo
gaggcgccaagagtgagcg

SEQ ID NO: 81632 - DNA, 28 bp, Homo sapiens
  chr18:13195551-13195579
  hypo
ttttttctggtgtctcgctctgtcgccc

SEQ ID NO: 81633 - DNA, 27 bp, Homo sapiens
  chr18:13195819-13195846
  hypo
agccaccgcacccggccaagaagtaca

SEQ ID NO: 81634 - DNA, 346 bp, Homo sapiens
  chr18:13218173-13218519
  hyper
gggggactcgggaaccggacgctttgggaactggacgtccgcgagcctgcgccgtcggctggggccggagggagaagctgggcgccgagcgcgcgaggtctgtgaggcttggtccgggtgggcttgccggtgggcacggcggggatccggggctggcccgcgggcggggttacgccggtggagggacttcgccgacccccaccccgttttctgtttcctggtgccctggggcgcagggtgtcccgcggttgcaagactgaattctgcaccgcccggaggccaggatgggcgcgcggatggcagccccaactgtctccgcgcccctaggcctcggcgagccgtggcg

SEQ ID NO: 81635 - DNA, 30 bp, Homo sapiens
  chr18:13219094-13219124
  hyper
aaggagaaggtttcccgatgaggcagaggt

SEQ ID NO: 81636 - DNA, 30 bp, Homo sapiens
  chr18:13228292-13228322
  hypo
tgccacagtccttggcggttctccattttc

SEQ ID NO: 81637 - DNA, 119 bp, Homo sapiens
  chr18:13231199-13231318
  hypo
tggtatgggaggaagcgggagggagaagggcaagaggggtctggaccggttttgcttgagaagaaatggcagtggacacatggctcgtgtgaaaggtgggtgcacgcagacaggccaga

SEQ ID NO: 81638 - DNA, 40 bp, Homo sapiens
  chr18:13233142-13233182
  hypo
gcctgtcctgaaggacgtgagcgggcgaagtgctcttggg

SEQ ID NO: 81639 - DNA, 127 bp, Homo sapiens
  chr18:13241262-13241389
  hypo
tggcacctcacagggcgctggtttataaagacccaaaccagtgtcgagttccatgctggccccggcgtctgctgtgtgctttcgctgtgtgtatacatgcggaagttcattccggaggcttccaggg

SEQ ID NO: 81640 - DNA, 102 bp, Homo sapiens
  chr18:13241775-13241877
  hypo
tttcacagggacatgcgtgaaatgggtcctgcgccgtaattactcctgctggagaccgggattgcaaagatgactgtcatgttgtctcgtgcatcttacatc

SEQ ID NO: 81641 - DNA, 64 bp, Homo sapiens
  chr18:13277290-13277354
  hypo
ctgcacactggagggcggggtgctgagaggcgcttgtggtgtctgaggccgagctttgctgagt

SEQ ID NO: 81642 - DNA, 35 bp, Homo sapiens
  chr18:13295972-13296007
  hypo
gaagacctgaggctgcgaggcggggtgccttgccc

SEQ ID NO: 81643 - DNA, 115 bp, Homo sapiens
  chr18:13319261-13319376
  hypo
acggcgggtatgattcgtcccagttcacgggcgagtaacagaggtgcgcagtggcggggcagctggcccaggtcgtgcagctgctgtgcgtgagccagctcgctcctgagtttcc

SEQ ID NO: 81644 - DNA, 48 bp, Homo sapiens
  chr18:13369153-13369201
  hypo
ctcacaggcaggggacgtgggaactgatcatagcgaccacttactcac

SEQ ID NO: 81645 - DNA, 102 bp, Homo sapiens
  chr18:13404829-13404931
  hypo
aaagtaactgtacaaattcaggccctgttttaatatgcgtttcagctgtcggtggtgtttcagaaatgcatgcaaaagaattgaaatcgcaaatctctgtag

SEQ ID NO: 81646 - DNA, 33 bp, Homo sapiens
  chr18:13405710-13405743
  hypo
actgcaggcatgagccaccgtgccgagccccta

SEQ ID NO: 81647 - DNA, 20 bp, Homo sapiens
  chr18:13417718-13417738
  hypo
caccacgcccagccagtttg

SEQ ID NO: 81648 - DNA, 127 bp, Homo sapiens
  chr18:13425990-13426117
  hypo
gaagaggtctggggacggatggcccatggcggcagggtgcgcagagctcctgggtgctgggccatcaggccacactgcacaggtgaaaccggctctcaacaggacatgccctcggggaagaactgaa

SEQ ID NO: 81649 - DNA, 52 bp, Homo sapiens
  chr18:13430352-13430404
  hypo
atgcgaggttagtcccgatgagggtgtattaaaagctcggcacagttgactt

SEQ ID NO: 81650 - DNA, 33 bp, Homo sapiens
  chr18:13432064-13432097
  hypo
ttcacgttgataacacgccggtgcagtctcgca

SEQ ID NO: 81651 - DNA, 46 bp, Homo sapiens
  chr18:13452310-13452356
  hypo
ccaccctccttgcagcgcttggaggatgcagcgggtgcagactggg

SEQ ID NO: 81652 - DNA, 111 bp, Homo sapiens; identical to SEQ ID NO: 45355
  chr18:13452723-13452834
  hypo

SEQ ID NO: 81653 - DNA, 30 bp, Homo sapiens
  chr18:13457997-13458027
  hypo
tggtggtcattcatacgtgttctcatgact

SEQ ID NO: 81654 - DNA, 283 bp, Homo sapiens; identical to SEQ ID NO: 45356
  chr18:13461100-13461383
  hypo

SEQ ID NO: 81655 - DNA, 156 bp, Homo sapiens
  chr18:13477773-13477929
  hypo
ggggtgcagaagaggcgtctgatgcaggccctgctgacaggcagtcaagggcatccctcaagtcgatgtagtcaagggccagagctgcaggaaaaatccagcaggcacatctcactggttaggggaaactggcggcttttccgtggtcccgggctc

SEQ ID NO: 81656 - DNA, 30 bp, Homo sapiens
  chr18:13485138-13485168
  hypo
gctcctgccttccctcggtggacctgagct

SEQ ID NO: 81657 - DNA, 32 bp, Homo sapiens; identical to SEQ ID NO: 45357
  chr18:13486501-13486533
  hypo

SEQ ID NO: 81658 - DNA, 30 bp, Homo sapiens; identical to SEQ ID NO: 45358
  chr18:13486818-13486848
  hypo

SEQ ID NO: 81659 - DNA, 30 bp, Homo sapiens
  chr18:13491518-13491548
  hypo
ataattaatagctggcgccagtgaatctag

SEQ ID NO: 81660 - DNA, 164 bp, Homo sapiens
  chr18:13516316-13516480
  hypo
atgaacgatctcttccgggtgtcctagaggagccctcgtgccttacaggaagttctagccctgtgcagccaacacacacctgtatttgttcagatgtcaccttggtggcacagtacagatccaggggacacctgtgcctctgaggccgtcggggagggtgtgct

SEQ ID NO: 81661 - DNA, 30 bp, Homo sapiens
  chr18:13523082-13523112
  hypo
tgcccccactgtgtgcgaggcagactctga

SEQ ID NO: 81662 - DNA, 115 bp, Homo sapiens
  chr18:13531749-13531864
  hypo
gagatggagagaaagcgctgcatctttctccttagagaactctggggttgtgctggcctcagagacagtggagggggtgagggtcctctgagggcgggagcggccatatgcagga

SEQ ID NO: 81663 - DNA, 30 bp, Homo sapiens
  chr18:13543948-13543978
  hypo
ccggggataccaggacgaggcctgccccga

SEQ ID NO: 81664 - DNA, 30 bp, Homo sapiens
  chr18:13545314-13545344
  hypo
gcaaaggggactcctcggggactctgatct

SEQ ID NO: 81665 - DNA, 85 bp, Homo sapiens; identical to SEQ ID NO: 45359
  chr18:13583740-13583825
  hypo

SEQ ID NO: 81666 - DNA, 30 bp, Homo sapiens; identical to SEQ ID NO: 45360
  chr18:13603756-13603786
  hypo

SEQ ID NO: 81667 - DNA, 30 bp, Homo sapiens
  chr18:13605780-13605810
  hypo
gccctcacatgtcctcgtggtggtatgctg

SEQ ID NO: 81668 - DNA, 30 bp, Homo sapiens
  chr18:13621196-13621226
  hypo
actacaaagtctccacgcggtccttcatca

SEQ ID NO: 81669 - DNA, 67 bp, Homo sapiens; identical to SEQ ID NO: 45361
  chr18:13621659-13621726
  hypo

SEQ ID NO: 81670 - DNA, 237 bp, Homo sapiens; identical to SEQ ID NO: 45362
  chr18:13621998-13622235
  hypo

SEQ ID NO: 81671 - DNA, 30 bp, Homo sapiens
  chr18:13645211-13645241
  hypo
cccctatgtgcagcacgagattgatcttcc

SEQ ID NO: 81672 - DNA, 59 bp, Homo sapiens
  chr18:13824214-13824273
  hyper
ggatcccggggacgccgggggcccgggctgagcgccgcggcccgcgaggaggagcaccg

SEQ ID NO: 81673 - DNA, 289 bp, Homo sapiens
  chr18:13826303-13826592
  hypo
ctcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcac

SEQ ID NO: 81674 - DNA, 267 bp, Homo sapiens
  chr18:13836758-13837025
  hypo
aagcttccagagccgcgtgcctggggctgctacggaagcgggcagactccccgccctgggctctgtcctgcccttcttgtgcctggcctctttctagggagccatggaaacagtgctcctaggatccgccctccagtcctgctctcagtgagaactcagcgcagggctccggacacgggcagacgccgcgctttgtcttcccgtcttcccctcacctcagtgtcctctttctctcacgttctttttttttttttttgagagggagtc

SEQ ID NO: 81675 - DNA, 30 bp, Homo sapiens
  chr18:13837373-13837403
  hypo
gtaatgaaaacagcacgttcccaggaactc

SEQ ID NO: 81676 - DNA, 33 bp, Homo sapiens
  chr18:13839105-13839138
  hypo
ggaatgctggggacacgtcgcctggatttttag

SEQ ID NO: 81677 - DNA, 374 bp, Homo sapiens
  chr18:13868546-13868920
  hyper
agcaagaatgcagcacggagcggagtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggcagctttgaaaacaagcgcaaggagatgcatccaaaagacaaccgaacccatcagggtaaggagcgcagcggtggagtgtgagggggaaccagaagggcggccagggccggcggcatgccatgccaggcagccccgcgccaccccggaacactgggacactctcatattcccaaagggacttctccatgcggcgctctgaccaggcat

SEQ ID NO: 81678 - DNA, 384 bp, Homo sapiens
  chr18:13868946-13869330
  hyper
cgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggatgagaggaccagagccccgaggccagtcgcccccctcccgcccatccgcccgcccgcccgccacgcagggctgctctagcgcctgcctcttcctcttccatagaaacagggttggggagagaaatgttatgttgctggcccaggattggcattgagcgttgttcaattaag

SEQ ID NO: 81679 - DNA, 30 bp, Homo sapiens
  chr18:13886627-13886657
  hypo
tgactatacaatgagcgtcagcacttctgt

SEQ ID NO: 81680 - DNA, 121 bp, Homo sapiens
  chr18:13940522-13940643
  hypo
cctgctgtgggtacccggccgctgagtgtacatgatttcatcgtcgtttgccttaattcttttctgtctgttgttttctttatttctatatagttcagctgagcatcgtgaatgcaaacag

SEQ ID NO: 81681 - DNA, 122 bp, Homo sapiens
  chr18:14450326-14450448
  hyper
aacctctccagcaggcggctcagcactacgttcacgcgcccgcgcccgcgcccgcgcccgtggccgcgcgggccccagctccacgcagcgctcacagaccgtgagcccgcagggcagtgtca

SEQ ID NO: 81682 - DNA, 80 bp, Homo sapiens
  chr18:14450712-14450792
  hyper
gccgcggtcgggctgcgccagccgggccagcatggagcggaagagcccgactgctttctggtactcgctcgcgcggaagg

SEQ ID NO: 81683 - DNA, 16 bp, Homo sapiens
  chr18:14475514-14475530
  hypo
gaggacccagctcccc

SEQ ID NO: 81684 - DNA, 44 bp, Homo sapiens
  chr18:15003453-15003497
  hypo
gccataggcatgctgcggccctgggtgagcgtggagggcaagca

SEQ ID NO: 81685 - DNA, 34 bp, Homo sapiens
  chr18:15017364-15017398
  hypo
ttgtccagtggctcacgcctgtaatcccagcact

SEQ ID NO: 81686 - DNA, 101 bp, Homo sapiens
  chr18:15198000-15198101
  hyper
ggcgggggaagaagccgcggcggccgtggaaaaagtcgcggcggcaaaaagccgcagagtagggggcgaaaagacgcaaaaagccgcggcggcaaaaagcc

SEQ ID NO: 81687 - DNA, 117 bp, Homo sapiens
  chr18:15198161-15198278
  hyper
aaaagcagcggtggcgctgacaaaaagccgcaaaaagcagcggcagcgggggtaaaaagctgcaaaaagccgcggaggcgcgggcgataagccgcggcggcgtggagcaaaaagccg

SEQ ID NO: 81688 - DNA, 85 bp, Homo sapiens
  chr18:18821400-18821485
  hyper
caagaaccttttccccgcagcacccgtcaaggcccagggccagctggacgcggctgccctggggtggagccgtccccgtggtccc

SEQ ID NO: 81689 - DNA, 215 bp, Homo sapiens
  chr18:18821698-18821913
  hyper
cagagaaagcaattgcgcagaggcgagagcaggctgaatgaacgcgggctccaggggaaataatttttcctcctggcttcgcgcgtcagcacactggggtgcagccctccctcacagaagaccccccccccgcacgaccccctgtacacccccgcggggctgcgcgttcgtctgtgcggcggggtttgggaatggaggcgtgaggaccgcgcatc

SEQ ID NO: 81690 - DNA, 1068 bp, Homo sapiens
  chr18:18821914-18822982
  hyper
agggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacctgggagccgtgcctgccttccctgccgcctcgcgtcgcccaccgaagggacccggccgtgctgtccgcgcccagaggccgaaggcctgtcaccgggctctactcgctgcctttgtggcgggagcgagacggcccgggggtgggacgagggagctgcggcgcgccgagtagcgcggggtcccccggcggaggcggcgagggggcacctggttcgtctccccgagcccaggggcagtgagggggtgccgggcaggcgggcgggcgacaggtagggcgccgcggaggtggcggggagaggatggatggagttcagcctgggaaagttgagaacgtccagaggtggctgggcgctcgctcggcgtctgtgggtttttttcctcaacaccaaatgtcacttcgtcacgagcgggcg

SEQ ID NO: 81691 - DNA, 292 bp, Homo sapiens
  chr18:18823194-18823486
  hyper
tgtggagattcagtgcgtggggtttctcagttacatgagtccaaggaacgtccccgaacgcgactcgtttgcccggaactgccgctgcctctaaccgaggctgcgggtcctggagaaactcctcagtcttgcccctttctccggtgaacgtgacggttccaaggtccttatcctccccacccactcctctggccccggctgagaggatagaaaccacattttaatttctgcttttcacaccgtaaggtgtttttttccgcctccccccgcctcgaggcgggaatccctgctt

SEQ ID NO: 81692 - DNA, 86 bp, Homo sapiens
  chr18:18939050-18939136
  hypo
ttggccatggttactcgggcagatttgggaactgcacaacttgagtatccaaatattttcatgctacattaataagaaatcagggg

SEQ ID NO: 81693 - DNA, 20 bp, Homo sapiens
  chr18:19181448-19181468
  hypo
ctggacgagtgagaccctgt

SEQ ID NO: 81694 - DNA, 18 bp, Homo sapiens
  chr18:19191607-19191625
  hypo
cagcgcctggcccattgt

SEQ ID NO: 81695 - DNA, 30 bp, Homo sapiens; identical to SEQ ID NO: 45366
  chr18:19243727-19243757
  hypo

SEQ ID NO: 81696 - DNA, 88 bp, Homo sapiens; identical to SEQ ID NO: 36922
  chr18:19748288-19748376
  hyper

SEQ ID NO: 81697 - DNA, 30 bp, Homo sapiens
  chr18:19748854-19748884
  hyper
gagaaagtttaaggtcggtctcacacaact

SEQ ID NO: 81698 - DNA, 37 bp, Homo sapiens
  chr18:19749409-19749446
  hyper
cagcctggcacccttcggcgagcgctgtttgtttagg

SEQ ID NO: 81699 - DNA, 60 bp, Homo sapiens; identical to SEQ ID NO: 36923
  chr18:19749864-19749924
  hyper

SEQ ID NO: 81700 - DNA, 30 bp, Homo sapiens
  chr18:19750360-19750390
  hyper
gccccacaagctctccgcattgcctctgct

SEQ ID NO: 81701 - DNA, 67 bp, Homo sapiens
  chr18:19750739-19750806
  hyper
acccctgggatctggcgcgcgcacggagaaaggatgcggccgagggggtgggcggggaggacgcggg

SEQ ID NO: 81702 - DNA, 77 bp, Homo sapiens
  chr18:20109538-20109615
  hypo
agaagcacaggtccacgcaggcagccaaagccatcttcttggttgaaagatactcttttcggggggaggagccaaga

SEQ ID NO: 81703 - DNA, 30 bp, Homo sapiens
  chr18:2038636-2038666
  hypo
atgagccaccgtgcccggccgattctccct

SEQ ID NO: 81704 - DNA, 30 bp, Homo sapiens
  chr18:20680329-20680359
  hypo
tcaaaatattcatggcgcctaaagtaaatc

SEQ ID NO: 81705 - DNA, 135 bp, Homo sapiens
  chr18:20685485-20685620
  hypo
ggctcactgcaacccagaggtgtcagttcttacaggttccttacacagcatgagtttgaagcttagggtattgattggccctgcctgaagcgttagtgagaaaccgtgggctttgaacctcggcagggctgtgaa

SEQ ID NO: 81706 - DNA, 118 bp, Homo sapiens
  chr18:20716572-20716690
  hyper
tgagtatccgggatgcgacgcgcacccaaccctgcgtcccgcccggcgctcccagcctccccgcggtctctgggctacgggacacgggttgctcccattttcccgcgccctgccggat

SEQ ID NO: 81707 - DNA, 32 bp, Homo sapiens
  chr18:20734199-20734231
  hypo
ctcataatcatgtgccgcggtaactaaacaag

SEQ ID NO: 81708 - DNA, 350 bp, Homo sapiens
  chr18:20911344-20911694
  hypo
gtgaaacctgccccccgccaccacctgtagtacaggagacaccacaaagcaagaggccccagggctctgctcgggaagctgccgggcctgtttttcctcccagtggccaacaaacaggagggcaggttcagcacgttgggctctgctttctgagcgccgcaccattacagcatccacatccgatttttaaaactgaagtataacataaataccgtgtagtgtaggaggcacaggaatctcaagtacatggcttgctgagcatttatacccattagcacccacacagctgccacctggacagagacaccggcccttcccagcattgcaccaggctccgcagactcctccca

SEQ ID NO: 81709 - DNA, 187 bp, Homo sapiens
  chr18:21163405-21163592
  hypo
acaggacaagaatgtcgtagataatgtagcatgtgaaatggggccctggaagatgggcaggattttgctagcaagcagttcaatttgactggagagctgatgcccttcacagagctggaggtcaaagggcagaaaggggcacccgagatcagagatgactgatccaggcttccgctgtaggtaatct

SEQ ID NO: 81710 - DNA, 24 bp, Homo sapiens
  chr18:21164586-21164610
  hypo
aagaggagggcggatcgctagagg

SEQ ID NO: 81711 - DNA, 39 bp, Homo sapiens
  chr18:21168942-21168981
  hypo
ctgctcccagcccgcttttcttttcggtatgctttgtca

SEQ ID NO: 81712 - DNA, 55 bp, Homo sapiens
  chr18:21242816-21242871
  hyper
tcccgccgcccggcccggcagcagccgccgcacacagggccgggccgaaggggcg

SEQ ID NO: 81713 - DNA, 260 bp, Homo sapiens
  chr18:21269423-21269683
  hyper
gatccggctggtgcccgctccagccgcggcaggttccagagctgagaggccacccccacgccgcgggcttccagcgcgtggagcaaggggagcggccccggcgccgcccatatccccggctgcgctagtcctggcgctgcaggtccgggaggcgcaggcggagagcggcggtgcccccgagcccctctgcggacggctcaggcgggaggaccccgcgcggctggatggcggcggccgcgcggcctcggggtcgggcactg

SEQ ID NO: 81714 - DNA, 9 bp, Homo sapiens
  chr18:21270126-21270135
  hyper
ggcaccacc

SEQ ID NO: 81715 - DNA, 30 bp, Homo sapiens
  chr18:21456470-21456500
  hypo
accctaaatagaggtcgctgtgtaaatata

SEQ ID NO: 81716 - DNA, 144 bp, Homo sapiens
  chr18:21789694-21789838
  hypo
atggaagtcaagacacggtgttgagtgactaacgccacattcaaggagcacacgcactgtgattcatttataatgcagttcaagataagactaatccatagtggcagaaatcagagcagtggctgtctacggagagtgggggat

SEQ ID NO: 81717 - DNA, 19 bp, Homo sapiens
  chr18:21796452-21796471
  hypo
agagcgagactgtgtctcc

SEQ ID NO: 81718 - DNA, 53 bp, Homo sapiens
  chr18:21808513-21808566
  hypo
cgcatggcccagcagcggggaagtgttttgtgaacaaacgagttcagtagatt

SEQ ID NO: 81719 - DNA, 540 bp, Homo sapiens
  chr18:21977137-21977677
  hyper
tctcccttggatattcgttcatgcttgtagaaccgaccacgcggtacattgggaaacggtcacatgaacaatgcgtgacttccattgtgcatcaatcctcctcttgttaggaggaaattaaaaagtcacatggacacacgaaagtaccgagaaggcacgcagctgaagatctggtaggggatgcatgcggcaccagcatggtcgtggcacccgagtgggaagtgcaacaaacgccaacatcttgttacttttaacgcctaacttcctgcagcgctggagcagccagcggccgccgggaagccgagctcggctgcagccctgcgtcgccgcgccacgacccgaccatcctctgagacgcccgggacgggagcgcccacccccaaccaggcgcggacagacctcccgagcgcagcccggcgggaacccgtcagcgcgggaaccggcctcgaactccaggcgtggacagccgcgagaaactgacctacgcggtcacccgggctcccagagctcccgaggcggtggccacgaccccaggcttcc

SEQ ID NO: 81720 - DNA, 32 bp, Homo sapiens
  chr18:21978002-21978034
  hyper
gacgcgtaaagccttcgcgctcctcccaccac

SEQ ID NO: 81721 - DNA, 35 bp, Homo sapiens
  chr18:22006639-22006674
  hyper
ctctcggctcgcagccgcagcgccccgcccccgcg

SEQ ID NO: 81722 - DNA, 162 bp, Homo sapiens
  chr18:22006877-22007039
  hyper
cgccatttgctccaccgcgttccattttcccggcgcttcccgtcggccgagcgctcttaggccggcggctcctcggcggccgcggtctcggcctgtctcggacggtgtcctcgtcaaccattaacacgcgactaagcagctctgggccgaaggcaaaaaccg

SEQ ID NO: 81723 - DNA, 47 bp, Homo sapiens
  chr18:22136813-22136860
  hypo
tgtcactgaacggtacgtgaaaatagttaaaacggtaaattttattt

SEQ ID NO: 81724 - DNA, 102 bp, Homo sapiens
  chr18:22596688-22596790
  hypo
tccactagtgactggcgggggaaagacacatgtcctgccaggcacgtgagagtggccgtaggctccactgagggcttcacccctggacgcttgagatgtcac

SEQ ID NO: 81725 - DNA, 18 bp, Homo sapiens
  chr18:22736912-22736930
  hypo
agaactttaagaggccga

SEQ ID NO: 81726 - DNA, 30 bp, Homo sapiens
  chr18:22756643-22756673
  hypo
gcaaacaactggcagcgaagcctacagggg

SEQ ID NO: 81727 - DNA, 30 bp, Homo sapiens
  chr18:22782434-22782464
  hypo
atggataccaagagacgactaataacacaa

SEQ ID NO: 81728 - DNA, 100 bp, Homo sapiens
  chr18:22799423-22799523
  hypo
acatgtgagtggatacgtgtagcaggcagctgtttatatgagtccgaaactcagagcaaagatgtgagttggagacatcattgctttttaaaattagctc

SEQ ID NO: 81729 - DNA, 30 bp, Homo sapiens
  chr18:22805066-22805096
  hypo
aggttcgagagcacacgttgcacttgtaat

SEQ ID NO: 81730 - DNA, 19 bp, Homo sapiens
  chr18:22900421-22900440
  hypo
accgcgcctggcctaaagg

SEQ ID NO: 81731 - DNA, 131 bp, Homo sapiens; identical to SEQ ID NO: 36926
  chr18:22928965-22929096
  hyper

SEQ ID NO: 81732 - DNA, 533 bp, Homo sapiens; identical to SEQ ID NO: 36927
  chr18:22929186-22929719
  hyper

SEQ ID NO: 81733 - DNA, 357 bp, Homo sapiens; identical to SEQ ID NO: 4528
  chr18:22929926-22930283
  hyper

SEQ ID NO: 81734 - DNA, 1070 bp, Homo sapiens
  chr18:22930284-22931354
  hyper
gtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaaactttcccagccttcgacccccacccccaatctccaagaaaaaaaaaaaaaaaggaaaaagaaaaaaggaaaggagggaaaaaaagctaaaaaaaaaaccccaaagacaatgtttgaagagccgtcagctacactaaaaagagaaaatccgttactatttccacctcaatcaaaattcacatagttcatgcgaatagaaaaaaac

SEQ ID NO: 81735 - DNA, 30 bp, Homo sapiens
  chr18:23686462-23686492
  hypo
tcaaaaaatgtgtgacgtgtataaacagtt

SEQ ID NO: 81736 - DNA, 94 bp, Homo sapiens
  chr18:23745191-23745285
  hypo
agaggtagatgctgaaatagttaaggatgaaatataatgacatctgcaacttcagcattaaaatgtgtgtgtatgcgtgcgcacgcatgcaccc

SEQ ID NO: 81737 - DNA, 40 bp, Homo sapiens; identical to SEQ ID NO: 45369
  chr18:23841433-23841473
  hypo

SEQ ID NO: 81738 - DNA, 531 bp, Homo sapiens
  chr18:24127654-24128185
  hyper
ttgcttctgcaccaccggcccggcgccctgctcctcgagcttgcggatgaccgcggccagcgtcaggttggcgctgcgcagctcggggtccttggtgaggtcgagcgtgcggcagtacgggggctcattgaggtagcggttgagggagctgcggatgctgatgagcgacgacttgctgtagagctggccgcttttggagcgggcctcggcatagaaggagcgcagcacgcggcacagcgcccccttgtccatggtctcgaagtccgggctctgcgccttctcgctcaggtactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatattgatcatatggaccggctcgggctccagctcctccccggccgagtcctcgggctc

SEQ ID NO: 81739 - DNA, 27 bp, Homo sapiens
  chr18:24130387-24130414
  hyper
acgctgctggtcctccgcgtgcctgcc

SEQ ID NO: 81740 - DNA, 303 bp, Homo sapiens
  chr18:24130644-24130947
  hyper
ggctttgttcacaatgcactgcccgccgcacccgccctggacacgtgcagaaaggcgtgctcgtttctccgaggctgcggtgagcagctaagttagttgcacactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggctc

SEQ ID NO: 81741 - DNA, 89 bp, Homo sapiens; identical to SEQ ID NO: 36932
  chr18:24131098-24131187
  hyper

SEQ ID NO: 81742 - DNA, 30 bp, Homo sapiens; identical to SEQ ID NO: 45370
  chr18:24465773-24465803
  hypo

SEQ ID NO: 81743 - DNA, 553 bp, Homo sapiens
  chr18:24764615-24765168
  hyper
cgcagcagagatgctcgtctttctgccacacaccctggaggacccgacagactggcagcagaaactaaagactgttcctgccgtcctctttccaacctctgcatgccccaagaggggtctgaccccggaatcctggagtccagggtgccccgccggggcgcaggaaggaaactcaggtagctgacaagttcaggcggccgtccttctccagcgccccctcaaagtcaggatcccctcctgctcccgccccccacctcccgccatgcgtccactgaagtgaagggaagtgggttggaatactggaggtaggggagatagaaaaaggaagaagcctcccgcatctccagcggcgaagcacctggaaaggtgagggcgcacgtccccgcccaccagagcccgctcccggcgcgggtacccagcagcgcgccatcatctctgcccctccagtgccccccagccccaaccccagccccagcgcggttacctcgcgggccgctgccgggcgcttgcaggtgctgctgttccaggagcgcagcttcggaggaaacttccc

SEQ ID NO: 81744 - DNA, 43 bp, Homo sapiens
  chr18:24765377-24765420
  hyper
tctttttctctccctcgcccccgctgcccgccctgccttctcc

SEQ ID NO: 81745 - DNA, 36 bp, Homo sapiens; identical to SEQ ID NO: 45371
  chr18:25089977-25090013
  hypo

SEQ ID NO: 81746 - DNA, 210 bp, Homo sapiens
  chr18:25755242-25755452
  hyper
tagttctgaaatccccgagtcaggagagagccgagtggcggatggcgagtgggggaagggagaaagaccggtaggagactaaagaacaaaagaagaaatccaagaaagggaaaaggaacgctgggaccctggcctgggaggcaggggtggggagagacaaagtgagagagcacgacccgggaggagagcgtggagccgggcagggacagg

SEQ ID NO: 81747 - DNA, 485 bp, Homo sapiens
  chr18:25755555-25756040
  hyper
cgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgc

SEQ ID NO: 81748 - DNA, 351 bp, Homo sapiens
  chr18:25756635-25756986
  hyper
ccccgcgagcttgctcggccccgaagaaggagcagaggggacccgcaatccagcccctagagccccgccaggaaaggcgcgagagacctactggccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 81749 - DNA, 185 bp, Homo sapiens; identical to SEQ ID NO: 36937
  chr18:25757253-25757438
  hyper

SEQ ID NO: 81750 - DNA, 533 bp, Homo sapiens; identical to SEQ ID NO: 13014
  chr18:25757439-25757972
  hyper

SEQ ID NO: 81751 - DNA, 359 bp, Homo sapiens; identical to SEQ ID NO: 36939
  chr18:25758128-25758487
  hyper

SEQ ID NO: 81752 - DNA, 30 bp, Homo sapiens
  chr18:2623947-2623977
  hypo
tttttatgtttaaatcgtcccagatttggc

SEQ ID NO: 81753 - DNA, 85 bp, Homo sapiens
  chr18:266838-266923
  hypo
caatatgatcttggatagtcctaacagttactcttagcaggctttcaaagcaccagagattgcagcaaaacgcacacaaagaaaa

SEQ ID NO: 81754 - DNA, 24 bp, Homo sapiens
  chr18:2755854-2755878
  hypo
gccctcggccgtgtattttctttt

SEQ ID NO: 81755 - DNA, 1715 bp, Homo sapiens
  chr18:2846451-2848166
  hyper
ccccccgcgtggcctcggaaactgtcagatggtgcctaaggcagagttgggcaaagaaagaaccagcgttcgtttcctcctggactctctaggtccatggagctggtgggggaacggccctgtcttgcccgaggaggaaattcgagtcgagcccccactcctctccccgcgggactgataaacatgtccctcattcgccccgggaggctggcacccaggcacgacgcgaggacggccagactcgccgacggcggccgcgtcccggggggccgggagcgagcctgtcggaaggtgggaggcggagtcgctcggcatctgggaagagaccaaaggaatgagtcattggaaatgctgtaacgtagacccttatcccaaaccctttcgcccctccaccccgagccccctgccgagaagcgaagggactggagacggggagacttggtggggggagagtcacgtttcggagagggaagtgaaataaagagggcggcacccggggggacctgtgcgtcattgagggaccggggagaagcgcagggcgcacggggctgcagaaggagaagtaggaacgagaagccggagggggcggccgcggagcactggttggagcgccgcgaagcgcccgagcctcttgccttcgcgggcggcgccctggccgccggcagccttgtggccggtgccccgatccgccgcgctccggacccgggcaggcggggcgcgcccgctgcgcgcgggatgtggcagcccagacggccctggccccgcgtgccctggcgctgggcgctggcgctgctggccctggttggcgcggggctgtgccacgccggcccgcagcccgggtatcccgcgcggcccagcgccaggaacaagtaagtgcgcgccccttggctggccccaaaccgcctacccctccccggcccccagttgagccccagagctgccctgccaaagacgacgagcggcagccgggggcctcccttggacttccccgggcggctccctctgcgggggaccgcgcgctccgcagccggcgcctcaggcagagctgactccgggggcgtgggcgcagagagcgtcccgcagacccgggcgatccgaaaacgactcccaggaattccatgagcccctgggaccatgggtgcttttctttcccgtcttggtcgggtccaggcgcgcgctctccagaggcgcacccgggcaccctccggcgtctgctcggtgaagctcccgcctccgcagagggcgacgggcccccccgaccctcgctcggtctggtgccgcagtcccctctcccctggcctcattgttctccgggtttaccccgtgcccctctccctctctctcctgcaccccaggaactggtgcgcctacatcgtgaacaagaatgtgagctgctccgtgctggagggaagtgagagttttattcaggctcagtacaactgtgcctggaaccagatgccctgtccgtcggcgctggtgtaagtcctggagccggggagcgggcggggcgcgcccgggccggggcggtgggggtggggtggggttgctgcgctgggctccagtccctccggtaaatcccttccagatccggtgaaaagcccgcagcggaaaagcgctccgagcgctcgcggggcaccggccacgctgggctatttagggagtgggtgctgcccgagtgagtggggaggatgcgcgcgcctcgggagtgtggggtc

SEQ ID NO: 81756 - DNA, 125 bp, Homo sapiens; identical to SEQ ID NO: 4530
  chr18:28620831-28620956
  hyper

SEQ ID NO: 81757 - DNA, 143 bp, Homo sapiens
  chr18:28621033-28621176
  hyper
cgcgcaccttcttccttgccacagctcgacacccccacccatgccttgccgggaaagctcctggtcttccatggcctctgggagcctcgagcgaatgcgagaaattctgagagcagcacccgtagtttcgttccccatcctca

SEQ ID NO: 81758 - DNA, 550 bp, Homo sapiens; identical to SEQ ID NO: 36942
  chr18:28621474-28622024
  hyper

SEQ ID NO: 81759 - DNA, 104 bp, Homo sapiens
  chr18:28622025-28622129
  hyper
agaaacccacttctcaggggcagccccaccaagggacccagggacacagccccggctccactcactaacgaaccaatccgggtcaactgcgacccagagctggg

SEQ ID NO: 81760 - DNA, 455 bp, Homo sapiens
  chr18:28622419-28622874
  hyper
ggctgctaccagacccgcagcattgatctgagccgcggttgtcacgtttcggcccgctttgtccccagctccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttctcgccgctgcttgtttttaagtgtatttggcctctctcaggcttgcctgcccgggagcaacttcacttctgaaaccggattggacccagaggacgcggagaggccactccttgttatttctcaagttttatcatcgccggcgcggctgaggagctgc

SEQ ID NO: 81761 - DNA, 149 bp, Homo sapiens
  chr18:28681064-28681213
  hyper
gcagaaaaatcgagtcgcctctggggacaagaaatcagaaagacccttccttcctccgaagatttagggaactgaagcctcgcacgttaagaaaccactgaaactgtacaaatgctcacctagggctcgccggtcgacagtcctcagga

SEQ ID NO: 81762 - DNA, 35 bp, Homo sapiens
  chr18:28681994-28682029
  hyper
ggcgagggccgcggccggagcgcagtctgggcccg

SEQ ID NO: 81763 - DNA, 30 bp, Homo sapiens
  chr18:2879366-2879396
  hypo
aacagccatgccaggcgcagtagctcatgc

SEQ ID NO: 81764 - DNA, 376 bp, Homo sapiens
  chr18:2906054-2906430
  hyper
cggcggggatggcgtttcttggcgagcgggtccctcagccaggcccgggtattgtcaggcgtcccgtggacggtcgggaggggcttcctggagggctcgttccgggaacgagttcaaaggaggaaagggcggcagcttccggcgccttccccagagggccgggagacgcacgccaggagcttcctccgttggaagtcccttccgctggcgacgtgggcgctgtggccgcggccctcgtggagcctgagccctcctcacggcctccgcgcagccctggggccccccggcagggtccctcggcagcccgcgggagaggccgtggggccccggcaggagtgtggttcagagacggtgcgggggtcggtggcctcaggtc

SEQ ID NO: 81765 - DNA, 30 bp, Homo sapiens
  chr18:2907170-2907200
  hyper
tcggggtccagccttcgggggggcaagttc

SEQ ID NO: 81766 - DNA, 124 bp, Homo sapiens
  chr18:29078131-29078255
  hyper
gggccagggaggagccgagtgcgcgctcggggcaggcggcggcgcggagcggtgcggcggcgggaggcggaggcgagggtgcgatggcgcggagcccgggacgcgcgtacgccctgctgcttct

SEQ ID NO: 81767 - DNA, 98 bp, Homo sapiens
  chr18:2913170-2913268
  hypo
ggcccagctgcataccgctgggtacaggagagagttcctggaataccaccgccctccaggagctttgcatacctgcgggggcccgggggcattccacc

SEQ ID NO: 81768 - DNA, 30 bp, Homo sapiens
  chr18:2917759-2917789
  hypo
acagcaaagcaaatacgagacttagactga

SEQ ID NO: 81769 - DNA, 35 bp, Homo sapiens
  chr18:29521127-29521162
  hypo
gggcgcggtggctcacgcccataatccccgcactt

SEQ ID NO: 81770 - DNA, 157 bp, Homo sapiens
  chr18:29599667-29599824
  hyper
ggcttggacgttagccgccaagcccctgaatgtactccttcaaaacccagccacaacgtaacaggaggtggcaggctacctgctttacgcacggtctctccaaaccggcggaaattacagagtaaaataactttctcaaaaccgcatagtacttagc

SEQ ID NO: 81771 - DNA, 58 bp, Homo sapiens
  chr18:30349723-30349781
  hyper
ccgctccaccagctccggggccgggatgagggcgaagcggaggcgcttcatgaggtca

SEQ ID NO: 81772 - DNA, 1012 bp, Homo sapiens
  chr18:30350062-30351074
  hyper
caggatcttgctgaccgacagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaaggagtcccgggctcctcctgcggcggcggctgctgctgctgtgacggctgctgctgcggcggctgctgctggtccttgggggcccccaggccgtcctggccgccgacccctcccccgagaggggggtggctggagaagagcgatcggaagtactgcgagcaggaggccagcacggccttgtggcaatggaactgctggccctgggccgtcagggtcacgtcgcaaaacagctgcttcctccacagcaggttgaggccgtgcagcaggttgtcgctgtggctggggtcgaaggtggaggtcctgtccccggatctggacatggcgagctgactcggtgcacctggctttaaaccctcctccaacctggcagacaggggtgggggatgggagggaggggagcagggtggtggagcgggtggggtgtggtcggggtggggaagggtgtggaggggaggggagggcgaagaacaagaatcaaggctcagcttgactccctcctggcgcgctccggaccccgaccctaggaggaaagtccgaagacgctggatccgtgagcgccaccagaagggccctgtctggggtcccggcgccggttctgcgccctgcggctcctctcgccacctcccacacacttcgtccctcactttcctaaaaccaaccacctcagctcggctgttggcagcaacagcagtggcagcagcgacggcaaagtggcggctgaggccgaggcacctcgtgggctcgtgtccatgccgggccagatgaagggaaaggccgggaagtggggagccgggggtgccctgaaagctcagaggcgaccgacggcgaaggttccaggtc

SEQ ID NO: 81773 - DNA, 43 bp, Homo sapiens
  chr18:30351356-30351399
  hyper
caacctggccctgcccgcttccccgcttcgcaaactgttggct

SEQ ID NO: 81774 - DNA, 30 bp, Homo sapiens
  chr18:30351670-30351700
  hyper
ggcaccaggcgcagtcgctttaactccagt

SEQ ID NO: 81775 - DNA, 344 bp, Homo sapiens
  chr18:30351913-30352257
  hyper
gtaaaaagtctgagccgcccgcatctaggcagaggagggcagggtgggggaggcgaggcgaaatcgatacgccaggtccttaacctgtaattgcaccttccagggctgagcagaaagggaccctctgcttgcatcccgcccgcgcgccggcccgccggcccgccggcccgcccgcccgggggagagccgccgccgccgcccggctcggagggatcccggcggacctgccccttccactgcggctcactctgccctgcctggcgccggtcctggatcgccggcttcctatttataccggactgggctcctttcgactcactttaccatcccgttccaggtggacc

SEQ ID NO: 81776 - DNA, 30 bp, Homo sapiens
  chr18:30781529-30781559
  hyper
cacagacttcagaggcggggcttcagttgg

SEQ ID NO: 81777 - DNA, 187 bp, Homo sapiens
  chr18:31020324-31020511
  hyper
tgggaaactggaggacggagaacagggggacaaaacgactgggggactggggaattatgggactggggatttggggaattgttttcaaacgcgcggggcaaggactccccaccgcctctggaaggggtgaagaactagtcgactctaactccctcagggtggccagggaattgcatttggttctccc

SEQ ID NO: 81778 - DNA, 97 bp, Homo sapiens
  chr18:31157850-31157947
  hyper
gtgagtgagtgtgcacgcgtgagcgcacaggacagaggcgtcgaggtgcggggcggactcctacacaagttccaaaggccaccgtgtccgcggcttt

SEQ ID NO: 81779 - DNA, 561 bp, Homo sapiens
  chr18:31158489-31159050
  hyper
gcgagtgcgggtcaccgggtcactgggtcattgtctccgcgcccgaaccccgagcaccccgtggaatcccccacgtcatcatcagaaccatcaatgagatgcaaacatgaaagacaagaggaagaagaaggaccgcacctgggccgaggctgcccgcctggtacgtaccgccccccacacgccgcccgcgcctcccgccggccccgccgctcgccccgcgccggtccgcggcggcggagacggccacttccagcccgagccgccgcccgctcgccgggctcctgctctttgttattctgcgggagtgggctcgcccgggggcccctgtgtgtgtgcgtgcgcgcgcggaggggcgcagcgattatctccgggagccccgcgtccgggaccgcccgggacacttctccccgtacttcgctctcggggctctgctgtgccttctccacgggtgaatttccgagcgctcggcgcagctcgacttccctctctgccgctccggagacctttgtgtggcaattaccactccctcccggcccctccaccccccggaatttcatcaat

SEQ ID NO: 81780 - DNA, 30 bp, Homo sapiens
  chr18:3126638-3126668
  hypo
ggcgtgcaagcatagcgtcatacataggac

SEQ ID NO: 81781 - DNA, 30 bp, Homo sapiens
  chr18:3152033-3152063
  hypo
tgcatgcaggcactccgtttcactcaaatg

SEQ ID NO: 81782 - DNA, 610 bp, Homo sapiens
  chr18:31739032-31739642
  hyper
ctgtttctacttcagcggcggcggctggagcagcgggtacaggtgaggttgccctggcggtgtccatagcaacgctggagggggtggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 81783 - DNA, 329 bp, Homo sapiens; identical to SEQ ID NO: 36954
  chr18:31802052-31802381
  hyper

SEQ ID NO: 81784 - DNA, 427 bp, Homo sapiens
  chr18:31802675-31803102
  hyper
ggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactcggagccattgagga

SEQ ID NO: 81785 - DNA, 331 bp, Homo sapiens
  chr18:31803302-31803633
  hyper
cacgttgcagggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatattttgtgaccaggaccatcccaacaccattctggcccagaggagctgggttttcaataattaaaatcccattccttggtttattaaaaatcccaatattgaattggggtggtccctagacgcctcgcccccgggctgc

SEQ ID NO: 81786 - DNA, 6 bp, Homo sapiens
  chr18:31803634-31803640
  hyper
tccggg

SEQ ID NO: 81787 - DNA, 30 bp, Homo sapiens
  chr18:31804123-31804153
  hyper
tggcggcgggtatcccgaataatgatggga

SEQ ID NO: 81788 - DNA, 335 bp, Homo sapiens
  chr18:31804809-31805144
  hyper
gggaaggtctcgcggcggctggagccgggactgacagcccgggcggagcgcaggcagctccacacgctaaacctctcgcctctcccctcacccccacccctcccactcccctctccttcccccaccctccccggccccttccaagctctctgattggccaatgggacaaaagtttctgtggagacggctgggcgctgacgtcacgggcagaattgtcccatttagggatcccgggggcagtgcgcatgctgcaggctgcaggttagaggcagaaggaggtagcagcgggcccggcggcagccaggtggcagaaaggagcacgcagcatccaggtg

SEQ ID NO: 81789 - DNA, 183 bp, Homo sapiens
  chr18:31902672-31902855
  hyper
ccagagggagaatgacgcagagaggaggtagagaaaacattaaaaagaatatttattttctaggaccatggaaagctgagtagtgaattttatttttaacttcattttttgatcaacccttttcttgaaaagaaaacgctagcgatttcacttaaggcacaaccagagcgccaccatgtggtg

SEQ ID NO: 81790 - DNA, 596 bp, Homo sapiens
  chr18:32073235-32073831
  hyper
cgggggaggcggatgaggaggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgcc

SEQ ID NO: 81791 - DNA, 386 bp, Homo sapiens
  chr18:32073907-32074293
  hyper
cgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatggcagccggctccttcgcgtcgcgggttgagttgttttcgttgtggtcgctgccctcttggtcatcctctcgggctgagctggtgggaggtggagtgtctacctccattagggatgatactcacgtcggggaacagtctgaggggtactgactgggacatccgcgttgggttcctttgcagccagcggcgtcctttcgtgttgcagtgcactgcggtgcccgggccga

SEQ ID NO: 81792 - DNA, 42 bp, Homo sapiens
  chr18:3215130-3215172
  hypo
gctggtagtgactcacggtgctgcgcacgtccttgttgcggt

SEQ ID NO: 81793 - DNA, 75 bp, Homo sapiens
  chr18:32557928-32558003
  hyper
ctcctccagtgacttcgtcaatacagtgccaagggcagagccgtaacctcggagaaggggcgctgcagccatttg

SEQ ID NO: 81794 - DNA, 146 bp, Homo sapiens
  chr18:32957667-32957813
  hypo
gacaagtttgacatccgcaaccccatgctttcacaggagaacacaatggcccttgaaaaagtgagaactgacccacataaaatttgttacaatacatacacatatctctcctcagataatcttaatctcaattgaaaaataagttt

SEQ ID NO: 81795 - DNA, 30 bp, Homo sapiens
  chr18:33078363-33078393
  hypo
ttcttttatttgagacggagtttcgctctt

SEQ ID NO: 81796 - DNA, 29 bp, Homo sapiens
  chr18:33078633-33078662
  hypo
ggcgtaagccaccacgcccggccggttct

SEQ ID NO: 81797 - DNA, 104 bp, Homo sapiens
  chr18:3330713-3330817
  hypo
cctcaggcagagacgcgcctggataataaaaaaaggttaggatgggggataccagagattcgtgccctatgcaaatagcacaactggtctaaccagtctttctt

SEQ ID NO: 81798 - DNA, 139 bp, Homo sapiens
  chr18:33529996-33530135
  hyper
cgtctggctctccacgccaacccattctgcccgctgactgcttgagtcctaagcccgacgaccctgccccagaccctggagacgctggacgctggctcacctggatcccactcagacccgggcgcgggctcacctggtc

SEQ ID NO: 81799 - DNA, 487 bp, Homo sapiens
  chr18:33767425-33767912
  hyper
tggcgggggcggagtcgccgggggccggcttcgcgcacttcccgggcccggccggcctggatggactagccggggccatggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcaggtgaggcgggcgggcaggcttgggggacacgaggtttctggaaccgacgtggacggatcttttgctcctagtgagagcggcgctacctcattcgggcgcattttgaatcgaaactccaggagggacgtgtccacgcgtcctcctagtagacacggctccctgaggtcccacctgcagccccaaggcttcttgctactcttactcttccgactttccggtgggcaggaccaacctagccgtcttccccttttcccgccctccgcgagcg

SEQ ID NO: 81800 - DNA, 171 bp, Homo sapiens
  chr18:33876948-33877119
  hyper
taactggggagaggccgtggtgatgcagaggtttaaccagcatccgccgggagccccggggtccaggcccggcgctggagtcccgcagcgaagcctcgcagcccccacgcctctcgactctaggcttgtgccctaaaagcggcctgggttccctggcgcaccctcctcttt

SEQ ID NO: 81801 - DNA, 52 bp, Homo sapiens
  chr18:33877877-33877929
  hyper
ggccgccgctgttcacgttccgcgaggacctcgcgctcggcacccagctggc

SEQ ID NO: 81802 - DNA, 260 bp, Homo sapiens
  chr18:33878296-33878556
  hyper
gcgggcagtcggcctcggcactcgggcgggcaccaagcggggcgcgggaagaagcggagcgccgcgagactcaggtcccttggagaggagagctctgagcgacggccgggacaaaacctccctcaggcctctggggccgctgcgggcggccacgcgaccctcgcgacaaagcacgcttcccggcgacaccgcctcctccttcccccgggggcgccgccggggacgccggccgcacactgcgatagcgctcagggtatccc

SEQ ID NO: 81803 - DNA, 89 bp, Homo sapiens
  chr18:3453723-3453812
  hyper
gtcgctgcttagggcggtgggatcctcaggccatgttgtggctttctccacaacatttccttgtatgtggatagcgtgaaagaagcttg

SEQ ID NO: 81804 - DNA, 15 bp, Homo sapiens
  chr18:34833539-34833554
  hyper
caggcccatttctgc

SEQ ID NO: 81805 - DNA, 572 bp, Homo sapiens; identical to SEQ ID NO: 36963
  chr18:34833958-34834530
  hyper

SEQ ID NO: 81806 - DNA, 30 bp, Homo sapiens
  chr18:34842164-34842194
  hypo
cccgcccatgctgtgcggctctgttggtat

SEQ ID NO: 81807 - DNA, 38 bp, Homo sapiens
  chr18:34855289-34855327
  hyper
gggaaagggaggagccggggaggcggggcgggggctcg

SEQ ID NO: 81808 - DNA, 454 bp, Homo sapiens
  chr18:34973974-34974428
  hyper
aaattgccagcttgtcgggggccgcagggcgcgcgcgacaactggcgcgttcctctgggcggcgctgggctccgagacccgcgggaggggcccgcggcagatgctcggggaccggcccgacgggggcggggcagcggggttccggcctccatagcaaccgagctgtgaccatggccagagagatggctcggcagccgccacctcccactctggacaggcgcgaggggcggggcggagggcgcgggcagcgcagagcagggagagggacgcggggcgggaggcaggaagctgggggacggaattgggcggcttctcccctcctgctcgcgtgcagccgccgtgaccttagacctggccggcgtccacgggcataccatgcgggcaccaggcaggccgtgagctgcccttggtccagcagccgggcctccttctggccgcgcgtgcttcctggctg

SEQ ID NO: 81809 - DNA, 328 bp, Homo sapiens
  chr18:3499043-3499371
  hyper
ggtggacaactacaccgcgacagtggaagtcaccgagctcgggagcggacgggctcggagggggagaggcagccggcagaggagcggccgggggaggaggggacagatgcttggcggcggcggccgggctgcggggcgctcagagccgggtctgcgcctcggggatgtagatctcgatgctctcggcgctctcggtggccgagttctggcggacggacgcggcgcgcttggcggccatcaggcgcttgcgggcctcctggcgctgcgagctctccagcgagcgctcccggatcagcggcgcggggcccttcgccggcttctttggcac

SEQ ID NO: 81810 - DNA, 295 bp, Homo sapiens
  chr18:35064851-35065146
  hyper
ctcccccctcaccaccgccccatctctctgaacccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctggctccttaaataaaccgcggtgatctcacttgcggcgccccctcccacgccggccccctcctcccccactagag

SEQ ID NO: 81811 - DNA, 342 bp, Homo sapiens
  chr18:35065516-35065858
  hyper
cgctctgggccttcagcgctgactcacgctcgcagtaggtgaggaaggcgcagcctggggaggaaagcaagcgccaagaagggtcagtggggcgcccccgggcccgccgacgcgccctgccgcccgccctccaggctcccgcccctccctgccgctcggtccctgtccccacctctctttctctcccgtgcactgttctcggagcttctctgcctctcggtgttcccggctgtctgcctctcgtacctccctttgcttttctattttgctccctccgcggagtctccccaccctgcatcttccccccaccacacccccctctccttacggttctctccttac

SEQ ID NO: 81812 - DNA, 61 bp, Homo sapiens; identical to SEQ ID NO: 36967
  chr18:35067550-35067611
  hyper

SEQ ID NO: 81813 - DNA, 33 bp, Homo sapiens
  chr18:35104518-35104551
  hyper
ccaaaggtaaattttcggccggcggggcagccc

SEQ ID NO: 81814 - DNA, 111 bp, Homo sapiens
  chr18:35104934-35105045
  hyper
cgccctcggccctccctttcttctctctccgcctgccctcctcccttctcctttgttaaccacctctctttcctaggggcctcttgcttggccagccgaccacccttctgg

SEQ ID NO: 81815 - DNA, 117 bp, Homo sapiens; identical to SEQ ID NO: 13034
  chr18:35144820-35144937
  hyper

SEQ ID NO: 81816 - DNA, 841 bp, Homo sapiens
  chr18:35144968-35145809
  hyper
cgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgct

SEQ ID NO: 81817 - DNA, 139 bp, Homo sapiens
  chr18:35146102-35146241
  hyper
acggcgggcggcggccgggggcagggcggcgtggggcggcggccaccgcgcctcccccgtcggcggccccgcgccgtggcgatggtacagtccgagacggcccccggctataaatagcgccaggcgcatggctcttcgg

SEQ ID NO: 81818 - DNA, 113 bp, Homo sapiens
  chr18:35146652-35146765
  hyper
agacaagagctctctcgcgcgcgctctctccctgtctctctgtgtgtgtctttctctgtttttttttcctcctcgcacccccaacctgccagagcagccccacatcttcctcc

SEQ ID NO: 81819 - DNA, 195 bp, Homo sapiens; identical to SEQ ID NO: 36974
  chr18:35146895-35147090
  hyper

SEQ ID NO: 81820 - DNA, 78 bp, Homo sapiens; identical to SEQ ID NO: 36975
  chr18:35147091-35147169
  hyper

SEQ ID NO: 81821 - DNA, 4 bp, Homo sapiens
  chr18:35147245-35147249
  hyper
cgtt

SEQ ID NO: 81822 - DNA, 355 bp, Homo sapiens
  chr18:35147449-35147804
  hyper
tatttacctgcaccccgtcctctctcatgtttgctttttcagggcagcctcttcgcttcagaagcctggcaaattgaaataacgcgcccgctcccccgcgggctgcggggctggggagctggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggtt

SEQ ID NO: 81823 - DNA, 34 bp, Homo sapiens
  chr18:35147834-35147868
  hyper
cgcctctctctgaggatcccgggcccaaaccaaa

SEQ ID NO: 81824 - DNA, 161 bp, Homo sapiens
  chr18:3616260-3616421
  hypo
aaaagccatccagcacgtattttaggatgtgtggatcattcgctgtctgacctgactactctatcactgtggcacagccctgggcgatgtgtacatgtacagccttgtttgtgtttgagaggtgagcccattcggtggtctgagggcgatagtttgccaat

SEQ ID NO: 81825 - DNA, 217 bp, Homo sapiens
  chr18:37421625-37421842
  hyper
agggatgagatgaagcgtcttcccgcgtacagccgccctgatggatcgctggggcctcgggcggggtgcaccgctgtcctttcgccgccgtccgggcggcactgcacgtgcagcgcgcggtcccccacccagcgcagcccgcaacacccctggtctgccgcaggagaccctgccgatgccactcagggtcaagactctggcgcggtggaaactgcag

SEQ ID NO: 81826 - DNA, 56 bp, Homo sapiens
  chr18:3771517-3771573
  hyper
cgaggctgaggactgcgcaggaccgcccgggcgggacgtgccgtgtgtactgcggg

SEQ ID NO: 81827 - DNA, 30 bp, Homo sapiens
  chr18:38952391-38952421
  hypo
atagccttgactcatcgcacaggcttctta

SEQ ID NO: 81828 - DNA, 113 bp, Homo sapiens
  chr18:3930496-3930609
  hypo
gcccctgagattgtgcggatctgagcgtgtcctgcaataggaagggtgccgggtcccagcctgaaggtacatgtactcagtcgctaccctggacgccacggcctgtgactgtg

SEQ ID NO: 81829 - DNA, 30 bp, Homo sapiens; identical to SEQ ID NO: 36978
  chr18:40857392-40857422
  hyper

SEQ ID NO: 81830 - DNA, 83 bp, Homo sapiens
  chr18:42259738-42259821
  hyper
acagctcagcaaaagcgccctcgccctccgcgcgccgcctcctgcgagcccaaacccaccaacattttttaacgctccaaccc

SEQ ID NO: 81831 - DNA, 142 bp, Homo sapiens
  chr18:42259941-42260083
  hyper
tttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttccccct

SEQ ID NO: 81832 - DNA, 30 bp, Homo sapiens; identical to SEQ ID NO: 45372
  chr18:43254053-43254083
  hypo

SEQ ID NO: 81833 - DNA, 15 bp, Homo sapiens
  chr18:43325220-43325235
  hypo
cgactgtaggttgtt

SEQ ID NO: 81834 - DNA, 30 bp, Homo sapiens
  chr18:4334251-4334281
  hypo
caaacaaaaaaacaacgctcacctcagtct

SEQ ID NO: 81835 - DNA, 45 bp, Homo sapiens
  chr18:43545729-43545774
  hypo
tataaatagggtgggcgcggtggctcacgcctgtaatccgggcac

SEQ ID NO: 81836 - DNA, 30 bp, Homo sapiens
  chr18:43651623-43651653
  hyper
ctgctgctgtcaacccggtaaagctcacaa

SEQ ID NO: 81837 - DNA, 172 bp, Homo sapiens
  chr18:43651956-43652128
  hyper
gtggggctggggccccgatcccttcacgcgcgagctccgccaagcccccgggcgcgcggtcaccgagtggcgccggagctggggagccccccacgcccgccgcgttggcctcccgcccgggccgggtcctgagccccgcgatccgctgtcggccccacgacttacccaaaag

SEQ ID NO: 81838 - DNA, 20 bp, Homo sapiens
  chr18:43779297-43779317
  hypo
tgagatggaatctctcgctg

SEQ ID NO: 81839 - DNA, 388 bp, Homo sapiens
  chr18:43913367-43913755
  hyper
agcctggggagtgtgcgtgtcttacctgtgtctgcatcgtgtgttccctctgtgtgtctctgagaatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcagggacctcagggtcgtgtgcactaagggcgctcgtgcccgtctctctgcactaaggaacgcacctccacatgtctgagtgcacgtccctctccatgtgtgcacgttccgtgttcacgccgcccatgtctgtgcaggggc

SEQ ID NO: 81840 - DNA, 71 bp, Homo sapiens; identical to SEQ ID NO: 36980
  chr18:43914155-43914226
  hyper

SEQ ID NO: 81841 - DNA, 381 bp, Homo sapiens
  chr18:43914227-43914608
  hyper
aggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtat

SEQ ID NO: 81842 - DNA, 403 bp, Homo sapiens
  chr18:43914882-43915285
  hyper
atcccatccttttttcgtctttaaccctttttgtgcatcgcccttgtgctattgccctgctcaccccgccccccgcaactgtctttgtatgacagttgcatacacgggttcaagatgcttgggcgcgtgtgtgtgtgtgtgtgtgtgtctgtatgtgtgtgtgcatgtgtgcgagtgtgcgcgcgcgcctcggagagtcagacctgcgctgctgtgccctccttgggtccggctggagcggggcgtccggcccttgggtgttgtgctgtgtgtgaggatgaggtgggaagctgcccccacgccaggcctttgccccgggcagcggttgacaaagcagcgggccggcgcgggctttgtttttaactgtgataaatggggtgtgtttgcacggtcccctttcccc

SEQ ID NO: 81843 - DNA, 186 bp, Homo sapiens
  chr18:4398414-4398600
  hypo
ttacattacagttagcggatatgctatggacataccaactgaaattacacatgcttggtcctgcttgatcctggacaaattgtttaccaactctcagtgtagcagacccgcagtgtctattaacttaatagctattacagaaaatgttttgaaactgatggaagatgattgcgggggatggacgtt

SEQ ID NO: 81844 - DNA, 30 bp, Homo sapiens
  chr18:44032745-44032775
  hypo
ctagggtgcattggtcgagagcactcttag

SEQ ID NO: 81845 - DNA, 121 bp, Homo sapiens
  chr18:44140380-44140501
  hypo
gtgaggtccacctcccgcaccaccaggtgccgcagccacacggtgtccacgaaccagctgggcccaaagccctcgcccgtgtgcccgagccggagcttatagacctcgcccacgtcggccg

SEQ ID NO: 81846 - DNA, 40 bp, Homo sapiens
  chr18:44260010-44260050
  hypo
gcagctgcaggtgcccgtgtgcacgcggaggatgcctcgg

SEQ ID NO: 81847 - DNA, 348 bp, Homo sapiens
  chr18:44336102-44336450
  hyper
cttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggc

SEQ ID NO: 81848 - DNA, 126 bp, Homo sapiens
  chr18:44337012-44337138
  hyper
cgatagggacggggggagggggcgtacaaaacacccgcgcagtctggctaatgataggcgggccgtggggagggggaggggcggagcgcaaaacgccgggtttgaatcttggaattaaaaagaggg

SEQ ID NO: 81849 - DNA, 180 bp, Homo sapiens
  chr18:44337438-44337618
  hyper
aaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaagga

SEQ ID NO: 81850 - DNA, 193 bp, Homo sapiens; identical to SEQ ID NO: 1335
  chr18:44337649-44337842
  hyper

SEQ ID NO: 81851 - DNA, 15 bp, Homo sapiens
  chr18:44338098-44338113
  hyper
cggttggaagattct

SEQ ID NO: 81852 - DNA, 30 bp, Homo sapiens
  chr18:44448392-44448422
  hypo
ccttcccgcctttgccgcaccctgacatgc

SEQ ID NO: 81853 - DNA, 190 bp, Homo sapiens
  chr18:4453666-4453856
  hyper
tatcctcaccttctacgaagccattcacgaagaccacaaaagctaaaagatctgtctttaattggtacttttattatatgtctttcctcgtaattccctaacttcacgtgttatggaaggaggcagggagcattcacctcccacgaccgggagtcagtctctgtgtcaggagtaaggagtgaagagtctc

SEQ ID NO: 81854 - DNA, 788 bp, Homo sapiens
  chr18:4453857-4454645
  hyper
cctggatccacaaaagacgtgacatctcccacccagcgtcccactgcttgccgcctggctacctttaaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaagtgcaatgtgttatctcgcccagcccagaggagaggtccctgtttggccttggttccagcccggctcattcaattcgctgaatgtcgggtctcccggcccgccccgcgattctccgggaattggccttggccgcgggcagggggcgactctccagtgacctcctccttggaccccatttctctctctctctctctctctgtgcctgtctttgtgtctctgtttctttggctttctcttacaaacgcacgggggagttggtccttttccacaatgccaaaatgtcacccaaaaagctagtgcaacaacttgctttgcaaacgacccaggagcctgccgagaaagccctgcggggagcagccccctcctcccctgcaaggtgcatcgggggtggggtgggggtgcgaatttgaccggtg

SEQ ID NO: 81855 - DNA, 14 bp, Homo sapiens
  chr18:4455258-4455272
  hyper
cggaggctgagcgc

SEQ ID NO: 81856 - DNA, 30 bp, Homo sapiens
  chr18:4455651-4455681
  hyper
ccattggttcccttgcgcagcatctgtgga

SEQ ID NO: 81857 - DNA, 30 bp, Homo sapiens
  chr18:4455910-4455940
  hyper
catgttcgtccccagcgccactactttcaa

SEQ ID NO: 81858 - DNA, 52 bp, Homo sapiens
  chr18:44772704-44772756
  hyper
tataagagggaaaggcggccccaaagcctttgaaaggcgttatcaagaaagg

SEQ ID NO: 81859 - DNA, 140 bp, Homo sapiens; identical to SEQ ID NO: 1336
  chr18:44772977-44773117
  hyper

SEQ ID NO: 81860 - DNA, 501 bp, Homo sapiens; identical to SEQ ID NO: 1337
  chr18:44773466-44773967
  hyper

SEQ ID NO: 81861 - DNA, 510 bp, Homo sapiens
  chr18:44774201-44774711
  hyper
ggacaagccggccttgggcgccgcgcccgcgccgcctgcgcccgcgccccccagggcctcagcggcggcacccgcatcctctttcttatggcacaagctgaaggcggcggccgcggcagggaaggtgtaggggtgcgggaagagcccgccgcagcccgggaacttctgcaggacgcccccgaacgagcccttgctgggcaccgggatgactgggtagctgcgcgggcctttggcccctgccccggcacccgcccccgcgcccgcgcccacgcccacgccggccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccgcttgtgatgggcgtgcggggcaccagccagctctgccaagggcggcggtggcggcggcggcggcgggggcgcacccag

SEQ ID NO: 81862 - DNA, 205 bp, Homo sapiens
  chr18:44775385-44775590
  hyper
cgatcaccaacgacacgatgggaatgccgtagaggatcacctggcccacctggttgggtttgaggttggcgtgccctggccgcggctggctcagcgtgtcgggctggaaggcgctcgacggcgacgccagcaggatgtcgttgggccctggcagcggactggaagccatctccgccgcagaaccccgggccgagccctacaggtc

SEQ ID NO: 81863 - DNA, 549 bp, Homo sapiens
  chr18:44776834-44777383
  hyper
cagctacatctcaagcgcattggccaaggcatgctttgccctgaaaaatcaccagaggccatagcgtggcccctttcggccacgtacagcgagttcgctattacagtgctttcagagggtacacgatcttactccctcacccaatttcttatccgtgtcctctctctgggcccctgtggcatctatacagcagcctctgtcctgctgccccctggatcctcagttctcattacatttggcggcctccaggaagcttgaacaaacctcgacgcgatcaaaggagaggaaagcctgcttgtcactttgggtggatcagagacaatatttccaggggacagggcgttacatggcagttcaaggcgcagtgacacccgagtctgatacaaccaacactagcttcgtcaggtggcccttcgatgctcatttccctaccaaacaagattcatatccgcttaataagaccctgggataattccaactctcgctccccagcaaggcgcgcggctggccagccggggcgggaagctggctctgcgttaaggactcgca

SEQ ID NO: 81864 - DNA, 196 bp, Homo sapiens; identical to SEQ ID NO: 36993
  chr18:44777596-44777792
  hyper

SEQ ID NO: 81865 - DNA, 464 bp, Homo sapiens; identical to SEQ ID NO: 36994
  chr18:44777862-44778326
  hyper

SEQ ID NO: 81866 - DNA, 622 bp, Homo sapiens
  chr18:44780619-44781241
  hyper
ggctcagggaggagtcgacggtggcgagaggaggctggtcgagcccgagttaatcaatgctttcctcttcgagctgacatgcattttacacgtcaggactctcctcagccggctaattgattcaaattgttttattggttaaactggtgtcacccattttcatgatctatcaccacatggaggagagcatttccactcccatctccgttccgggcggctgcggttcacccaggccaaggacaggtaaaggagcccagacgcgggacccagaggaaaaccacaaaccgagctggcctcctcataactggagaggcgacgtctggaagtaagaggaggaggccggcacagcagcgcatatgggcttccagctacaaatttaaactggttgaagagaacccacgctcagccgggcctgggcccagtttcctccacctgggacacagtcggtttccgagccggcgttgaactccgcggtataggaggccacaacaaaacccgggtgggaactgtccgcggtgctgacgagatgcatcgttccaaagcacagcgaatcctactgtgttcaagtcgggaagaagcctcccagcatgtaattgagccctagattcggctctgggcgggc

SEQ ID NO: 81867 - DNA, 294 bp, Homo sapiens
  chr18:44786853-44787147
  hyper
ttcacctgccaggaccgggaagttactaggctcgcccgcgggagtcgctgtccgagcttggcagtgctgaaaccgccggcgtgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaattaattgccttaatcaaatcgacccaccttctgc

SEQ ID NO: 81868 - DNA, 359 bp, Homo sapiens
  chr18:44787492-44787851
  hyper
gctccacggctcctccgcgctctgcctcccgcggcgcctgccgcctcccctgcgcggatcagccgccgccgcccgccgcccgccgtcctctgcgttcctgctcgcgatccggcccttcgccgcgaccctgtcctgtcccacccctccccttctcggcggttcctgcagcggctcagctcttcctactctcctcctgggcaagtttgtaagtttagggtgagggtcggtctctcctcgcgccctgcttctcggcttagcttgctcagatccgcacccccccactccccacctcagacctctctgacgccgcctgttggtcaggcagggcagggcgaggagcgcagcgccagccccagccc

SEQ ID NO: 81869 - DNA, 30 bp, Homo sapiens; identical to SEQ ID NO: 36998
  chr18:44788251-44788281
  hyper

SEQ ID NO: 81870 - DNA, 641 bp, Homo sapiens
  chr18:44789474-44790115
  hyper
aagaaatggagacagcgttgcagagcgaatcactcatggtctttccatttcataatcgagggagacagcgcaagcaggtcagactcgaccggttcgcttcctcccacccctaacttggcgggatctgagaagaaagttcccgcatgtttgagcgtcctagggcttggataggacagacctcgtaggtccccaagctccagcttggagttcccaaggagaagggaagcgctagtgctatggagcgaggttttggtgaagaaaagggcctcgcgcccccttagtgccgtcgctctggggaatcttctttcgctgggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgctacggcttcatcccggagctcctgctcggggttgccggctgcctctgctggcgtccctcttcccttcctttgcgtaagcggcaactcctccaggaagccaggggaaggacgggatttcctctccacgtagggtagtagatcgcatagcccagc

SEQ ID NO: 81871 - DNA, 29 bp, Homo sapiens
  chr18:44790144-44790173
  hyper
cgtcggggtgtctccggcttgtgggtgtg

SEQ ID NO: 81872 - DNA, 380 bp, Homo sapiens
  chr18:44790571-44790951
  hyper
cgctggcctcctcctcgggcgactgggccctgaggcaacagcgccttctcgagccccgaggattgaccgccccgagcctgcttggagcagggcctctctccagcgcggtgtgatgaaagtaagaaaatcgggcccctgccccaggcaataggggaggcctaaaatgaagggggcagcgatggggtcggaaatgcgtgcaagttgagagtctcgcagggaactcatctcttgctcagggtttccgtgtttggaatccagttagatgtctgcgggggatctccaaggctctcattccatgaaggcatttttatccactctgggggagatgttgccagggcagacatttcggaaaggtccctcgggcccgatgttaattacaa

SEQ ID NO: 81873 - DNA, 30 bp, Homo sapiens
  chr18:44852515-44852545
  hypo
taattattcagagcccgccatctattgtat

SEQ ID NO: 81874 - DNA, 193 bp, Homo sapiens
  chr18:44977278-44977471
  hypo
ttcacgttctgtcagcgattctaagggttacctatctgctcactgacagccacattatccttattcacacacacacatgcacacacacacacacacacacacaggcaggcagatgcacatgaatctgcgtttgcaacacacatgcactgatacatacataaggcttgcaaatattgcccgtaaaatcaacaca

SEQ ID NO: 81875 - DNA, 217 bp, Homo sapiens; identical to SEQ ID NO: 37001
  chr18:45058076-45058293
  hyper

SEQ ID NO: 81876 - DNA, 140 bp, Homo sapiens; identical to SEQ ID NO: 37002
  chr18:45058307-45058447
  hyper

SEQ ID NO: 81877 - DNA, 30 bp, Homo sapiens
  chr18:45120847-45120877
  hyper
atagacggcggagcccgcagtaattcaatc

SEQ ID NO: 81878 - DNA, 182 bp, Homo sapiens
  chr18:45275551-45275733
  hyper
cctcctaacagagaacggcgctcggagccgggaacgcagctgccgccgcccagccctgagccccgcgcttcgcgcccgcggccctgagctctgctgacccctggcggccgccgcgcgccgcgccgtctggactgcgaagggcagccgcgcgaaacccgacgctctggcgccccctggtgtcc

SEQ ID NO: 81879 - DNA, 41 bp, Homo sapiens
  chr18:45534935-45534976
  hyper
cgggacctcctcctccgccgccggcccgcccgcgtctacac

SEQ ID NO: 81880 - DNA, 115 bp, Homo sapiens
  chr18:45662236-45662351
  hyper
agccgaccaataagtcgctggagtggggcttccttctgcgcgaagctgggtaccagctattaaaagaaagaaggcagccgcccgctgcccacccgcctgccggcacagacacagc

SEQ ID NO: 81881 - DNA, 496 bp, Homo sapiens
  chr18:45662583-45663079
  hyper
ccgcgggagtggggacgcacggggtcagtccttttgcgccacccacaccgggccgtctccggagctgagagactatagctcgactcgcctgctcgggtgggagtgctccccatccactcacccccaggttggagtccagggaagagccccccacccacccagctcagcgcgcgatttgagcccagggacctgacagggctcccgccgcgcgcctagctggacttctgccaatcgctcctttaatttctgcccgtatcgccggccctcgacttttgccaagttgccatggcttttgtcccccctccctcccgtccccaagttttgcatctgactctcaggaggaccaagcattcttgggggagacaatttaaactaccaaggtacacccgcaactccctctcggagtgcccttacgttccttcggctggcccctcgccccaaaggagcccgctggcgtgggccggcggcaatggggcagtggcgagagttgctctct

SEQ ID NO: 81882 - DNA, 267 bp, Homo sapiens
  chr18:45663337-45663604
  hyper
atcctagcccagaggcgggccgaggccgccgcagacccacctggccgccccggggacgccgcgctcgtgcccgggccgtgtcctgagcgccgccagggtcccgggctgggaatccacgcggccgcgctgctcgcgggagcctgccgcagccggcgggaggttgtcattgattcgtgctgggcgagttaagccattccaggagtggttttgagagagcactccctccccaccctccaaccagaagtatttggccgggagcccctttgg

SEQ ID NO: 81883 - DNA, 37 bp, Homo sapiens
  chr18:45934773-45934810
  hyper
gacctcgcactaccccgcgcggcgacaggcaccgggc

SEQ ID NO: 81884 - DNA, 165 bp, Homo sapiens
  chr18:45935031-45935196
  hyper
aaagtcccaggaaaacgtcactcaccaaaacgctcccgcgccttccaggcagaagtgcggtaaaacttttggcagaaaccacctgtggctgccgacgggcccgccccgctcgggcccgcaggcgccgccgagccccgggccgcacgcgcccgcagaagttccttt

SEQ ID NO: 81885 - DNA, 30 bp, Homo sapiens
  chr18:45937081-45937111
  hyper
agacataggaaccctcgccctccttggtag

SEQ ID NO: 81886 - DNA, 213 bp, Homo sapiens
  chr18:46142398-46142611
  hypo
cagccctgagacactcgggcatgtttgggagagccccgcagagccggccagaggctgctgctgcaggcagagcctggcactcaatcctcctggaaacggctccgtgtagagttcctgcaaaacccggttctccgactgcacctgttaggtgtgccagggagcccttgataagatctgacgtcttccaggaataatgggcgtggccttgtgtat

SEQ ID NO: 81887 - DNA, 24 bp, Homo sapiens
  chr18:46713260-46713284
  hypo
tcatatattcactgccggtacaca

SEQ ID NO: 81888 - DNA, 82 bp, Homo sapiens
  chr18:47012303-47012385
  hypo
caaggtgtgatggcacgcgcctgtagtcccaggtatttggggagctgaggaaggagagaaccgcttgcgcccaggaaagccg

SEQ ID NO: 81889 - DNA, 86 bp, Homo sapiens
  chr18:47019807-47019893
  hypo
ctttgtcttctcctccgggttcctcttttatgttgcatggtgacaagagtaacagacaatgggccgggcgcggtggctcacgcctg

SEQ ID NO: 81890 - DNA, 557 bp, Homo sapiens
  chr18:47087147-47087704
  hyper
ctagggaggaaggggcgcgggactgctgtgggggttttccctccccaggcaggggcaggacctgttccgggcgactgcagggttaagggtatcgtcttaaagagccggatcctcccggctggagcgaggctggatggcgggacgcagcctctcagcctctcgtacccgccctgcgtccgcagtggttgttggcgcagccgccccgtcggtgttccgggctcagtccccgctccccagcgccagacgcagactccgggccaagttctccctccgctcgctgctttctgccgcaggacccggatcaataaagggaaggagagccgggaggaaatgatggagaacagagagaaaggagatgcttgatttcactcgccaaggagtgagtgctcatcggcagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagtt

SEQ ID NO: 81891 - DNA, 441 bp, Homo sapiens
  chr18:47088061-47088502
  hyper
tccttctccagggatcgcctccccagcggacgcagagtttcagggaaatgtccgcctccgccacttgggatggcagtggggagaggaggatctgggtgtccggaggagggcagtgggagaaagctggagctgctggagtcgcagctgcctgcggagcgggcccgggaggaagcggggccgagcgtgcggcgtccacgcggtgagtgtgcagcgctttcattcaaactttctccagtctcggttccggcgtcagcaaggtgtgaccaatcagagcccagagacgggaataaattatgcaaatcaccatctggcgatgggtcagatgactcccatacttttaaaaactacctctataggagcgtgacagcagcgagtccttgcctcccggcggctcaggacgagggcagatctcgttctggggcaagccgttgacactcgctc

SEQ ID NO: 81892 - DNA, 152 bp, Homo sapiens
  chr18:47339606-47339758
  hyper
aacaggaaattgcaccgaaatcgctgtcgctagcgccttacaagtaagggttttctccttaacccaaacaagcctttcgggctgggtttttatcacgtccgctccaaaaccgaggaggttgagtgaacttcaccccacgaccccgactctcc

SEQ ID NO: 81893 - DNA, 81 bp, Homo sapiens; identical to SEQ ID NO: 45374
  chr18:47344091-47344172
  hypo

SEQ ID NO: 81894 - DNA, 136 bp, Homo sapiens
  chr18:47720183-47720319
  hyper
ctccaggttgaaactcgaggggtcccgggcggctgcagcgctgccgcgagctcccctggaagcggtggcttgtccctaactttaaccacagcaactgctgcggaacgcgggcgtctccgcccgggctgcacctgtt

SEQ ID NO: 81895 - DNA, 107 bp, Homo sapiens
  chr18:47720801-47720908
  hyper
gccgttcggggaactcggttggagccgagcccaggcaacgaaagtgaggggcgcggcggggagggggcgacagccctggcttggtgctgagccgtggcgctgcggaa

SEQ ID NO: 81896 - DNA, 449 bp, Homo sapiens
  chr18:47792530-47792979
  hyper
gggtagataggtgagcgaccttatcttccttctttcaaaattcaacccactgcatcaggcgacacccgttcccctcgagaaggccccgggtgggggccgaagtgggataggccaggcctggagtgcggagagatggagaaagctgtagggtctggcagacatatcctgtgcttaccacgatcaccactttgggggtggggcccttaacctcccgctgtacggtgccaaaccgctggctgtacattttcgagtccccttcgggacgggggcggcgtccgccgcgtttcccccaaccgtggcgacctgcgggacccgcttccgcgacgcagaagtctggttgccatggtgcgcctcgcgggattaggggccggtagaggtgggcgggtcgggcggaagtcggtctggtcaccatgggggccgcagacgcctgcactcgggacttcctcttc

SEQ ID NO: 81897 - DNA, 193 bp, Homo sapiens
  chr18:48320158-48320351
  hypo
tctctcctcttccagcggctggttatatctgctgatgcagtcaggcaggcaggttgaaaagctttggatttctgattgcatttttgctgtggcagaggcatgtgcctctagcagtgtcgcttaggaaatgacatttttaactctctgatccgcatttctgaaaaacatttccttcttgcgggagacatttggg

SEQ ID NO: 81898 - DNA, 215 bp, Homo sapiens
  chr18:48493710-48493925
  hypo
gagccacggcgcccggccagctgctggatattttgaccacctcaagtacgctgagcacgaaatcagtgcatctggcagtacacaggagcttgaaatactttttttaaaagttgttattcaaactgaaggagtttttccctgtggtctgtaatcgccacgtgcccgttctgtatacagccagcctgggtttttcaatcccacgtccgctacctaag

SEQ ID NO: 81899 - DNA, 216 bp, Homo sapiens
  chr18:49866847-49867063
  hyper
tcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggc

SEQ ID NO: 81900 - DNA, 276 bp, Homo sapiens
  chr18:49867123-49867399
  hyper
cgcgacccctggccccgaaggtgttggctgaaatatggagaatagtcttagatgtgtttgggtacccaagctggcttttgtactcttcggagcttccttgttcagcgcgcatcttcaagtaaccggtaagtggctctttcctttcttctcgtcgcacccccttccgtaccccacttcccttctcatttcatttggcgagtagtagaattggggtgggggatagcaagagatttggcgcttgcgctgcccccatttgcgcaccgatgataaaagata

SEQ ID NO: 81901 - DNA, 57 bp, Homo sapiens
  chr18:49868299-49868356
  hyper
ggctcaggcagagaccgggcgttgagtaggagctccccagttcgtgcctgggaaatt

SEQ ID NO: 81902 - DNA, 96 bp, Homo sapiens
  chr18:49868671-49868767
  hyper
cacgcgcgctgtcctgtgatgagcgcgtacccgcatccccgcgcttagccgctggtgctccctccctccgtctgtccctcccgggccggtcccctc

SEQ ID NO: 81903 - DNA, 81 bp, Homo sapiens
  chr18:49945126-49945207
  hypo
aatatcctaggatgacgacaatgttgtatgtagtaatcctgttattatctagtgaaaaacagtatccgagatcctttttct

SEQ ID NO: 81904 - DNA, 30 bp, Homo sapiens
  chr18:499528-499558
  hyper
tggaagcggggtgaccgcggtcagatggca

SEQ ID NO: 81905 - DNA, 1248 bp, Homo sapiens
  chr18:500042-501290
  hyper
cccggagaaaacacccggccgccagcgcggggaccgctcgggccgggaaacggctagaggcgggaggagagaggactgggcgagcgtggggagcgctgcggcgtggaaaagcgaccgggagggatggcgatgcctccactctcctcggcaggttttttcaattaaaaagttggaaacgggaatccgtaaacaacgacttagggcttcaaactacttgcaaagacgcgatggggaggggaatacttgcgcgcttcaaaaccccaacctcgaggtctccagccgcgcctgacccgggagccgggtgcgcccccagtgtccgcgcacgaacccggcgccctggcagccccgactccccgggcccgcagcccaagggaaggttcgcgcgggaggcacctccgtggcctcccgcgcgccccgaagcccgttccccccgcccagagccccgcggagctgccgccgccctacctttcatggtgaccgtggggacgcaccgccggccggggagctccgcgcgagcgccgcgcagccgaggaagtcgtcccgagcggctgctcaccgcacgcccatggtagccgcgccgcgcgccggccgtctgcgcccccgtcctccctcgccgccgccggcccgcgctccccgcgctcccggctccgcgctctgctgcctcggggctgccgcgcgcgccgctctcgctctcccagcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattagacactctctctgcgctcttggacacct

SEQ ID NO: 81906 - DNA, 19 bp, Homo sapiens
  chr18:50382419-50382438
  hypo
ccaccgcgccccgccatta

SEQ ID NO: 81907 - DNA, 120 bp, Homo sapiens
  chr18:51209753-51209873
  hypo
ctcccaagtagcagggactacaggaaacaaaatttttaaaacacagtgtgaggctaagctactcagttacattgtcacagtcaggaaaatttttcttttcttttttttttttttttttga

SEQ ID NO: 81908 - DNA, 219 bp, Homo sapiens
  chr18:5133145-5133364
  hypo
gcgggttgatggggccgccctcccgcctaagcctggccagctccaccaccaccgaccacgatggctgcgccccgggccgcgaggaagatggaacacagcttcttctccaggaccgagagcccagaatgtgtagaggggcagagggggcagaggatgagctggaagagggtcccaaggaggcagcggcagaggtgatggtggtggcggccagctctgaga

SEQ ID NO: 81909 - DNA, 31 bp, Homo sapiens
  chr18:5196228-5196259
  hyper
tacccctagagacagcgtcggacgttcacaa

SEQ ID NO: 81910 - DNA, 697 bp, Homo sapiens
  chr18:5196575-5197272
  hyper
cgcctccttctcctcgggaggccaggaggacccgggtcactttgccaattctgcggagggggaagtagcagtgagggagattcccacgcaagtagcccgaagcccactactctttgccccacctctccactctcttgcccgtgtaggtgccggtgctgctggcgaaagtcccagttcttaaggctcctgagctcggaaggggtgtggaggagccagatgggaagagaagcagcgggacgagggcgaggaagggctggagattgttagaggacagatggggcgggactggggagaggggcgaaggcgacgcgccgaggcactcctccgccccatgagcacagacagtaactccgaaacgcgcagatgggccgtaaggtaaagaggccttttttccctctcctctccgtcctctaccctgctcccctcctagacacttggtgaaaaagcaaggtgcggtgtacctggagcgaacaccatgatttcttccagccgctacgcccccagattaagagagaaagacaggcagacggaggatgggaagaaggccggacttggcggggtccggtgcaggagggcgcgctgggcgggcggcgggcggggcggtcagcaccccggacagctcccgccgctagatcctggggccgcagctccagccgccgccgcgcgctctgcctccacaatgcggccacagcggcgg

SEQ ID NO: 81911 - DNA, 430 bp, Homo sapiens; identical to SEQ ID NO: 12959
  chr18:5197329-5197759
  hyper

SEQ ID NO: 81912 - DNA, 24 bp, Homo sapiens
  chr18:5233199-5233223
  hypo
cgctaaggccgagagagcaaaagt

SEQ ID NO: 81913 - DNA, 127 bp, Homo sapiens
  chr18:52495893-52496020
  hyper
tgacacctgctctcccggcaaggaaacttcgcaggctggtgagttgggaaggcgggctgctgctgctggaacgcgttcccacccacccgggtgctgcagcgccggcctgcgccgtgggaagtgaggc

SEQ ID NO: 81914 - DNA, 92 bp, Homo sapiens
  chr18:52627015-52627107
  hypo
gatagtagagagagtcgtctatatacccctcagtcggtgtctcctaatgcctacagcttccataactgtggcacatttgtcaaaactaagaa

SEQ ID NO: 81915 - DNA, 30 bp, Homo sapiens
  chr18:52946077-52946107
  hypo
gtgagccaccgcactcggccacatcttggt

SEQ ID NO: 81916 - DNA, 81 bp, Homo sapiens
  chr18:52961504-52961585
  hypo
aaaagaaaaagaaagaaattcatatcttatatgaattatccaggtcgtatcccccgataaatactacggactccttaggag

SEQ ID NO: 81917 - DNA, 103 bp, Homo sapiens; identical to SEQ ID NO: 45377
  chr18:52961793-52961896
  hypo

SEQ ID NO: 81918 - DNA, 235 bp, Homo sapiens
  chr18:52988920-52989155
  hyper
acatcaaagagttgccgcccatgcccgggattgtgtatgcgcagtacatggtctcggattcttttttctcctcagtaccactctaacaacttttatttcaaactcgctgtcccttttttcacaacaattccttcagttgcattttcccatatggccgggccaagcgtggtgaatatgcaaagcaggaagagaccattcctggcgggcgggggaggccgcggcgctgctgtcagac

SEQ ID NO: 81919 - DNA, 135 bp, Homo sapiens
  chr18:52989156-52989291
  hyper
ctcaactttgcgcagcggagctggaaggcagcccggccctgatggagctcgaaatcctaatgcatacgcgagatcgattcaacttttccgaggggtttttattagttcctcgaataatgccgattcttacaaatt

SEQ ID NO: 81920 - DNA, 212 bp, Homo sapiens
  chr18:52989741-52989953
  hyper
caacaacctacaaaacggggttgcggaatgaaacagagtagcagtgcggcccgccccgggctccgcgggccccggcctccccggagctggtgggaagcgcggccgcccatgaacttcacctcgccccgccgcagacagccgcatgggcccagagcctacggaggggctggggcgctgctcccctcgctggcgctgggcgccccaagggcgca

SEQ ID NO: 81921 - DNA, 180 bp, Homo sapiens; identical to SEQ ID NO: 45378
  chr18:53074296-53074476
  hypo

SEQ ID NO: 81922 - DNA, 82 bp, Homo sapiens
  chr18:53233489-53233571
  hypo
gacatggatgtagtctatcagtgggcagagagacaacggagatccggaaaggtagaggggcaggaggcgggtggctaagaaa

SEQ ID NO: 81923 - DNA, 1403 bp, Homo sapiens
  chr18:53254614-53256017
  hyper
tatttccaaagagacgatcaaactggtaacatccactataaaaccaaatcagggaaagaaaaaaaaaaagccgctcttcagcgcatcattttatgcaacaggaggtagagcgagaaatgaatggatcacagagaaaagagaaactactgagaacgatccgatctcaactttccccccaccctgcaccccacccccctcgcacactcacactcgcacacgcacacacactcgcacacaccactcccctccgcttttcaaagtagctatcaagaaattaaagatgagcgtctctggagtgaaaacacgtccaaagggggaggggtggggtgacagggttggggggagcggagtggagggtcgggtcctctaattgtccagcaccctaatttgtgaaagaaaggggttataaaaattaaagtcaggcccctggcaaagtcctcggtccctccgagggggcatcaaggggaggggcgggggggctggcggcgagggggagggaagcggcgggaggggaaggggtgtctcttctgggagcgccgggcgccgggagcccgcggcgcgggaggcgcggagccgcgtgcggggccgccgagcccgaaccccgcgccgccgggcgcctccgccccgccgagccccgcaggcgccggtacctaccgcccgcgcgcgagaaggggctctccgtgcaccgccggcgccgaggcggcgttcatgtctaaccgccgccgccaccgccgccgcctgctcctgcgcccgctcccgcgcctgctgcctccccgccgccgccgccgccgccgccactacagatccgcagacacacagccaagatccctgactcttaacaccaactctcttctccggggaggggaggggacggagggaaggggggagggggaaacacgccgaggcgcacggaattgcaagttcagcaaagaaatgggtgggggggctccggcggggagacgcgacttgctccgggtcgggcaggctaggatgcatccccctcgcacccaccccgaggggaaaaaaaaaaaatctcaacacctcccccgcctcgccaaaaaatacaaacgaaaattcatcgagcacctcatttttcctcagatcgtcagttacaatctgaagcctgaacagttcagtttttgcccgttgcatccctcggaggcactttgaaatttattcgagtttacatcccctcacttctttctttctcttactctcgttccctctcactcacacatccacacacggcaaagcaagtttatactaggctgcaaatacacgtgatgcaaaaagactttgccaagaggaacaatatttttctttttcgtctataaatcaagccacattttcctggggagattttcgtttcggtagttttgcgttgggggcgaaatctgaattgc

SEQ ID NO: 81924 - DNA, 380 bp, Homo sapiens; identical to SEQ ID NO: 37017
  chr18:53256942-53257322
  hyper

SEQ ID NO: 81925 - DNA, 648 bp, Homo sapiens
  chr18:53446827-53447475
  hyper
ccccacactcttcttcgctggcacattcactgatgtagaaaatgccaggagccccgggggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggc

SEQ ID NO: 81926 - DNA, 112 bp, Homo sapiens
  chr18:53447798-53447910
  hyper
cgccggctactcagctggccccgcagcttccctgcggctcagcggcctcccacccaggagaaaaccacatttgatgagagttttgaatcaagccgagcgttcccccagatgt

SEQ ID NO: 81927 - DNA, 36 bp, Homo sapiens
  chr18:53960321-53960357
  hypo
ggagcattgtgcctaactctgcggtaaaagagaagc

SEQ ID NO: 81928 - DNA, 202 bp, Homo sapiens
  chr18:53968903-53969105
  hypo
cctacttcattagttcgttgtggggatgaaataagacaatatatgtaaatcactctaaacagcgattggtatgtagcaactactcagcatgcattagctattatgaggtagcgtgcttagcacagtacctgggacaaaataagagctcaatgaacaatagtatgatcgtgctgatgctgacggtgtacgtggttttgacaaa

SEQ ID NO: 81929 - DNA, 50 bp, Homo sapiens
  chr18:53989683-53989733
  hypo
acacagcagtgtgttcgattcccactcctctcaaacgcaaattgtggaac

SEQ ID NO: 81930 - DNA, 30 bp, Homo sapiens
  chr18:53989950-53989980
  hypo
ttctaactttagaaccgcactctaaacttt

SEQ ID NO: 81931 - DNA, 47 bp, Homo sapiens; identical to SEQ ID NO: 45380
  chr18:54483265-54483312
  hypo

SEQ ID NO: 81932 - DNA, 275 bp, Homo sapiens
  chr18:54789012-54789287
  hyper
gccccccacttccagcgcttctgggagtgcatgtgcgttgctgagcgtggcctgagcccggtcagcggccgggcgccggtggcagcccccggtcccgcggcgaccccggcccaggaaggagcccggtagggggtgcgctttccctggcctcccgaggcgggatcggggccgggctccactcggtgagaggatcctgccagccagctgggtgaaagacccacagaaatcccgaactggctgcaagatgcattggtagctggcgcctttagtcgggt

SEQ ID NO: 81933 - DNA, 123 bp, Homo sapiens; identical to SEQ ID NO: 37021
  chr18:55019653-55019776
  hyper

SEQ ID NO: 81934 - DNA, 260 bp, Homo sapiens; identical to SEQ ID NO: 37022
  chr18:55020439-55020699
  hyper

SEQ ID NO: 81935 - DNA, 141 bp, Homo sapiens; identical to SEQ ID NO: 4552
  chr18:55020804-55020945
  hyper

SEQ ID NO: 81936 - DNA, 465 bp, Homo sapiens
  chr18:55020965-55021430
  hyper
cgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccctttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccattttatggtctctccggcacccggagggatggacaa

SEQ ID NO: 81937 - DNA, 42 bp, Homo sapiens
  chr18:55101949-55101991
  hyper
tgcattactgctgcccgcgccgcccgtgggccgccggccggc

SEQ ID NO: 81938 - DNA, 59 bp, Homo sapiens
  chr18:55102007-55102066
  hyper
cgagggcactacagttgctctgaccgcgtagattatgcatgtcccggcctcgggaattt

SEQ ID NO: 81939 - DNA, 77 bp, Homo sapiens
  chr18:55103337-55103414
  hyper
catgagcatgtcctgcgactcgtctccgcctggcatgggcatgagcaacacctacaccacgctgacaccgctccagc

SEQ ID NO: 81940 - DNA, 30 bp, Homo sapiens
  chr18:55104062-55104092
  hyper
tccggaatccaaaaccgtggagtaaactca

SEQ ID NO: 81941 - DNA, 345 bp, Homo sapiens
  chr18:55104840-55105185
  hyper
cgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcg

SEQ ID NO: 81942 - DNA, 626 bp, Homo sapiens
  chr18:55105464-55106090
  hyper
aatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcgg

SEQ ID NO: 81943 - DNA, 108 bp, Homo sapiens
  chr18:55114536-55114644
  hyper
ggaacgctgtttgagcgaattggagatggaccctctactgcggttaaatccaggcaagagcctgaccagtatctccagctctgtaggtctcagcgccccagtgcaggg

SEQ ID NO: 81944 - DNA, 458 bp, Homo sapiens
  chr18:5542700-5543158
  hyper
ctgggctgcaactaacggaaaaaccctagaaaacttcagatccgtaatataaaaagaaaattgaaaagaatactctcattgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccc

SEQ ID NO: 81945 - DNA, 14 bp, Homo sapiens
  chr18:5543430-5543444
  hyper
gcagtgtcgccccc

SEQ ID NO: 81946 - DNA, 270 bp, Homo sapiens; identical to SEQ ID NO: 36868
  chr18:5543899-5544169
  hyper

SEQ ID NO: 81947 - DNA, 77 bp, Homo sapiens; identical to SEQ ID NO: 36869
  chr18:5544170-5544247
  hyper

SEQ ID NO: 81948 - DNA, 220 bp, Homo sapiens
  chr18:55469444-55469664
  hyper
tctgcaacatctccccgcgccccccaacaagttgcccctcctcgtgcacacagcgaggtgacagcgcagggcaccaaactgctgagggaaggagatgcctgcagccatctcagcggggctggcggacgcgacccgacagtcaccggaaaaacagtggtgtcggtcttccccatcacctcccctccccatcccacaataaagcgcacggaagatgtctggg

SEQ ID NO: 81949 - DNA, 30 bp, Homo sapiens
  chr18:55470924-55470954
  hyper
agcctggaaagctggcggggccgcggcgcg

SEQ ID NO: 81950 - DNA, 30 bp, Homo sapiens
  chr18:5561844-5561874
  hypo
atatgacagagggcacgttaccactgtaga

SEQ ID NO: 81951 - DNA, 164 bp, Homo sapiens
  chr18:55850823-55850987
  hypo
catgttgcatcttaccgagttgattgagtattcacttcgaagctccatgctgcacgcatgggcctgtaaatagctttttcgtgcacttgtgggtgtcatttcagatcgcttcatcggatttcagttacccaagtttttacttggttcaccgtaagtttgcaaaa

SEQ ID NO: 81952 - DNA, 30 bp, Homo sapiens
  chr18:55852270-55852300
  hypo
ttcatcagcaccaggcgtgcacggcgttag

SEQ ID NO: 81953 - DNA, 71 bp, Homo sapiens
  chr18:55992525-55992596
  hypo
attcctctccatttacgtaaagcatgcaagagcagtcagaacttgtatattgtaagcgattgcctttgagt

SEQ ID NO: 81954 - DNA, 30 bp, Homo sapiens
  chr18:56022817-56022847
  hypo
tactcagctgtactccgtttcctttatttg

SEQ ID NO: 81955 - DNA, 1289 bp, Homo sapiens
  chr18:5628082-5629371
  hyper
cactggagcccaccccgctcctacgccgcaaagcagcacaattacagcctgggaggggcaagtcttgcggggcccgtcggtaactgccattatttgaatgcgatataggagatcccacatagaccctgctctaccgggttagaatctgtttctaatcacgtggaatttagatttaaaccacagttagatttgggatttaccatcgtttctactttcattcatttagtggcttccagccctctcgcggcccagtcttaatccatcgcacttcagagggaattacgagggagttgcggactggcgggggcgggggtctgtaactaacaccaggtgcctgtgagagagccccaagggcgggggcagcacctcctggctgggttgggtccgcctggcctcgcctcgcctccgggatccttggcgctcagcgccgccctcccgctactgcgctacccgccagagcccggcgtcttccctttccttgtcttgtggacgccgcccttcgctcccgggaggatttcgcctccagcacctcaggcttttctggcgcaaaggtcgccagcccgagcgagcccaggcggcggcttcacttctgcagagggaaagcgaaagacgcggccggcgggccgagggggcggccgaacgcgccgcgtggttgctgctcccgaatccgcagcggcggcgccagggcggtcaccgagccctgcggaccccggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgc

SEQ ID NO: 81956 - DNA, 112 bp, Homo sapiens; identical to SEQ ID NO: 36872
  chr18:5629372-5629484
  hyper

SEQ ID NO: 81957 - DNA, 257 bp, Homo sapiens; identical to SEQ ID NO: 36873
  chr18:5629569-5629826
  hyper

SEQ ID NO: 81958 - DNA, 531 bp, Homo sapiens
  chr18:5630124-5630655
  hyper
cgcaagccctctgtccccctcaaagcacctctctgctcgtccctagtctccaggtgcccgtctgagagtccctgtcgcctccgggcggacccggccaggcagcccccggtcgggccagcctcgccccttcctcgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcggg

SEQ ID NO: 81959 - DNA, 105 bp, Homo sapiens; identical to SEQ ID NO: 36875
  chr18:5630693-5630798
  hyper

SEQ ID NO: 81960 - DNA, 30 bp, Homo sapiens; identical to SEQ ID NO: 45382
  chr18:56483562-56483592
  hypo

SEQ ID NO: 81961 - DNA, 25 bp, Homo sapiens
  chr18:56483918-56483943
  hypo
aagtttgaaattccccggccgggcg

SEQ ID NO: 81962 - DNA, 30 bp, Homo sapiens
  chr18:56737815-56737845
  hyper
aacgccgaagttcatcgagttcctcgggag

SEQ ID NO: 81963 - DNA, 24 bp, Homo sapiens
  chr18:56815852-56815876
  hypo
tttttttttttgagacggagtctc

SEQ ID NO: 81964 - DNA, 24 bp, Homo sapiens
  chr18:56816116-56816140
  hypo
gattacaggcgtgagccactgtgc

SEQ ID NO: 81965 - DNA, 342 bp, Homo sapiens; identical to SEQ ID NO: 37028
  chr18:56887076-56887418
  hyper

SEQ ID NO: 81966 - DNA, 155 bp, Homo sapiens
  chr18:56887704-56887859
  hyper
ctccccatttctttgcgtttccctggcccagctttgggagctgggtttgttgtgacctttctatcggcaaacaccttccccgttctcctaaaactccaccccacctttccccattctagggagcccatgagtccctagtcagccgcaggctggtc

SEQ ID NO: 81967 - DNA, 421 bp, Homo sapiens
  chr18:56887906-56888327
  hyper
cgagctcccaacagccaaccccggtgcagatcaccttccctctgcgcccatcctacatctccttttgtccgcctagtctcaacctgtctggcacggtactctcctagaataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctgttcagtgcgcagtgccctgaatcccgcctgtctgtgactctctggagtttcctcagtccttctcttcgctttgcagcgatattcttttccctgcccttttgccctccctctttccagccagcaggctctgagcttggggaatct

SEQ ID NO: 81968 - DNA, 272 bp, Homo sapiens
  chr18:56888384-56888656
  hyper
cgcccttcttgacccacgacttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcatcaccccagggctctcggcgt

SEQ ID NO: 81969 - DNA, 8 bp, Homo sapiens
  chr18:56888686-56888694
  hyper
cgtccaac

SEQ ID NO: 81970 - DNA, 17 bp, Homo sapiens
  chr18:56911116-56911133
  hypo
cccggcctctttgtata

SEQ ID NO: 81971 - DNA, 878 bp, Homo sapiens
  chr18:56931541-56932419
  hyper
atcaaatgctgaagccgccaaggctctcgggtccgcacccagggtgccctcaccgtacgccgaccgtgtggggaacacgctctctggaagctgagttgggggtcctggtctctcttgccgccccctgcccccagcttcctgcgcgtgggctccagcggtctccgcaaagactttcagctagcctgtgaatttggactagagagggagcaattggcattccctctaccgtcaccagattctagattaactggggcggggtggggaacaggcagggattgtctccactagtttgacaattcccattccccaaacactgaatatgtatttagggtaaataaatttagcagggtggtcccagtttagttggtgacctctggtcaaagcccgcccctcttgggggttctcttccagtccctccaccccatcccaccctgaccagcccggatcaccctcctgagcagcgcaggtgggggctcggaccggcaggggacagaaccgtgttcggaactaggaaatccactagggatacacagcctggaccggtccagggccgcagtgcctaaccccaggacaccgagcgagggcgcctccgcggtcctacgggaacctcaggacactgagcgagggcgcctccgccatcctacagctgttctcttaacgtcgagcctctggagcccagcaatccagagaggccgagccctcagtcccctgcgtccgtgcaggaaagaaattgggctgcgagcatcgccaacagaagccgggagccgtggcgcgcattatggacacgccgccctcgcgcgcagagactgctccagaaagggaaaaacgcaaaacttaaaacgcggtggctcacgcctgtaatcccaacactttgggag

SEQ ID NO: 81972 - DNA, 457 bp, Homo sapiens
  chr18:56932659-56933116
  hyper
ctgtctctaacaaaacaaaacaaaaactgccgtggggctggctgatggtggccacggggtcgcgggggaggtccgctcccggcaggctccagctctctgggtcagcggaggtaccccgaggctcaaagagcggtcagctccccacctccccaaaagtgcctgactccgcccttctctcggcgcggtccaattcgcggcgtccttcccctccccgccttcgctatctgagagccccgcccaggccccgcccaacctggttcgcaagagcagaagaggatcccggtctacagacccgcttgctttcctcctagggcgggtcagagcagacgtcgtcggggtttgggaaggaagcatctccagacctcttgaattgactgaagccaatagaggcttgccctaggtctgtgcttggagcagcacggtgccttttcttctggaacctcgtaagacccatgtg

SEQ ID NO: 81973 - DNA, 30 bp, Homo sapiens
  chr18:56933508-56933538
  hyper
tgcggggcttggggacgggggaaccctggg

SEQ ID NO: 81974 - DNA, 507 bp, Homo sapiens
  chr18:56934900-56935407
  hyper
tccaggttctgctggcggtcgcccagcttccagtgtcaacggtggatatcgagcacgctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctgcttggtgaactgagaggagtccttaggagagcggggacgccaggggccgggggacacttcgctctcgccctagggaaggtggtcttga

SEQ ID NO: 81975 - DNA, 140 bp, Homo sapiens; identical to SEQ ID NO: 37037
  chr18:56935479-56935619
  hyper

SEQ ID NO: 81976 - DNA, 1141 bp, Homo sapiens
  chr18:56935921-56937062
  hyper
gcctggaggctccagcgcctgcggtgatgggagcggcgtggccagcggggcccggcagcctgttgccctccagctgcagggctgaggtccgcgaagtgcgttgaggcggccagagggcctctcctcaggcctgaaagtcgcccttctccccgtgcatcgggagcaggcgcgtggccctgaactatgcttggcgggtggctgcaggcgacagggaaagaggggccgagctggggaggggggttgtccctgggagagaggatgcgggtacggtgcggtcggcccggggtcggatcccaagacgttccccagtgcccctagagggcctgccacggcttcccgatggcctggatgtgctccttggctttcagacgcagcgccgcgatgctgctgttgcgcgggtccgcctcgtccagcgggaacttgtccccgaagccgggcccgcacgggtaggagggcggcggcggcgcgagaggttgcaggccggggcccaacggcggggagttcaggaagggcggaggcggcggcggtggcgtgtagctggcaggcaggctctgcgccggcggcccgaagcccggcaggctctgcagcgccgtggcgcccccgcccggcagcggcggcccgagccaggactccagcggcagcgcgcccccagccggcccgccaccgctgcccgggcccgccccgaggggcgacagcgtcgcggagggcggggagcggctgaaggagaggaggggcgagtcctgcagcttcatggaggacacttccagcttctcctgccgccgccacttagcccgtcggttctggaaccacacctgcaggagagagcacaggggccgtcgggcagcagcggaggctgcggccgcgtccccaaccctgagccggttcagctcggcgggctccactccgtccccctcaaataaaactaggggcgcaactgttatgcatgtgccgagagaggcccggatcttccttccttccacccactcctactcctcccaccccgcgttctcttttcttttccatcccctttctctctctctctctctctcttttttttttttttttggcctcttctctccattatcgcctcttctgagtctctttgtcccatcctagtcctccgtggcgtcccacccttttc

SEQ ID NO: 81977 - DNA, 600 bp, Homo sapiens
  chr18:56939052-56939652
  hyper
aaaaggcctttgcagcgagaagtttggttggatgtgcaccagaaaaggaaaagtcagtttcttaaataaatccacccgaagtttcaactgcgaggtgccaggcccttcgcaaggaaacagggttttcgtttccaactcggtattcgcagctagtgacgagggtggcatttggggccccaatcctgtcaccctcgatcactacctgcattccatttccactcagcaacccccaaccccttcctggctatgtctaatgagctgtcggcctcttcatcttgcaagtcattcccatcttctattttgagtttagaagagggaaacccccaaaggggagctcgtactacaaactggaacagactgcttgaagggcgatgcacagggaacatcgaagatctgtgcctctcccttgagactctgggcatgccaagtcgaggaaggacagtaataaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtc

SEQ ID NO: 81978 - DNA, 408 bp, Homo sapiens; identical to SEQ ID NO: 1341
  chr18:56939763-56940171
  hyper

SEQ ID NO: 81979 - DNA, 680 bp, Homo sapiens; identical to SEQ ID NO: 1342
  chr18:56940565-56941245
  hyper

SEQ ID NO: 81980 - DNA, 632 bp, Homo sapiens; identical to SEQ ID NO: 37043
  chr18:56941557-56942189
  hyper

SEQ ID NO: 81981 - DNA, 75 bp, Homo sapiens
  chr18:56976125-56976200
  hyper
tgcgacaagtgacagcgcgggaggcagaggaggcgcccaagggtggggctggtttgcaagcgcaaagtgttgcac

SEQ ID NO: 81982 - DNA, 36 bp, Homo sapiens
  chr18:57061262-57061298
  hypo
agcactttgggaggccgaggcgggcagatcaaaagg

SEQ ID NO: 81983 - DNA, 52 bp, Homo sapiens
  chr18:57069866-57069918
  hyper
agaggtgactgaggccgctgtgctgaggctccctgggcgattcaactacacc

SEQ ID NO: 81984 - DNA, 30 bp, Homo sapiens
  chr18:57138384-57138414
  hypo
aggcagagaggctgtcgaagtgtttgagtt

SEQ ID NO: 81985 - DNA, 375 bp, Homo sapiens
  chr18:57363675-57364050
  hyper
gtgttgctctgactccgatccaaccaaccctcaaagattcgcaccgcgcggcacgcacccagcaggttccagcgtaaaagctgctccggtcccaagcgcgtctccaaacccctcctttacagcgccgcctccccagccagccccggtgcgcagtggcgaacagcccgcagagcccccaggcttacctgtagcatgtggtgagctcgcctgaagacttcagacacgggtatttagtcgtcgcgattttgctctctgagcagatttctctatgaaaaagtgcagaggaaatgttcgattctcagcgggagagcggaggcgggcagcgcgcgctggggaatccctggcgcgtggggatcgccaggctccccgtcccgg

SEQ ID NO: 81986 - DNA, 532 bp, Homo sapiens; identical to SEQ ID NO: 37046
  chr18:57364448-57364980
  hyper

SEQ ID NO: 81987 - DNA, 183 bp, Homo sapiens
  chr18:57365455-57365638
  hyper
ccatcaaatgagacacgtgggggcaaattaattacaggtgctgctacctgctagtgtatgcagccgcgttgataggtaacaagaaaacggaggaggggggccgtaaatcggctcccttgacggtgaccctaattgtaattcgtgtgtcagcaacttaacactttgttgcgctttaggagtttt

SEQ ID NO: 81988 - DNA, 184 bp, Homo sapiens
  chr18:57652615-57652799
  hypo
atgtaatgcatttagcgtgattgtgaccacgtaagtcatcatgggcatgttagctattaagatgatttaaaaatgatcacatcttagttcttgcaattttacactgaaattactataagtaagcttctcctcacgtggaagtcattagctttacctgtaaatatgattgcggcatctgcctatg

SEQ ID NO: 81989 - DNA, 116 bp, Homo sapiens
  chr18:57677751-57677867
  hypo
agactctccctgagccgcaaaatcggtgctaggactccctgccggagaggccggagacacgcgagaatcagtgtcactcaacgcccacgggagcagagactcgggccctgccagct

SEQ ID NO: 81990 - DNA, 30 bp, Homo sapiens
  chr18:57684712-57684742
  hypo
ccccctccggcactccggtgactgctgaga

SEQ ID NO: 81991 - DNA, 38 bp, Homo sapiens
  chr18:58330518-58330556
  hypo
tcacaccatcaccctcgccagggcggacctggagaagt

SEQ ID NO: 81992 - DNA, 85 bp, Homo sapiens; identical to SEQ ID NO: 36876
  chr18:5891336-5891421
  hyper

SEQ ID NO: 81993 - DNA, 69 bp, Homo sapiens
  chr18:5891443-5891512
  hyper
cggtggagtagaggtcccgcaggttgatgattttggtcttcttgtcccggttctcgtggaggaccgcgt

SEQ ID NO: 81994 - DNA, 283 bp, Homo sapiens
  chr18:5894663-5894946
  hyper
gcgctgtgctgtgcccggtacccaacccaggtcctcgaccccggcccctcactggcagggcggcgaccccctggcccctggctttggtctgcttattgatgttagctggagtcacatgagtgcagcagctgggagtccgcctctggaaagaagacaggcaggagccaagtgagggcaatcctgaactagctttttctgggcagcgcatcccgtgtagccagcccgggaaaaagcctctcaccgaacaccagcccggggcgcggggactcggggacccgagggg

SEQ ID NO: 81995 - DNA, 1115 bp, Homo sapiens
  chr18:5895017-5896132
  hyper
cgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggtcggggcccgcccggctcggcggagtcggggggcgcccccgcccccgccccccgccccaccccctcctccggcgcccccccccacgccgccggccttccccgctcccccgcgtcctccgccgcccgccgcccgtcccttcggaagcgccgattcctcggggaggaggaggcgtgaggggaggcggcggaggcagccggcacggggcgctcgggccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctccctcccctcgtgcctcggtcttttgttgcctctactcctcggcacggcgcagcctgggctctcttccccctcccgcttgggagtttgcagtgtggacgctcggcaagcacagtaagttgtcccccagcgaactcgggcccgggcggagtggagccgcc

SEQ ID NO: 81996 - DNA, 109 bp, Homo sapiens
  chr18:59000691-59000800
  hyper
aggggaagcggaccgcgcgccacgctcgggggacggtgaccgcgaccagggggctcttctcactggacaggccgaacgcggtggccgcgggagggcagggcagggcatc

SEQ ID NO: 81997 - DNA, 543 bp, Homo sapiens
  chr18:59000801-59001344
  hyper
gcggggttggtgcacttggcagtaccccccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggtggaggacgtggcg

SEQ ID NO: 81998 - DNA, 408 bp, Homo sapiens
  chr18:59001497-59001905
  hyper
cgcacagagatgtgcgccgggaaggggaccagagagccaggctccggggaggcgcaggcacctacggggccgatccctggtccgtgcctcgcgccgcgcccccgccggagctcggctgtgggaggagaatgtggtgggtactcgagtccccgccacctgccggacttcgccaactccccggatttcctgtcctcgggccctgacactcccaaggaaagctctgaattgcgctcgctgtttggtttttgcttgttgtagttactctgggggaagagccgggggcaagggggtcaaatggggctaaagtttcagatttgcaaagagaacgttaccgaggactctcaacgtgtccttagcaatcggagagactgcagcagcctttgcctagctatccgcctctggggcagc

SEQ ID NO: 81999 - DNA, 30 bp, Homo sapiens; identical to SEQ ID NO: 45386
  chr18:59137607-59137637
  hypo

SEQ ID NO: 82000 - DNA, 226 bp, Homo sapiens
  chr18:59560168-59560394
  hyper
aggaagggttagatacgcgccgcggagaaggaaatccaagcgccctcctgggcagacggggctggagcgggtgcactagggaggtggagcaaggcagatgaggtgtggagggctggcggccgagaagggggcgtcacggctcctaattgtctctacaggataaataaccacctcccccctcctccgcagtctcccccgcccacgagttcccctctggtggcagagc

SEQ ID NO: 82001 - DNA, 177 bp, Homo sapiens
  chr18:59560395-59560572
  hyper
cctactagcaacagtaagccctaggaaagaaagaaatcggagcaggtggggaataacatcttggggcaaagacacactggcaaaatctaccaggtaacccggtcatatgggaatgcggggcgcctagtcagccgcgcagacaggcacacagcgcggcaatcccgagcatctttcttt

SEQ ID NO: 82002 - DNA, 98 bp, Homo sapiens
  chr18:5967868-5967966
  hypo
gggacttgtgaagggcgccagggggagccagggattgttgtaagctgggcagagacatgcccagaattctgccttctccaccacgttcctcacgatct

SEQ ID NO: 82003 - DNA, 30 bp, Homo sapiens
  chr18:5969470-5969500
  hypo
ccgaggggaaggtcccgaaaagggtgggct

SEQ ID NO: 82004 - DNA, 86 bp, Homo sapiens
  chr18:597381-597467
  hypo
aggaggaggtagaggcggggagacacaccatccctgcaaaactactggcaaaaactaagcggagccgggtgtggtggctcacgcct

SEQ ID NO: 82005 - DNA, 37 bp, Homo sapiens
  chr18:59992186-59992223
  hyper
gcccccattccttcccgggaggcggggcccacaggcc

SEQ ID NO: 82006 - DNA, 30 bp, Homo sapiens; identical to SEQ ID NO: 45387
  chr18:60056441-60056471
  hypo

SEQ ID NO: 82007 - DNA, 38 bp, Homo sapiens
  chr18:60263506-60263544
  hyper
tcgcgttcagatcctcgaagtggctccctccgggacct

SEQ ID NO: 82008 - DNA, 694 bp, Homo sapiens
  chr18:60263660-60264354
  hyper
cgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtgtttgaaacgtgagctgttgtcaggcccagggccaaggatgctaaatgtccgggaaaatgcgcgcggcagccggccacactcaggacgatggtccgtccccgagagccagcagggctgcggagaggaagatccagccgccgagcgcagcgcgcacggagcgggacgcctgcggcgatgcctgcccgggtggccgctgtcctctgcccgggcgccgctggagccgcgcgtccccatcgccgcgccggctagtcccacaggtgcccggagagggaggcacggaggcatacccaaccttgagtgcgtccagcatacgtgggtgtggacgaaggtgagaaagggttctttccaaaggttcaagacagagcttccagtaccttctaaatccccagaaagtagtggtctagaagttgcttctccgcttcccaacgcca

SEQ ID NO: 82009 - DNA, 216 bp, Homo sapiens
  chr18:60467824-60468040
  hypo
atgggctgtttgtctcgggggagcatatgaaaagaagagtctctgttgtaaaaaccctctcagtttgatatttactttggttcatgttacttgttttgttgtttagcgagtttctgcttatgatcctaataataacctatttagagtagggctttattttctagagtgccttgaagctattcgatgctgagctggcttctccggctacctgcattc

SEQ ID NO: 82010 - DNA, 94 bp, Homo sapiens
  chr18:60557763-60557857
  hypo
gctgggattacaggcgtgagccactccgccaagccttcttttccatttaaaacttgttaactgcattttcctcattcagcgtattgctgctttc

SEQ ID NO: 82011 - DNA, 49 bp, Homo sapiens
  chr18:60730449-60730498
  hypo
cagcagttctcaaagcgtgggcttggaccagcagcgacagcagcaccca

SEQ ID NO: 82012 - DNA, 30 bp, Homo sapiens
  chr18:60741411-60741441
  hypo
tcatatttagcagtgcgtgcttccagcttc

SEQ ID NO: 82013 - DNA, 30 bp, Homo sapiens
  chr18:60756521-60756551
  hypo
cacaggggctcaccccgggacttggcttgt

SEQ ID NO: 82014 - DNA, 85 bp, Homo sapiens
  chr18:60759912-60759997
  hypo
aggcctgtgaggaaccgggccatgcggcaggaggtgagcagcaggcgggcaaacaaaacttcctctgcatttacagctgcccccc

SEQ ID NO: 82015 - DNA, 15 bp, Homo sapiens
  chr18:60985518-60985533
  hyper
ccgcgcggtgaaggg

SEQ ID NO: 82016 - DNA, 140 bp, Homo sapiens; identical to SEQ ID NO: 13094
  chr18:60985592-60985732
  hyper

SEQ ID NO: 82017 - DNA, 240 bp, Homo sapiens
  chr18:60985733-60985973
  hyper
tgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaa

SEQ ID NO: 82018 - DNA, 30 bp, Homo sapiens
  chr18:61200515-61200545
  hypo
tcttaatgaatgaatcgaacttaagttctg

SEQ ID NO: 82019 - DNA, 217 bp, Homo sapiens
  chr18:61603484-61603701
  hyper
ccttccttccgggtccgcacagaaggcctgagcgcgtcgcctctaacactggtccagggcgggggaacgcggtgtgcctcggctgccacctcctggtgactaattctagtggacgtggagagcgaaccacagcctcaacaacacctaattctaattacagctggtgatcggtgaggtgacggaaataaacggggcgctatggcgggaactaatagat

SEQ ID NO: 82020 - DNA, 84 bp, Homo sapiens
  chr18:61603901-61603985
  hyper
cccgcagaatgcaagcggcgcagaatccttgaaagagcttccgagtgaaacccacgcccgcccgtggggcggagccctagcagg

SEQ ID NO: 82021 - DNA, 31 bp, Homo sapiens; identical to SEQ ID NO: 45390
  chr18:62165289-62165320
  hypo

SEQ ID NO: 82022 - DNA, 19 bp, Homo sapiens
  chr18:63276828-63276847
  hypo
actccgtctcaaaaaaaaa

SEQ ID NO: 82023 - DNA, 160 bp, Homo sapiens
  chr18:63417736-63417896
  hyper
ttctttattttcctgcgaaggaatccatctgtacagatccgccaggcgggaggtggaggagggtgcgcgagggtgcgcgcgtgtgtgtgtgcgcgcgtggcggccgagcggctccgtcttcgcgttcttttccagtagcccccaccgggtctctgggagg

SEQ ID NO: 82024 - DNA, 30 bp, Homo sapiens
  chr18:63418956-63418986
  hyper
ttcatctgcatcctgcgtcccctccgcctg

SEQ ID NO: 82025 - DNA, 190 bp, Homo sapiens
  chr18:6414507-6414697
  hyper
cgaggcgccgggctctgcggcggccgcgcccgtccaaagtaggcgacaagtgaggcagcgcctctcgcggggagcccggcgcgcgccccggcggcgaaagagaaagagaaagagcctgggccgggaccggggctatccccaaccgccaccgcccccaccggcccggccctcgccgcgggagtcgtgcagg

SEQ ID NO: 82026 - DNA, 40 bp, Homo sapiens
  chr18:65085708-65085748
  hypo
tggcaatacatggaccgcacatttctcggaatggtaaaaa

SEQ ID NO: 82027 - DNA, 449 bp, Homo sapiens
  chr18:67067444-67067893
  hyper
cattgataacaaccacgttctccattttcccagaagagccaggagccactttcagtcctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttgtgtgcaccaggaagggtctggcgtcgatttacacttcctaacggggcagagacctggaacggccgcgagtgcttgggaataaaaatgtactgtaaacaaggccaatgaaataagtgtctcgctcccgctggccttccgcgttggaagtgtccccactgccctttccccgctgcacagcttgcgagtggagatttagagcccgggaatgaggcgccgtgtccttaggaatctcgcgccc

SEQ ID NO: 82028 - DNA, 77 bp, Homo sapiens
  chr18:67067894-67067971
  hyper
gggagcgctgagggaccggggagccgggtggggagcgggcctcggggcgcccggcggcggaggcgctcccacccgcg

SEQ ID NO: 82029 - DNA, 119 bp, Homo sapiens
  chr18:67067995-67068114
  hyper
cgagcgtctccgagcccagccaccccacgggccagggggagggagcggggccggcgcatcagcccgccccccccggcccgccccctccccccgcgccggggagccgcggtggtgcgctc

SEQ ID NO: 82030 - DNA, 700 bp, Homo sapiens
  chr18:67068592-67069292
  hyper
cggctggctgcctggggggggggcagggagaggtgacccgtgcgggtacagggcagagagggacccggcccttaggcggatggcccgcttgttgcttggccaggtgggggcccacacctgccggggggctccgcagacggacctggggactccaggagcgcctgagtccccatcctcgagtgcaccgggctgtcttcgaccgtgcggggaagtcagtagacgaaaggggttgtcagttccaacgaggaacgtgccttggaggaggtttctttgcggtgctatccacgatggtctgttctcaaaagtgtgcgcctttcgggtggaactgctgtgtgtggcgacgctcgcgtgtgtttagaatcaccattttctggtctccgcttcccaagctcaattcgaaattcccgtctgatgccctcccagcgccgcgcgtccctgccggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaagggttcaaaactattctagtgaccagacgaggcggtaggagggactc

SEQ ID NO: 82031 - DNA, 48 bp, Homo sapiens
  chr18:67163583-67163631
  hypo
ccaactcggaaggggcggggctcccacttgtcccggctaccaccaggt

SEQ ID NO: 82032 - DNA, 30 bp, Homo sapiens
  chr18:67266861-67266891
  hypo
cgttcagaagctcaacgtattgatttctac

SEQ ID NO: 82033 - DNA, 279 bp, Homo sapiens
  chr18:6729441-6729720
  hyper
caggcgtgcacacgtacacaggcacacaaacaggcacacacaggtacacacgcacacacagacaggcacagacgcacgcacacacacaggcacacaaacaggcactcacacaggagcgcgcgcgcgcgcgcgcacacacacacacacacacgcactatgcccgcccccactccagcccgtgggcgtggttcccagcgtctgcgaattcgcgcgcccggggcggggcgggcctgcccgggggcccctgacagccgcgggagagagcggctggtcgcacct

SEQ ID NO: 82034 - DNA, 158 bp, Homo sapiens
  chr18:6729981-6730139
  hyper
tgggcttggggggttcgccgtgcagctgcgccttgtgcctgagcgcacgaccgccgtcactggatgttgtttcaagttttggtggactagatgagtgagcctggggttctttgcattgtctttgactggaggtgggaaacgctcgaaggctccaccag

SEQ ID NO: 82035 - DNA, 172 bp, Homo sapiens
  chr18:67592818-67592990
  hypo
tcagttgctggatcccgtcaactctaccttttaaacatctctcaaacatggaccctacactctctatacaaattgccctattctgctccatccctactatattactaaaatagacttctgcccagcctccttcactccagtctcgctcccatatgaacgacagtccacgata

SEQ ID NO: 82036 - DNA, 93 bp, Homo sapiens
  chr18:67918076-67918169
  hypo
gtaacgtacacttggaagagggccaagcaggcggcttgagagaatgtatgcagttggacctttgacttggggttgatacgttggagtacttca

SEQ ID NO: 82037 - DNA, 35 bp, Homo sapiens; identical to SEQ ID NO: 45391
  chr18:68051409-68051444
  hypo

SEQ ID NO: 82038 - DNA, 34 bp, Homo sapiens
  chr18:68180996-68181030
  hypo
tgccctggctccccccgtccgtctgcaaaatgga

SEQ ID NO: 82039 - DNA, 44 bp, Homo sapiens
  chr18:68206456-68206500
  hypo
aaagtgctgggatttcaggcatgaaccaccgcgccccaccaatt

SEQ ID NO: 82040 - DNA, 24 bp, Homo sapiens
  chr18:68699229-68699253
  hypo
ctcccagtgcggggcccgccaacc

SEQ ID NO: 82041 - DNA, 37 bp, Homo sapiens
  chr18:6929750-6929787
  hypo
ccagccacactgtcccggcagacgctctcaccttagc

SEQ ID NO: 82042 - DNA, 285 bp, Homo sapiens
  chr18:70209101-70209386
  hyper
cgtggcggagaaggccaccttggcgctgccggagcgcacggagatgcctagggaggaggtgacggcgccgtccgccgacgggctggagtcgcacaccaccaggcacttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccggg

SEQ ID NO: 82043 - DNA, 440 bp, Homo sapiens; identical to SEQ ID NO: 37059
  chr18:70209493-70209933
  hyper

SEQ ID NO: 82044 - DNA, 395 bp, Homo sapiens
  chr18:70210560-70210955
  hyper
ctcttgataaatatccgctgtccgcagccccgatcctacatgatttcccttctctctctccacctcctccacccctcgatctggaccagggagagtcttcgttaaaatccacgcagaaggcgcttgcatgcggaggggagggcaggtcgggggtggttacctggaacatccatgctgggcgagctccgctgtccgcgaagttgctctgcttagagaaaatgaggcgagtgggagctgtcgggaggaggacacggagcgcgaccctgctcccagcgcgtggccaataaccgcgccgccccgccctgccgctttcccgcgccagcctgcgccgcttcaggggtgcaccacgccccgcgcgcccgcttaggcgccgcgcccgggaccgggaaccccgc

SEQ ID NO: 82045 - DNA, 768 bp, Homo sapiens
  chr18:70210956-70211724
  hyper
tctcgcccggctcagcgccccgcgctgtgcgcccaggtgcctccaacccctgggcttcgcgcccgcaccgctgcctggggcccctcgagctcccgcgctcagcgcgtccgcagcgcggctccctcgcgggtcccctcggccccgcagccccgccagtctccagagggcatagccgagcgctgccgcctccctaggactcggaaccttccctgctcccaagcccgccgcaccctccaacgccccggtcctgctcacccaaacgcccagagcaaaatactcccagacgtctcttttgaaaattagacacccttaaaagcaccggtcgcttctcttcttttagattctttcttttctttccccaattccctccaagtcttaatattgaatggcgtgaccactttcataatgacaggagcgaaaaaaacaataagttaaaaaaaaaaaaaagaagaagaagactgggatggctgggacgaagagagggaaaaaaaaagcttgagaatttgatgatttaggagctgtggttccagagtcccagttggggaactgtccggttcccgcagggctagaagaggggcctccggcccgggtctgtgtgtctgctcctctggacctcggactggtggagcggctggcgcttgcgcttatttattaaattgcggtgtccgcgctcgctcaaaggacccggggagacgcgctgggtttcccagctgcgcctggagctcggctgagggcgcaaacacggacgtggggcgccacctgcgggtg

SEQ ID NO: 82046 - DNA, 328 bp, Homo sapiens
  chr18:70533988-70534316
  hyper
cgacatcagcggtctccagggcggaaaggggtggaagctgaccctcgcccttccctccagcgctggcttcaggtgtgccttctgctacctcctgtactgcgaacaggggcccgccgagctccgggagcccctagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgc

SEQ ID NO: 82047 - DNA, 182 bp, Homo sapiens
  chr18:70534427-70534609
  hyper
cgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagg

SEQ ID NO: 82048 - DNA, 335 bp, Homo sapiens; identical to SEQ ID NO: 37065
  chr18:70535220-70535555
  hyper

SEQ ID NO: 82049 - DNA, 509 bp, Homo sapiens
  chr18:70535575-70536084
  hyper
cgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcc

SEQ ID NO: 82050 - DNA, 838 bp, Homo sapiens; identical to SEQ ID NO: 13106
  chr18:70536187-70537025
  hyper

SEQ ID NO: 82051 - DNA, 33 bp, Homo sapiens; identical to SEQ ID NO: 13107
  chr18:70537332-70537365
  hyper

SEQ ID NO: 82052 - DNA, 27 bp, Homo sapiens
  chr18:70711868-70711895
  hypo
taaaacacatagtttcggccgggcgcg

SEQ ID NO: 82053 - DNA, 183 bp, Homo sapiens
  chr18:7109195-7109378
  hypo
ccagagtccggggaccggctttatggttgctcaggcaacctgactacctgtggggagttcctcggtgttactgccctccggctactaatgacccaggttttaatgctagaacccccctggggttgtctgtgtattcaaagaaatgccgggagctaaggttttgatcttcgaaacagaaatgtc

SEQ ID NO: 82054 - DNA, 147 bp, Homo sapiens
  chr18:7116490-7116637
  hyper
aatgaatgagatggtcgcgtttctgcagagctcacaactcagcacaatgcccaaacacacgtttcccacgagggcactgcaaattccgcccactacttttgactcgaatttttttttaatgaagtttatattcgtgggaatacgccc

SEQ ID NO: 82055 - DNA, 26 bp, Homo sapiens
  chr18:7116857-7116883
  hyper
gcccgcaaaaacagaaaatgaaaatt

SEQ ID NO: 82056 - DNA, 238 bp, Homo sapiens
  chr18:7117059-7117297
  hyper
cgcctgcgggtccccctgcccgggacggctggctaggggcgcccttctcgccgcgtctctccccactagcccgcttggctgccaggggccccgaggaatccgccctttcccggccgccgcgacccagcttgcgcagccggacaatgagggcgactcgggagagctctttctccattcatcccccgcgcccggccaacagccccgccacccccgcccgcgcagccggggcactaaaagc

SEQ ID NO: 82057 - DNA, 38 bp, Homo sapiens
  chr18:7117522-7117560
  hyper
ccgagacacccactccgaggtggatcaggatgcgcgcc

SEQ ID NO: 82058 - DNA, 476 bp, Homo sapiens
  chr18:7117615-7118091
  hyper
cgcctgcgggggacagggaccctaggacccgggccgggctcacctctctgccggcactgcgcggcgacacacagcagcaagaccaggagcacgcccccgcgcatctcgcctccgccgccactcggtgggtctggggagaaagccgcgcgcccgcctggaacgctccacgggacgcgagtccgcgctgccctggccccgccgctcctggagtcctgccgcccctccctccagccgccctcggacacacccctcggctgcgccccgccccgccccgtcccgccccggcttggccccgccacccagacccctcccccgggggcgcccagcttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattc

SEQ ID NO: 82059 - DNA, 81 bp, Homo sapiens
  chr18:7118131-7118212
  hyper
cggccctgcagtccccgggccaggacccacgcgcccctgccaggagctgggcgagaggcgacccctcgggaagccacccag

SEQ ID NO: 82060 - DNA, 19 bp, Homo sapiens
  chr18:7118760-7118779
  hypo
agagcgagactctgtctca

SEQ ID NO: 82061 - DNA, 53 bp, Homo sapiens
  chr18:71840738-71840791
  hypo
taacactgccagcctcgcctccctgcctgtaactccaccggcttcctgcctcc

SEQ ID NO: 82062 - DNA, 30 bp, Homo sapiens
  chr18:71844331-71844361
  hypo
gcccatctgttcacacgacatctgtggtaa

SEQ ID NO: 82063 - DNA, 56 bp, Homo sapiens
  chr18:71983677-71983733
  hypo
ctgaaccccgcgccccgggaggatttttaggaagggtccctcgtagcggcggtccc

SEQ ID NO: 82064 - DNA, 168 bp, Homo sapiens
  chr18:71989323-71989491
  hypo
tgtctgataatttgtcggttacatttttagaggtagcttgtaatacactttaaactataatatagatactgctaaattgctgtctgaaaagctttttgccggattgcatgttaacaaatagtctgggaggaaacctgtttttccataccctcacgaacactgtagata

SEQ ID NO: 82065 - DNA, 750 bp, Homo sapiens
  chr18:72123440-72124190
  hyper
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagccctccgcatgggctcggtgagatagggggtgacctggcagctcagggtggaatcacagaacgcgggctgggctggagcgctgcggacccgagagacagaggcgtggcaccccggatcccgaaccccgcactggcttgcgccccgagcccggcggcctgacaccggacgcggcacctccctggacactcggatcagacccgcaaactttcttccggagctcgggctcaggggtggcgagggtaggacggagaggctgtctggggacaaagggcgaattctggcgaaaaggggagagacacccccagcgcgcccacagagcactgccggctgcgtccccattcgggggaccggggcgtgcgcctctggcactccacgcaggtgtcgggaacccatgtccccgg

SEQ ID NO: 82066 - DNA, 48 bp, Homo sapiens; identical to SEQ ID NO: 13109
  chr18:72124237-72124285
  hyper

SEQ ID NO: 82067 - DNA, 93 bp, Homo sapiens
  chr18:72220044-72220137
  hypo
gctgggtcatatggtgactctatgtttaattgatcaaggaactttccgactgttttccacagtggctgtaggcttttgcgttcccatcagcag

SEQ ID NO: 82068 - DNA, 23 bp, Homo sapiens
  chr18:72263664-72263687
  hypo
atgatttttttgagacggaatct

SEQ ID NO: 82069 - DNA, 23 bp, Homo sapiens
  chr18:72263927-72263950
  hypo
agccaccccgcctggccagtgat

SEQ ID NO: 82070 - DNA, 42 bp, Homo sapiens
  chr18:72335160-72335202
  hypo
gtgaatatgtgactgcgtgtgtgagtgcgggtgttagtgtgt

SEQ ID NO: 82071 - DNA, 77 bp, Homo sapiens
  chr18:72347499-72347576
  hypo
catgaggaattgctgcgggaggtgaataagtatatagtggaagacactgagcaaatcaaccgcgagagggaggaaaa

SEQ ID NO: 82072 - DNA, 30 bp, Homo sapiens
  chr18:72592835-72592865
  hypo
tcacagtcaataaaccgcagtggtaatttc

SEQ ID NO: 82073 - DNA, 30 bp, Homo sapiens
  chr18:72647545-72647575
  hypo
gggtggcaatgtggccgcagctcatgtaac

SEQ ID NO: 82074 - DNA, 30 bp, Homo sapiens
  chr18:72827696-72827726
  hypo
tctacagcaagcagtcgggataataaatac

SEQ ID NO: 82075 - DNA, 45 bp, Homo sapiens
  chr18:72844763-72844808
  hypo
tcttcatgctgatgtcgtggaaggggtggtcgtgtgtttcaaaca

SEQ ID NO: 82076 - DNA, 45 bp, Homo sapiens; identical to SEQ ID NO: 45396
  chr18:72896219-72896264
  hypo

SEQ ID NO: 82077 - DNA, 508 bp, Homo sapiens
  chr18:73167421-73167929
  hyper
cggacagcacccgccttgtgctcaccccgccgggatacacggggacggttcctttccaaggaggcccggggccgcctctgcgccgggacagcctgggaagccgcgcaggcctggccgacttccccttcccagccccgctgcgccctgcggggccctgtcggcggtgggggctgcggacccgggagcgcgcggccgcgctgcacgtgcagggaccggtaggcgccggggtcagcgccagcgtttgatgtgcggcggggagcgggccgagccccgggaggccgcttcgcacctcccagtgtgtccgggttgagcgcgaggtcaggaggggacgcagagttcacggcgaagacggatcgcgggggctcgtcccgcccgggttgcgcgcagcgggggccgcgtgatggatgggccgggccgggcacccgggaacccgcgagcgcggggctgggctctgggctgcgtccgggggccccgacttggttattgatcggcccaagcgcaggagaac

SEQ ID NO: 82078 - DNA, 174 bp, Homo sapiens
  chr18:73438900-73439074
  hypo
gggtattccatccaccgggatgcaccttgttacaactgggtccaatcccgtcacagtcaggtgccgcctgtccttctgctaagcccttctcccctctccctgtgctcctgggacttgcatgtgtactcacagggttcctcccaccgttattcagacctccgctcattttatttc

SEQ ID NO: 82079 - DNA, 32 bp, Homo sapiens; identical to SEQ ID NO: 37074
  chr18:73628017-73628049
  hyper

SEQ ID NO: 82080 - DNA, 135 bp, Homo sapiens
  chr18:73628494-73628629
  hyper
ggaggagcctgagggccaagagggccggcgcgcggtgggcgcggcctgcggggatgccgggctctacggagcagcgcggggtcccgaagccccctaccgcgaggcctcagaaggggatggcgacctcttgcagcg

SEQ ID NO: 82081 - DNA, 39 bp, Homo sapiens
  chr18:73769111-73769150
  hypo
gtgcactgcggtcttcgtgcaaatcggagttgacgccta

SEQ ID NO: 82082 - DNA, 30 bp, Homo sapiens
  chr18:73843051-73843081
  hypo
tttgaatcattcggccgttttgcattactc

SEQ ID NO: 82083 - DNA, 30 bp, Homo sapiens
  chr18:73885138-73885168
  hypo
aaacatcaagacacgcgcatgagtcggaag

SEQ ID NO: 82084 - DNA, 30 bp, Homo sapiens
  chr18:74023665-74023695
  hypo
gctctaagttttctccgcaggccctgcatg

SEQ ID NO: 82085 - DNA, 135 bp, Homo sapiens
  chr18:74062180-74062315
  hypo
tcacacctgagcctgcgccacgggtgtaggacgcccagcagcagcttctggagagcagagagccgggggagtggccacttcagagtggggccaggacagctggggccaccgccttcccggcgcaaggtgggccag

SEQ ID NO: 82086 - DNA, 39 bp, Homo sapiens
  chr18:74062539-74062578
  hypo
caggcccactctctgcgggcaccgcgtcctgctcacccg

SEQ ID NO: 82087 - DNA, 30 bp, Homo sapiens
  chr18:74063052-74063082
  hypo
gacggaacccatcctcgcaggcacttcatc

SEQ ID NO: 82088 - DNA, 88 bp, Homo sapiens; identical to SEQ ID NO: 45398
  chr18:74107215-74107303
  hypo

SEQ ID NO: 82089 - DNA, 30 bp, Homo sapiens
  chr18:74113912-74113942
  hypo
ctgcacatgcatgtgcgtgcctatgtgcat

SEQ ID NO: 82090 - DNA, 210 bp, Homo sapiens
  chr18:74114002-74114212
  hypo
gtgaccagtggtctctgcatcccacagggaggggagggcttctctgaaaagaaattgtatatgcacaagccttagccccgcgccttctatttgctgaagacatcgcctcggtcaacaccaatgaattcatttactctgtgaatacaaatcccgccagtggccacaacaatccctcttgctgagttcagcagtgaacgaggcacacactgg

SEQ ID NO: 82091 - DNA, 30 bp, Homo sapiens
  chr18:74195561-74195591
  hypo
gtctcagggcccagccgtctatcagaactg

SEQ ID NO: 82092 - DNA, 30 bp, Homo sapiens
  chr18:74196348-74196378
  hypo
aaacataaacaatcacgaaagcaaatgctt

SEQ ID NO: 82093 - DNA, 77 bp, Homo sapiens
  chr18:74206606-74206683
  hyper
ccttaataattgaagcggctcctcgggcccgcagccccatcacccaccttcattagccggagcgttttactttaaag

SEQ ID NO: 82094 - DNA, 285 bp, Homo sapiens
  chr18:74207730-74208015
  hyper
cgggggtcccaggtgcgtgtgcattacacacggcgtagcgtgtgcgtgtcactcaacttcctggtaaatgcctctgggggtgttcagatgcaggatcaatacattaagtcctgaatcaagggtcacagaggtcccgctggaaagacttcaaacagcggctctgccacccggccatttaaaaatgaaggggttgtttaccggtagcctcgaaagttcaactcttatttttctgttcttaaaacttcatttcttcacctcacctactccccacgagcagtagttagt

SEQ ID NO: 82095 - DNA, 107 bp, Homo sapiens
  chr18:74208293-74208400
  hyper
gtccaagacgcccaacgtggctccgcgtagcaatcagcgctgcaatcctggcggttacctcagcggcggcgtctctctctgcgcctcacactcgcagcccgcggccc

SEQ ID NO: 82096 - DNA, 30 bp, Homo sapiens
  chr18:74313492-74313522
  hypo
gagagttgagctgcacggcttacactgggc

SEQ ID NO: 82097 - DNA, 190 bp, Homo sapiens
  chr18:74325748-74325938
  hypo
tgaggttggggtgagcgcctcaccgagcctcagtttctcatctgtaaaatggacacctgtgcgcgcctcgcggcaggggctgctgagcacgcggatgggtcctctggaggctgggccgccaagaggcggcggctgcaccatctgatgctagagaacgagaaccgcagtgcgtgcccgacacaaagggaag

SEQ ID NO: 82098 - DNA, 46 bp, Homo sapiens
  chr18:74396499-74396545
  hypo
tcaggtgattgactccgtgcagcgatctccacgggtccttttgagg

SEQ ID NO: 82099 - DNA, 30 bp, Homo sapiens
  chr18:74399925-74399955
  hypo
aacggcccaacaggccgggcgcggtggctc

SEQ ID NO: 82100 - DNA, 30 bp, Homo sapiens
  chr18:74405452-74405482
  hypo
aagccaccttccacacgtaatcattaacat

SEQ ID NO: 82101 - DNA, 30 bp, Homo sapiens
  chr18:7444343-7444373
  hypo
ggggctggactgagacggtacacgcagcgg

SEQ ID NO: 82102 - DNA, 166 bp, Homo sapiens
  chr18:74495900-74496066
  hypo
caccacgcgcttctgcgggaggggctgggagctcccagatgccggtgcaggactccaggcgagggtgagccccaaccccagagctggccaggcccctcctggggcagggttcttgctcaccaaggcccaggctctcgggtgaacctaggaccgttgacgttaatgg

SEQ ID NO: 82103 - DNA, 30 bp, Homo sapiens; identical to SEQ ID NO: 45402
  chr18:74497491-74497521
  hypo

SEQ ID NO: 82104 - DNA, 222 bp, Homo sapiens
  chr18:74501045-74501267
  hypo
gaacccagccacccacgtgcccctccaggcccggacctgcctctcagcgcccagagctgcccctgcagtgccccgtgttccctccccagccacgcttgcggttggcgctccccacggtcccgacggggctttctcatgggatccatcaatgcgcagtttagacaccccaggctctcccgccctacacggagatgagaaaaaggttgatagaataaattacat

SEQ ID NO: 82105 - DNA, 654 bp, Homo sapiens
  chr18:74503878-74504532
  hypo
gcgatcagacagatccgccagggaatcaaggagtgccacccagggaagcaagatggttgctagaagagcggcagattggatggagcagggagttcgggtgtgacaggatgactgtggtgtggtggtaggacttcgacgtgtggacccccaggtatttggaaatgtaggtccggggcgcacctgagggctcaggactggaagtgcacttggggagccacggatgcgctcccagaagtgcgcccaagaggaacagtgtggggcctgagcaggcgggaagcttgaggagtgcccacccgcagggaatgggaaggacagcgcagcagcttgaggagaggacgctcagagagtgagcttcagaggaacacccagggtgtgaggcgcgcaacccaggcgtggcacagctgcatggaaacccggggcaaagtggcatgagcagctgccaggaagtccagagggctccgtggtaggcagacgttctgtgacggagcccacggcaggtgcaagtgtgagctgagacctgagtctgctaaggagaagtgaggacgcccctgataaggttttgaagctgaaggcgccacaggagtcttgatgatggggcaaacagtcctgggggtgggcgaggagagcacactcagcatgcgtgctggtaggagg

SEQ ID NO: 82106 - DNA, 35 bp, Homo sapiens
  chr18:74553356-74553391
  hypo
ctgtaataatatgagcgaaccgacactattaagga

SEQ ID NO: 82107 - DNA, 30 bp, Homo sapiens
  chr18:74606649-74606679
  hypo
aagcatgaggtcattcgatcccatctgctt

SEQ ID NO: 82108 - DNA, 30 bp, Homo sapiens; identical to SEQ ID NO: 45405
  chr18:74695927-74695957
  hypo

SEQ ID NO: 82109 - DNA, 38 bp, Homo sapiens
  chr18:74710319-74710357
  hypo
cgacatccacggcaccgtatgcgcggattgctttctgc

SEQ ID NO: 82110 - DNA, 30 bp, Homo sapiens
  chr18:74721760-74721790
  hypo
ggtcacccctggccccgatgggtgaggacc

SEQ ID NO: 82111 - DNA, 30 bp, Homo sapiens; identical to SEQ ID NO: 45406
  chr18:74755472-74755502
  hypo

SEQ ID NO: 82112 - DNA, 30 bp, Homo sapiens
  chr18:74756555-74756585
  hypo
gacgcaggtgccctccggtcacacccttcc

SEQ ID NO: 82113 - DNA, 30 bp, Homo sapiens
  chr18:74857784-74857814
  hypo
tgacactcaggggcccgtgtgagggccggg

SEQ ID NO: 82114 - DNA, 30 bp, Homo sapiens
  chr18:74867247-74867277
  hypo
ttctcgctcacagcccgcaagaaggggcca

SEQ ID NO: 82115 - DNA, 120 bp, Homo sapiens
  chr18:74870956-74871076
  hypo
tcactaacgaaggaacgcaggtactgcctggagctggggaggaaggacaggtcctccctcagagccttcagagggaaggcggcccttacacctgacctcagacctcgggcctccagaact

SEQ ID NO: 82116 - DNA, 43 bp, Homo sapiens
  chr18:74877173-74877216
  hypo
acccaacaggaatgccgtgaggattgcgcgagctcatattctg

SEQ ID NO: 82117 - DNA, 84 bp, Homo sapiens
  chr18:74884614-74884698
  hypo
aaaaaacccaaactgtcccgtgagtaaagcttttctctgagatgaccacaaacttccatctgcagcagacgtgctctttgtgcc

SEQ ID NO: 82118 - DNA, 17 bp, Homo sapiens
  chr18:74895202-74895219
  hypo
atcgagttctacacttc

SEQ ID NO: 82119 - DNA, 34 bp, Homo sapiens
  chr18:74906008-74906042
  hypo
ggtttgcggttcctgcgttcgtttgtataggata

SEQ ID NO: 82120 - DNA, 393 bp, Homo sapiens
  chr18:74961344-74961737
  hyper
ctatagagaagctcacgcggccctttccctttgcacttctctcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcagccccgccttcagcccgccgggcaggtccgcactccgcagaggcgagcgcgctccggttccagccgggaggtgggcggcgacccatccc

SEQ ID NO: 82121 - DNA, 218 bp, Homo sapiens
  chr18:74961738-74961956
  hyper
ctagaatccgtccagtctctgctcgcgcaccgtgacttctaaggggcgcggatttcagccgagctgttttcgcctctcagttgcagcagagaagcccctggcacccgactctatccaccaccaggaagcctcccaaaagagctctcgccctgtggacgactcggaatccctggaaaagccgggagggagtcggaggcgccagcccactggggaggtgg

SEQ ID NO: 82122 - DNA, 153 bp, Homo sapiens; identical to SEQ ID NO: 37078
  chr18:74962018-74962171
  hyper

SEQ ID NO: 82123 - DNA, 135 bp, Homo sapiens
  chr18:74962209-74962344
  hyper
cggaggcgcccgggaaggggaccccagtgctctcgagatcaccgtcccttcccgagaaggtccagctccgggctcccgaacccaccctctctcagaaggtcccggcgcaaagacggtgccaccaggcacggccac

SEQ ID NO: 82124 - DNA, 854 bp, Homo sapiens
  chr18:74962692-74963546
  hyper
gggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtgcacgccggtcgcggggccgagacgcgcgagggagggcggagggccggtgggggccctggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccc

SEQ ID NO: 82125 - DNA, 222 bp, Homo sapiens
  chr18:74963720-74963942
  hyper
cggggcggcccctctcccccggggtgcgcagtttgccctcgctccgaaggctttgcgcacaccgggctctgtgaagccgctgctcccggggacagagcctcgaattttattttattctgaagcttagctttgtaaacccaagtgcaaaagggtgtttctttacagagtcttgaccgcaggctccaggaacttggaatggaatggactcgagctttcggcttc

SEQ ID NO: 82126 - DNA, 168 bp, Homo sapiens
  chr18:75088086-75088254
  hypo
aagactcacgtggggcggggcggccacagtcaggatccgtagctccaagactggctgccccctttccattaaccttggacttgcagattcacagaagcccattccctgggctgcaagcgctgctcggtaacggcgcttgtttgcttcgtttcacggcggactccctag

SEQ ID NO: 82127 - DNA, 253 bp, Homo sapiens
  chr18:75229713-75229966
  hypo
caaatgatcatacaccgtctgcggcggcttttctgtgtccacaaagagaccctcccacaggcacatgcatgatgctgcttcccagtgagaaacttcggagagaagacaggaggagacgtggaatgtttcggggctagaaatgtccatttcttgaggtgtgtcgcgtgcgcgttttgacctcggactgcacatgtgcgcctccacccagggctggtcttcaacgggcaggacctggagacggggcgcaccgagg

SEQ ID NO: 82128 - DNA, 810 bp, Homo sapiens
  chr18:75230170-75230980
  hypo
ccagggcccatcccccgacgccatccccgccgagagagccagggtcttgggaccagggcccggacagcccctgcaggggttccgctctgcagagtgggcccttcggcggtccttaaattctttgcagtgaatgacccaagggaaggagggcgagcggggaaccacgaggctcggagctgagtggtggcctcaaggacccttccagaatgcgaatgaatatttactggaaagagaccattaacccaaagcaaccagaacgctttgaagagacaagatggattttcctttccgtggagggaagaagggctcgccgaggcagatgagttagcacgaaaaagagggcgtcgtcctttcgaatacgtttgactgaagaaagtctcaggcttatcaggtccatatcacacatattcatagattccttaacttttacgtcagaagcgaatccactttccttctttatgtcctttattattgtgaaatcaaaggactccgaaaggaaatttactcctgtgtttaaaactgaagtctagctcgtgcttctgaaatgacgcataaataattcaagcttgagagggaagaactggccacactttggaggcgccgagctggggaacctggtgtccgaagccaagctctgctcgggcccaggaggacgcagggacatcgcactgtcccccacgcctggcctgtgctcctttaatcttggtcctaatgatcgaattaaagagggatacaaatctttgtaaagaatctctgttagatgtctacatggttcagagaagcttctcaagtgaacgcagggcttcataa

SEQ ID NO: 82129 - DNA, 168 bp, Homo sapiens
  chr18:75339191-75339359
  hypo
attcttctgtgtgctcggggacacttgtagttttcctgtcctgtgagttgaggtccgttacatcccataacatgtgtgtccccattcacatctttccagctctctgaaaatcgccgggaaagttgggattgccccgcagcgtgggggtgatgccgctgcagcgcaggc

SEQ ID NO: 82130 - DNA, 312 bp, Homo sapiens
  chr18:75362784-75363096
  hyper
tttttgcaaattaaccgccgtactttccttcccaatgtttgtgtggagagcacacggttcctgcgtcaggaccctgcaggacgcgggccgaggctcccagctgccggccatgccctcggctcctctcccgacacgcgccagcactgccccctgctggcctcccgggagcactgcccgctgccgcggcgggaggagacccgggaagaagccgggaccgcgagcagctggacgctttctccctggggctcagccacacattttagtcacagttacagactacgggggatttgaagccttcgctttagtttttat

SEQ ID NO: 82131 - DNA, 30 bp, Homo sapiens
  chr18:75363596-75363626
  hypo
ccaggcagaggcagacgcagacgcagacgc

SEQ ID NO: 82132 - DNA, 42 bp, Homo sapiens
  chr18:75369603-75369645
  hypo
ccaggtggagaagcccggagcggccagcgcagatcagtgccc

SEQ ID NO: 82133 - DNA, 115 bp, Homo sapiens
  chr18:75455894-75456009
  hypo
ttataaaaatggttacgattgaagagacattacacaatgggtgtaataaatgttgaaaatcatgaggctgtgcacaacagttttattccatgagtggctccggaatttcagcaag

SEQ ID NO: 82134 - DNA, 30 bp, Homo sapiens
  chr18:75551271-75551301
  hypo
aaagttacagattgccgttgacacagtatt

SEQ ID NO: 82135 - DNA, 684 bp, Homo sapiens
  chr18:75611969-75612653
  hyper
tctccagctgagccccgaggaggccgctgctccgtgtcctggactctgagcaaagccgcgggccttagaccctccccagcctcaggcgagccccagtgccgacacctgctaagagacggtgcattgcgggctaaacccgcagacactgagcggggacgccacttccgacggcgtaaggcacctaaagtagccacagaggaaactgggggtgcaggagctgcaggagccccggcggcctgcaggggcggtggcgcggcgctgggcgcgcggccgctagatggcagcgcagccccggcccggcccgcgggaggcggccacgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgcatttttattttcctctaaatttcacacaggtgaagcctgtgtttgaatcactgagaggagattcaaatgaggttcctgacggggtagctgctccaaagaataccagtttcctctgcgaggagaatcgcgccccttggcaggaagccacagcccggccctgggacccgggttccaggtgcagacggcgctggctggggtgcgggatttcggagtcagattttt

SEQ ID NO: 82136 - DNA, 46 bp, Homo sapiens; identical to SEQ ID NO: 45410
  chr18:75617810-75617856
  hypo

SEQ ID NO: 82137 - DNA, 30 bp, Homo sapiens; identical to SEQ ID NO: 45411
  chr18:75631688-75631718
  hypo

SEQ ID NO: 82138 - DNA, 174 bp, Homo sapiens; identical to SEQ ID NO: 36888
  chr18:7566582-7566756
  hyper

SEQ ID NO: 82139 - DNA, 13 bp, Homo sapiens
  chr18:7566780-7566793
  hyper
cggcgtagagaag

SEQ ID NO: 82140 - DNA, 326 bp, Homo sapiens
  chr18:7567009-7567335
  hyper
aacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagcc

SEQ ID NO: 82141 - DNA, 789 bp, Homo sapiens
  chr18:7567750-7568539
  hyper
ggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagc

SEQ ID NO: 82142 - DNA, 178 bp, Homo sapiens
  chr18:7568540-7568718
  hyper
ggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtg

SEQ ID NO: 82143 - DNA, 111 bp, Homo sapiens
  chr18:75685755-75685866
  hypo
gctggtgctggatggcggctgcagatgcaggacccatctgccttttatatacgtgcctgatggaggcacacgccatggctctcctcccagaaatggcgcacagggcctgtg

SEQ ID NO: 82144 - DNA, 29 bp, Homo sapiens
  chr18:7568792-7568821
  hyper
cggagtcgggggtccggcgtgggggcgaa

SEQ ID NO: 82145 - DNA, 48 bp, Homo sapiens
  chr18:75688179-75688227
  hypo
ccaactgtcataggtcgacgaccttcatgcacgcgagataatagatac

SEQ ID NO: 82146 - DNA, 30 bp, Homo sapiens
  chr18:75690504-75690534
  hypo
ccatgaacttcctcccgtgttgcttctata

SEQ ID NO: 82147 - DNA, 30 bp, Homo sapiens
  chr18:75696322-75696352
  hypo
tgctcatccctcccccgcccggagcacttg

SEQ ID NO: 82148 - DNA, 37 bp, Homo sapiens
  chr18:75845486-75845523
  hypo
caggcttgggctgttcgtgaagcgggaaggagccccg

SEQ ID NO: 82149 - DNA, 163 bp, Homo sapiens
  chr18:75845747-75845910
  hypo
gagaaacagcacaggcgtcgtggccacgcgtccttccccagcctggcacagcaggccgtatgagtttatctgtaatatcaactacgatgttaactgttttatttatatgcagttttatcatacgagtccttaaaaggagattcactgtcgcctcagagcaccc

SEQ ID NO: 82150 - DNA, 52 bp, Homo sapiens
  chr18:75886360-75886412
  hypo
gagtgtgtttgcgcacgtgcgtgtgtgtctgagtgtgcgtgtgtgtgcgtgt

SEQ ID NO: 82151 - DNA, 30 bp, Homo sapiens
  chr18:75901015-75901045
  hypo
atgcacactcctgctcggagtcactctaat

SEQ ID NO: 82152 - DNA, 812 bp, Homo sapiens
  chr18:75998622-75999434
  hypo
tcacgtggtgtgtgtgtgtgtcgtgtgtcgtgtggcgtgtgccgtgcgtgtgcgcaccgtgggcgggaggcgagaggaagcgcagtgggagccgcgggcaggcggtcgcagaggggcctggggaggcgaagcagcccgggtgggggcgttcgctggaaacggggcccctctgaagggcgtgggcagccggtgcctgcagagcgtggagagctgcggccgcctcacctgacacaattgggcagcgatttctcaggtccaaagagcggaccccgtgggcactttcctgacggaggactcggctcctgggagctccggcaacatcagcgacagtggagcccggtctcaaaagaccgacccggcggcctgagaagaaggaaggaggccgaggcgccgcagggaccctggcacctgcccctgacgcaggagtggacgcgaagggtgggcctggggcggaggctcgggagcggcgcggaggtgggagttggcagctccaggccggcgcatgtggaggagaggagggggcccttccacgtgactccgaggttggagcccccctgactggggggcggacagcaggtgttcacagaaggcaggaagagctggaagctggggtgagccagctcatgcgggtttccgggggctgtgcaggtggaaccatctagatagctggggagtctcacacccagagcgttttagacccaaggtggccttcatggctcccacgaatcccttcacggtttagaagagatcagctcagcaacgacgaatgccttccctcagttgtgccaagggggcagcgccaggtctcctgg

SEQ ID NO: 82153 - DNA, 321 bp, Homo sapiens
  chr18:76073199-76073520
  hypo
gtgtgcacctgaggtcgccgccagagcaggggcacacttcagaggggaaggtcctcaggcccaggctcctggggacggcgtgtgtcctggctccaccctctgctggcggtgagaccatgcacaccgcaaaaccatggacgtcacaagaccacgcacacggtgagacaaggcaagagcataaacatagagagaccacagacgtggcgagaccacggacatggcgagaccacggacatggcgagaccacatgcaaggcaagaccacggacatggcaagactgcagacacagcgagactacgtacatggcgagaccacagacac

SEQ ID NO: 82154 - DNA, 200 bp, Homo sapiens
  chr18:76123694-76123894
  hypo
acacctgcccagctgcggccgaccccggggcgcacaccctccgggatgaagacggcacgcctgctgcgcacggtggctgtgctgtgctttccagagacaccaaagatccagcaagccccggtttgtgtcgagtgtcacgggaatggagatgccttaaggctccggcttggacggcctgttgttcgcgtgctgagtgcact

SEQ ID NO: 82155 - DNA, 30 bp, Homo sapiens
  chr18:76129420-76129450
  hypo
acctgtacactctcccgtgactctgccaca

SEQ ID NO: 82156 - DNA, 183 bp, Homo sapiens
  chr18:76161397-76161580
  hypo
gagaatacgtgtgttcgcggcgttcccgctaaaaccagaaaaaaaaaaaaaaaggagatgaagaagatggagcctggggcaagggagcttgcttggagaatattttccatggaagccaagggagcatccctctcccttttggaggcacgtcgaggccaattgacttgacgatgatttgctgtt

SEQ ID NO: 82157 - DNA, 79 bp, Homo sapiens
  chr18:76189793-76189872
  hypo
ggttgtgcatggtggcggcgaaggcacccagcgctgggaccccagcgaggcgacccggggccaccgggcaggcccaaga

SEQ ID NO: 82158 - DNA, 63 bp, Homo sapiens
  chr18:76190665-76190728
  hypo
gacgaggagagagggcgaagccaaacactggagaggaaaagttgagctcgtctccccggggag

SEQ ID NO: 82159 - DNA, 30 bp, Homo sapiens
  chr18:76206022-76206052
  hypo
ccagcaagcgagctccgcaatagacgagaa

SEQ ID NO: 82160 - DNA, 150 bp, Homo sapiens
  chr18:76210870-76211020
  hypo
acaaagcctgttactcgcctgcacacagccacacctatgcctgcggcgtatgagcctcccctgcaagacggccttcatgtgttggcccagcgtgggactggccaggtgacaccgtgggcagccctggaaccactccgcttccttcccaac

SEQ ID NO: 82161 - DNA, 277 bp, Homo sapiens
  chr18:76239446-76239723
  hypo
caacgcacagcagcacgagcactccacccgggttaaccagagtccggagtcagagaaataatttggtgtttcagggtcgcctgctgcagggcaatctccacacctgactgcggggtcacctgctgctgggcaatctccacacctgactgcggggtcgcctgctgcagggcaatctccacacctgactgcggggtcgcctgctgcagggcaatctccacacctgactgcgggggcttcccagacctccgcccactgtgccctccgcccaccgtgccct

SEQ ID NO: 82162 - DNA, 159 bp, Homo sapiens
  chr18:76412599-76412758
  hypo
ctgttagatcacgaccgtgagtagatgaggacaggcaggccagggaagaggaagcagcagaatcggccttgggcgaggtcggaaatttcacaaaggtgccgaggaaggcggcggctacttggactaagtttgtcggggactttcctgggttgcgcactg

SEQ ID NO: 82163 - DNA, 98 bp, Homo sapiens
  chr18:76415368-76415466
  hypo
tcccgggaaccccctcagtcccaggaaacccctcagtcccaggcaaatggtggagagcagggcaggtgtgttttgggtgccaccgtgggggatggggc

SEQ ID NO: 82164 - DNA, 32 bp, Homo sapiens
  chr18:76436423-76436455
  hypo
atcccacagcaaggccgcgcttctctaagact

SEQ ID NO: 82165 - DNA, 30 bp, Homo sapiens
  chr18:76463445-76463475
  hypo
cgccaggccacagggcgctccccggccctc

SEQ ID NO: 82166 - DNA, 158 bp, Homo sapiens; identical to SEQ ID NO: 45420
  chr18:76477472-76477630
  hypo

SEQ ID NO: 82167 - DNA, 74 bp, Homo sapiens; identical to SEQ ID NO: 45421
  chr18:76486799-76486873
  hypo

SEQ ID NO: 82168 - DNA, 215 bp, Homo sapiens; identical to SEQ ID NO: 45422
  chr18:76501459-76501674
  hypo

SEQ ID NO: 82169 - DNA, 30 bp, Homo sapiens
  chr18:76513376-76513406
  hypo
cacctctctaccaaccgtccactggtcagc

SEQ ID NO: 82170 - DNA, 30 bp, Homo sapiens
  chr18:76514550-76514580
  hypo
cctctcccattgcaacgccctcacccacag

SEQ ID NO: 82171 - DNA, 52 bp, Homo sapiens
  chr18:76540366-76540418
  hypo
gtccgaggccaggcacggtgtcgggtggccctggccacgccagaccttccag

SEQ ID NO: 82172 - DNA, 36 bp, Homo sapiens; identical to SEQ ID NO: 45424
  chr18:76541554-76541590
  hypo

SEQ ID NO: 82173 - DNA, 39 bp, Homo sapiens
  chr18:76557065-76557104
  hypo
ggcgggacggaagcgcgtcatcaccgaggctctcacagc

SEQ ID NO: 82174 - DNA, 143 bp, Homo sapiens
  chr18:76564557-76564700
  hypo
ctctttggaccctttcgagacagcacgggcaggggtctcctcctccacgctggccccaggactccgcctgtgctgtcctcatgccaatggcagccaggggcagagggaggctgcagggggctggccgccggcctgacgaggct

SEQ ID NO: 82175 - DNA, 16 bp, Homo sapiens
  chr18:76571588-76571604
  hypo
ccgctcatctcctgct

SEQ ID NO: 82176 - DNA, 143 bp, Homo sapiens
  chr18:76589501-76589644
  hypo
cgagtatccactgagcgtgagctatgtccagggtttgcaaacttcatcccgtctatctggttattccatcaaccggtacttactgggaccctgtcatgcagcagccatatttggttgtttcatttatttattttattttgaga

SEQ ID NO: 82177 - DNA, 159 bp, Homo sapiens; identical to SEQ ID NO: 45427
  chr18:76626246-76626405
  hypo

SEQ ID NO: 82178 - DNA, 248 bp, Homo sapiens
  chr18:76653442-76653690
  hypo
cacaccgcacaactccgtctacgtgaaacgcccagcgcaggcgtgccggcacatggggtgatgagcgtgctctaaaggtgatcgcggtgacagactgcataaatctaggattctgccaataccctgaattgtatactttcagtgggtgggccgtacggtgtgctaatttcgtctcaataaagctgttataaaaaacaaggaaggcgccctgctccttttcattccagccttgacggtgtgcatgttat

SEQ ID NO: 82179 - DNA, 346 bp, Homo sapiens
  chr18:76685490-76685836
  hypo
ggctctgtgctgtatcgtgcgtttcagtgtgcatgaaatatcttgtgcaatcatttacgtgaaattagagctagtaggaaaatgtatcgtcaggcgtggaagagcgcactgcaccttctttttacttgcgcgcacctgaggattgtctaaaatccaggcctcacgggactcccagagcccgtgctcgtcacagctgctggctacagaaacacagcctgcaaagtcggcctcaccgccagccagacgagcccagccagtttccacgagcaggggagggcacacccggaggccaccgtggaaagcagcctggctgccctcgggaagccacacgcggagccgccgcggc

SEQ ID NO: 82180 - DNA, 145 bp, Homo sapiens
  chr18:76686134-76686279
  hypo
cacgagacgctgcctcgggcgcgactccatttacttgaagtccagagcccgtaaatccgcgagacagacatggaggagcggcttaccaggtctggaagcagggaggggagtgagggactgctgaggggtgcgggtttcatgtggg

SEQ ID NO: 82181 - DNA, 41 bp, Homo sapiens
  chr18:76693984-76694025
  hypo
gacttctctgaaaagcgagcgttccacgttgcccggcaccc

SEQ ID NO: 82182 - DNA, 173 bp, Homo sapiens
  chr18:77043590-77043763
  hypo
tggagtgcacatttccggtaagatctgaaattaatgatgttgctatagtgacacatctgtggccaccagtgcatgaaacataaagcaattcattcgacaagcgtagacatctgtgaactgcaaggatgcagagcatattgacactgaccagaaatactcgacgccggctgata

SEQ ID NO: 82183 - DNA, 51 bp, Homo sapiens
  chr18:77143458-77143509
  hypo
ggggcacagggaacccgaaatgcggaaccctaagcacggtctgtgttggaa

SEQ ID NO: 82184 - DNA, 332 bp, Homo sapiens; identical to SEQ ID NO: 37085
  chr18:77153184-77153516
  hyper

SEQ ID NO: 82185 - DNA, 66 bp, Homo sapiens
  chr18:77156762-77156828
  hyper
ctctggcgccaagatcgcggtttgggggttctgcgccccccacccccaccccgagctcgtggcggc

SEQ ID NO: 82186 - DNA, 199 bp, Homo sapiens
  chr18:77159823-77160022
  hyper
ccgtcgggctgaaatcggggttcctagcgttggcggcctcgggctgggacctccccactcccggggctccgcagggcgcgcacgtggcgctcgggggtcaccgttgcagccgctttcccgaggaggcccggattgaaaacttctttaaaaaaaaaacttaaaaaaaaaattccgtcgccctgggcgcagccttaggtac

SEQ ID NO: 82187 - DNA, 56 bp, Homo sapiens
  chr18:77160605-77160661
  hyper
ggctacggcgggggacgctgcagtgcggggcgtcctgggctcggatgcggttcctc

SEQ ID NO: 82188 - DNA, 103 bp, Homo sapiens
  chr18:77167751-77167854
  hypo
tgatttattgacattactgttctctctccggtgcaggagactgcgtggctcccgtcctcttgagggcatttctttacgatggggaaggcgggactggggcctg

SEQ ID NO: 82189 - DNA, 167 bp, Homo sapiens
  chr18:77176557-77176724
  hypo
gtgtaaggtggtagccgtggggtcttccccgagcttcccgctgccatcacctcctgggaagacggatagcaaagaagccgagggtgtcgagttgccccatggtttgtaaaacactggcatgggctggaacggctcaggactgactgccactgcgtctccctgtaagc

SEQ ID NO: 82190 - DNA, 157 bp, Homo sapiens; identical to SEQ ID NO: 45431
  chr18:77181269-77181426
  hypo

SEQ ID NO: 82191 - DNA, 79 bp, Homo sapiens
  chr18:77181779-77181858
  hypo
agctcttggcagtgccgccaccatgggctgtgtcctgtccccgtggcgacatcacagctgagcgcgaagctggaagctt

SEQ ID NO: 82192 - DNA, 112 bp, Homo sapiens
  chr18:77185612-77185724
  hypo
ctgggcttctgctgccgagggcgcgattccgggattctcatcgttcaccggcggagtcggggcgactcatgaggagagtgttttcagatgctggggacgtggcctttctaag

SEQ ID NO: 82193 - DNA, 22 bp, Homo sapiens
  chr18:77185948-77185970
  hypo
cacctggaatcccagcgctttg

SEQ ID NO: 82194 - DNA, 35 bp, Homo sapiens
  chr18:77186431-77186466
  hypo
ccatgccgcttccaccgcagcgtgaggacagcagg

SEQ ID NO: 82195 - DNA, 30 bp, Homo sapiens
  chr18:77187147-77187177
  hypo
gtgtacccacgtgtccgatgtctctgtgcc

SEQ ID NO: 82196 - DNA, 50 bp, Homo sapiens
  chr18:77193378-77193428
  hypo
tcttagagaactggccgggccgtggccacaggtcacgatgagtaagcact

SEQ ID NO: 82197 - DNA, 42 bp, Homo sapiens
  chr18:77194936-77194978
  hypo
cgggagacacctgagcgcacagtggcccgtttgacatttaaa

SEQ ID NO: 82198 - DNA, 567 bp, Homo sapiens
  chr18:77201923-77202490
  hypo
ttcagccaaagtgagcgtggccgtctcttctctgggcgcttccaggtgcgttggggcccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggcccacaggtgtggccgggcggcctttctcctccccacctctgtccaccctcgccgaggcgtcggtcctgctgagcagcctctgctgccttcgtgcaggtgacagcgcacgtgccattcacgggcgccatgtctccaagaagaggggctcctgccgcgtgcctgttctggggttgccactcaacatccttccagcaccttctctgggcttccggtttgaatgatct

SEQ ID NO: 82199 - DNA, 74 bp, Homo sapiens
  chr18:77203641-77203715
  hypo
gcccagcctctgcctcggttcctgccgggcacatggacgcttcccttgaatccttctgccgacggcatctgtgg

SEQ ID NO: 82200 - DNA, 284 bp, Homo sapiens
  chr18:77205447-77205731
  hypo
cccagccctgagagacgcaccacggccttcacctggaagtgtcacctctggctgctgttgtgggtgatgaggattccagggctgagaagaggaccctagacgctgttcacacagcgtggcaatctctcaaattaatccagcatggggggaatcggggttgaaaccggtttgtgagccggattttctgtccctgtgtacttccttggggcaatttgaaaaatgcagattttactcgtaggccctaaatggataatttccctttaggctgacggctgctcctgtgc

SEQ ID NO: 82201 - DNA, 205 bp, Homo sapiens
  chr18:77209940-77210145
  hypo
actgggaggaatgtacgcacctgggaattcattccaaatccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgc

SEQ ID NO: 82202 - DNA, 41 bp, Homo sapiens
  chr18:77216863-77216904
  hypo
aattcccagctccagcgtccgcggcacgggcagcctccctg

SEQ ID NO: 82203 - DNA, 57 bp, Homo sapiens
  chr18:77221921-77221978
  hypo
cgtggctcctggactcgcgattggccacagcctgttagcgggcggtgcatgtgtgcg

SEQ ID NO: 82204 - DNA, 135 bp, Homo sapiens
  chr18:77227605-77227740
  hypo
agccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaag

SEQ ID NO: 82205 - DNA, 30 bp, Homo sapiens
  chr18:77228944-77228974
  hypo
tggggaagggcctcacgctctgggaccccc

SEQ ID NO: 82206 - DNA, 76 bp, Homo sapiens
  chr18:77229422-77229498
  hypo
acaggtgggaggtggcggcccccaggaccgtggccacagcatgaagccggtggggctgagccgctcctgctacctc

SEQ ID NO: 82207 - DNA, 56 bp, Homo sapiens
  chr18:77230030-77230086
  hypo
tccgtcccgcgtgcccgctgcacttcctgcctctgcaaccccggctgggtctgagg

SEQ ID NO: 82208 - DNA, 631 bp, Homo sapiens
  chr18:77236039-77236670
  hypo
gatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaggccccacttgcgcttcccctcgctgccgtgctgtcctggccccgtcgctgccacctgagacccccatcaagtacctgagctctgcgtctgttttcacgcttctgtatgtgtaggaagccccccaccgatgttgctcggggtcgacgtgataaacctgag

SEQ ID NO: 82209 - DNA, 156 bp, Homo sapiens
  chr18:77239886-77240042
  hypo
tgggatggcacaagacgccgctgccagggctgagaaaccatccggccaaccccagacttgagccagacttcatgggcaaggctgggagaagccgcgtggagaccccagcccagggaggggcactgtggcaggaacagggcccgcacctgcagggtc

SEQ ID NO: 82210 - DNA, 43 bp, Homo sapiens
  chr18:77240573-77240616
  hypo
gtggctggagagatgcgggggttaatgccggtaccaccgcggt

SEQ ID NO: 82211 - DNA, 519 bp, Homo sapiens
  chr18:77246353-77246872
  hypo
gctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaattt

SEQ ID NO: 82212 - DNA, 58 bp, Homo sapiens
  chr18:77247301-77247359
  hypo
accggcctctgcagtcggggcatcgtgggtgccgcctgagtcccgtgaatggtttgta

SEQ ID NO: 82213 - DNA, 43 bp, Homo sapiens
  chr18:77250896-77250939
  hypo
gggcctgggttatgtcgggaaagcctcacgcaggctgaagacc

SEQ ID NO: 82214 - DNA, 36 bp, Homo sapiens
  chr18:77255748-77255784
  hypo
tgaacagtggtaaggcgttcgcgagtcattgtaacg

SEQ ID NO: 82215 - DNA, 89 bp, Homo sapiens
  chr18:77271000-77271089
  hypo
gggagtggtcgctggcgaggcctggcgtgggcccgcggtgtctgtcagggtgccctgggccagccccgctgattcgatttagagctaac

SEQ ID NO: 82216 - DNA, 448 bp, Homo sapiens
  chr18:77271863-77272311
  hypo
ggagttggcaggattcggggcttctgggggaggccaggaacagagggcggcacgggcctggggagagcaggaagctgtgtgctggctctcaggagcccagtggatgggacgcagctgagacgtccgcagccatcccaggatgcgcaggtggcgggagcacgcggggcacaggagcctgtcccggcaatggctccttgtctccggcccaagcgacccctggcatggcggacagagaggcccaggaggagccggcctcagggaggatggcttgaggagacaagccccaggacgcagcctgaccccaggacacggcctcgccccaggacacggcctcaccccaggacacggcctcgccccaggacactggcgagtgtttggactttgttgaaactgcgccacaggcactgccctgggaggtaaataaacggaaaagcgtctgactgcagca

SEQ ID NO: 82217 - DNA, 325 bp, Homo sapiens
  chr18:77272937-77273262
  hypo
ccacccacaccaaatcgccttccgtacccacctggctcatgtgcctataagatgggagagggcctggcagagaatttcgctagagacgcagggagttgtatctgccatgtttttaaagagcgctttaaaaacggtatcactttcgaacgctcggctctcaataaaaaggagcactgccagtattttaattcctctctcgatacccagaaccaccaccaggctgtgtcaactcccgtcggcgtagagcagctgatgcccgcgggtggactccgggttcagggcactgggaccgctgcagagacgccgtccccggcccccacctgta

SEQ ID NO: 82218 - DNA, 244 bp, Homo sapiens; identical to SEQ ID NO: 45446
  chr18:77285870-77286114
  hypo

SEQ ID NO: 82219 - DNA, 202 bp, Homo sapiens
  chr18:77288237-77288439
  hypo
tcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggctt

SEQ ID NO: 82220 - DNA, 30 bp, Homo sapiens
  chr18:77289162-77289192
  hypo
gccgcgtcccacctgcggctgggtaccctg

SEQ ID NO: 82221 - DNA, 212 bp, Homo sapiens
  chr18:77290787-77290999
  hypo
accttagggatggggcgttttctgagactcagccagaggcaaagcagccgcatctgcgcgtaagatcacgtttgctttgctcctgagcagagactgggtggcacaaaagtaatatgagtatcaagtttcccctcagagccaagtggagcccaggaaagacccaagtgcttgagcttccggccctggcaagggcatctcgttatatggacagc

SEQ ID NO: 82222 - DNA, 30 bp, Homo sapiens
  chr18:77305341-77305371
  hypo
ccctgctgttcctgccgccccgagctggag

SEQ ID NO: 82223 - DNA, 207 bp, Homo sapiens
  chr18:77307603-77307810
  hypo
acggctctttcccagcgggcgcctccgcacccagcaaaccaggcccatccagaacggcagcacaggcgcctggctccagcggaggcggccctgagcagtgagccctgtgccccactccacaggagggctggccccagagcgcgggcggcccgctaggagccacacagccgacgcctcgggctgggcatggagcggggtctgtctgtc

SEQ ID NO: 82224 - DNA, 241 bp, Homo sapiens
  chr18:77308327-77308568
  hypo
tgcccggcaggaccacgagacgtccgctgagcacgatgtctacctggcattcaaggtaagtcatcaagcgccccccggttaggctggacgtgtctgtgagggttccggatgagcctggcattgggatgagccaggccggctgcggtttgactcagtgagggaagaggcctggcttgggacaggaggaagctgcgttccagcctcaggggagcctccttcccctggccgcctccttccgcac

SEQ ID NO: 82225 - DNA, 201 bp, Homo sapiens
  chr18:77309533-77309734
  hypo
cagacccaaggcatccgaggtgcccactgcatgcggggtttattacgtgttgccaggggcgctggttattttattttgcttctggttttgctctgccagccgcttgtctcctgaattctctgactttttctcagcacctctgctgggacctgcccaggagctcgggcagatgggttccgccagcggcgccaactcccacgg

SEQ ID NO: 82226 - DNA, 136 bp, Homo sapiens
  chr18:77312103-77312239
  hypo
gggaaggcaggcatcctccctcccctgaggccgcagccggtgctgagctctgcggggaagccgtctcagcctccctccagcctccctgggcctggcgctgcttcgctgtctctgcctccgtcgtgtggtgtctgtg

SEQ ID NO: 82227 - DNA, 49 bp, Homo sapiens
  chr18:77312878-77312927
  hypo
caacgcggcggcatgcggctgcagccactgggaacgagcctggctttgg

SEQ ID NO: 82228 - DNA, 149 bp, Homo sapiens
  chr18:77313872-77314021
  hypo
acagcaccggcctcccgctcccgttcccgcaccctgaggacgcgctggctgattgtggcacgcgtgccttccgagcccagatgtcccttcctgacacgccggcagcagccaccgcggattgttggcctctttgccgttctgccttaagc

SEQ ID NO: 82229 - DNA, 32 bp, Homo sapiens
  chr18:77315506-77315538
  hypo
tctaccttcctcatccgcggggtcaggggtca

SEQ ID NO: 82230 - DNA, 30 bp, Homo sapiens
  chr18:77315989-77316019
  hypo
gctctggagtggaggcgcagaggggctgag

SEQ ID NO: 82231 - DNA, 212 bp, Homo sapiens
  chr18:77320311-77320523
  hypo
tctgatgatgccacacgtatgatcatcccgggaccacattctcacagcaaggagagggaagaacacaatattccctgccgagaataagatgcctcttcatgatggcaagcctggtaacttggcaattaatcctcggtgccaggaatcctcatgccgagagggacagatgctcctttgtttggctcccggcactcagtcgacacctctggtta

SEQ ID NO: 82232 - DNA, 373 bp, Homo sapiens
  chr18:77329644-77330017
  hypo
ggtgaggtttcgctacggtgctcagcagatttagataacatggtgtctgagtccagtagtacatgctctcaccttcactgtctcagtacaacaggacacgctctcaccttcaccatctgggtacagcaagacacgccctcacctttaccgtctcagtacagcaggacacactctcaccttcaccgtctcagcgcagcgggacacgccatcaccttcaccgtctgagtgcagcaggacacgccctcaccttcaccgtctcagtacagcaggacacactctcaccttcactgtctcagtatagcggtccacgccctcaccttcaccgtctcagtacagccaaacacgccctcaccttcaccgtctcagtacagca

SEQ ID NO: 82233 - DNA, 30 bp, Homo sapiens
  chr18:77331718-77331748
  hypo
aaaggccaagcgaggcgggtgtgcgtgcag

SEQ ID NO: 82234 - DNA, 30 bp, Homo sapiens
  chr18:77339091-77339121
  hypo
atgtgcacacagctccgtggccagcgctgg

SEQ ID NO: 82235 - DNA, 30 bp, Homo sapiens
  chr18:77345226-77345256
  hypo
aggccagtggtgtaccgggtggtccaatcg

SEQ ID NO: 82236 - DNA, 34 bp, Homo sapiens
  chr18:77346594-77346628
  hypo
gtggtggggggaaggcgtgcggagccgtagcact

SEQ ID NO: 82237 - DNA, 139 bp, Homo sapiens
  chr18:77357869-77358008
  hypo
ggcaccacccatgcccgggcactgacagcgggtggctcgcagtgaacccagcatcgcctccatggcctgtcatcatcgggactctgccgcaagtgaagacgtgcttgtgtcccagggtacaagccgccaaagccccaga

SEQ ID NO: 82238 - DNA, 30 bp, Homo sapiens
  chr18:77363914-77363944
  hypo
ttctcccacaggcagcggcagagactccct

SEQ ID NO: 82239 - DNA, 261 bp, Homo sapiens; identical to SEQ ID NO: 45454
  chr18:77364366-77364627
  hypo

SEQ ID NO: 82240 - DNA, 35 bp, Homo sapiens
  chr18:77364942-77364977
  hypo
cactgctgatagatgcgcacacacacgtgtgcaca

SEQ ID NO: 82241 - DNA, 35 bp, Homo sapiens
  chr18:77365157-77365192
  hypo
cacatgcacacacatacacacgtgtgcacacacaa

SEQ ID NO: 82242 - DNA, 154 bp, Homo sapiens
  chr18:77365670-77365824
  hypo
cccctcgccggctcccgagctcgtgccttggcttccccactgggtctgcgctcctctgtgtgctggggctcccacacccagtctgcgttccccgccaggtctacgttccccgccaggtctgcgttccctgccaggtctacgttccctgccaggt

SEQ ID NO: 82243 - DNA, 78 bp, Homo sapiens
  chr18:77371430-77371508
  hypo
caggctggcatgtcacggctgtggctacgacgccgaggaagcaaactgacaccgctgcccccacgcccctgtgccctt

SEQ ID NO: 82244 - DNA, 30 bp, Homo sapiens
  chr18:77393026-77393056
  hypo
cactccaggcaagaacgggacttcactgct

SEQ ID NO: 82245 - DNA, 178 bp, Homo sapiens
  chr18:77410020-77410198
  hypo
cctagaagcttttggcggtgtgtgcgcgtgggctcagggctcgtgaccctctgttccggcccacgcttctgaccggtgattagaaagcggcacgttctatcctcggccctgtcagccctgcagggcgcaccagctgctctcacgggccacagaatcacagatgcggtcctcacctctc

SEQ ID NO: 82246 - DNA, 32 bp, Homo sapiens
  chr18:77417240-77417272
  hypo
cctctgactccggaccgcgttgttcagttggc

SEQ ID NO: 82247 - DNA, 30 bp, Homo sapiens
  chr18:77502354-77502384
  hypo
ccatcacaccacagccgcttctcctcagag

SEQ ID NO: 82248 - DNA, 47 bp, Homo sapiens
  chr18:77508899-77508946
  hypo
tgtctgtgtgtgagccgtgtctgtgtgtgagccgtgttggtgcatgt

SEQ ID NO: 82249 - DNA, 335 bp, Homo sapiens
  chr18:77509344-77509679
  hypo
tcagtgcccctgatacgtccaacccagcgtcgctgtgagggagtcaaccacacctgccagcacccccgagtctggccccactaggaggggccagggctcccttgagcaaggcatcagcacacaggcagggagccgggcaccagactgtgagggtcgcgccccgtgcacacgagatccaggcccgccccctcctggacttggtgaccgtcccgagctcgacctgagagggcacttcggctctcctgttcacagtcatgactgccccctccccgaggtcagcgccatgcactgctctgggggcctgaaacaccgcctctgttcgcaagggtctcctg

SEQ ID NO: 82250 - DNA, 58 bp, Homo sapiens
  chr18:77531551-77531609
  hypo
gtcctcccatggacccggctctcaggctgccctcagtccccggcgtcccaagcccgtg

SEQ ID NO: 82251 - DNA, 48 bp, Homo sapiens
  chr18:77532151-77532199
  hypo
accaggccccgaaggcggcagctcccacggcctcgtccatttctaaaa

SEQ ID NO: 82252 - DNA, 77 bp, Homo sapiens
  chr18:77533370-77533447
  hypo
cctgctatctgcaggcgacatcacgtgtaaaacgcattcgtttttggttttgatgaacccttcggctgtccttttcc

SEQ ID NO: 82253 - DNA, 71 bp, Homo sapiens
  chr18:77534949-77535020
  hypo
ggaggtgtcccgcaccgttcccgtcgcatgatctcacgcgtggagtcaacagaagtcgaactcaggcagga

SEQ ID NO: 82254 - DNA, 46 bp, Homo sapiens; identical to SEQ ID NO: 45460
  chr18:77542905-77542951
  hypo

SEQ ID NO: 82255 - DNA, 155 bp, Homo sapiens
  chr18:77543221-77543376
  hypo
ctcccgtgccatccccgtgagctccgcctggccctgctgctcccgcccggaaagctcagacccataacccagcccacttggcagcagcgtgccgcctgatcggcaaggtttactccctttgaaaatctctgttgggtggccgggcgcggtggctc

SEQ ID NO: 82256 - DNA, 124 bp, Homo sapiens
  chr18:77543700-77543824
  hypo
ttgggcacatctaaacgcacccaagcttcctaccgcacgtctctgcgaggagccgggtctccgaggcatggctcctgtagtacccaggagtccacgtgtcacgggcgtgcgtggtgctaagctc

SEQ ID NO: 82257 - DNA, 147 bp, Homo sapiens
  chr18:77544654-77544801
  hypo
acctctcgccggggccggtcccccatagggtgtggatgacagacgcagccctgcccttggctgctgtgcacgccatgcctccctgcgtggtcacgcctgtcacctgtctctgtgccgtctcccacacggtcacgcctgtcacctgtc

SEQ ID NO: 82258 - DNA, 217 bp, Homo sapiens
  chr18:77547831-77548048
  hyper
tttattttagtcctccgcgaaggagcctctcaaatattcccggagcacaggctaatttagaacgtgttatcctgacaaggcggcccagccagggaggagacgccggggtccgcgccgcggggcgggcgcttccccggacccgggggaggcgggacgcaggcgaaggccgccccgggagagcggggtcccgggagagcggggtcccggctgtggggga

SEQ ID NO: 82259 - DNA, 258 bp, Homo sapiens; identical to SEQ ID NO: 1347
  chr18:77548351-77548609
  hyper

SEQ ID NO: 82260 - DNA, 470 bp, Homo sapiens
  chr18:77549960-77550430
  hypo
tgccaaggaaggggacgtccgtgcccctccttgtcccggggagcacggctccatggcgcccgctgtggagctgcggttctcaccatgggcaggtgcgaggccgtagactggtgtggtcagaccaggggactcctgcgttcaccctgggccccggagactagtgatcccgctccccagcagagcaccgccaaaagccccgggtgccggagctgtcctgcaagaatgaacgggcaggagacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcatatgtttaaaagatgagcacacaaaggactgtgcacctgccgcggagtggcgtcctctgggagaa

SEQ ID NO: 82261 - DNA, 83 bp, Homo sapiens
  chr18:77557808-77557891
  hyper
ggctccaaacccagccgagggtcggctcgctcctggggacccgcggatgtcgcgagggggcgccgcgccactgaaggctggga

SEQ ID NO: 82262 - DNA, 485 bp, Homo sapiens; identical to SEQ ID NO: 37090
  chr18:77557912-77558397
  hyper

SEQ ID NO: 82263 - DNA, 833 bp, Homo sapiens
  chr18:77558416-77559249
  hyper
cgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaataatggattttgacccagctgggagatctcagagtgattaagtggagaggctgttccaccctcagccctgcccaggcagctgggtgaccccgcgggccacatgccac

SEQ ID NO: 82264 - DNA, 25 bp, Homo sapiens
  chr18:77569611-77569636
  hypo
ccagagtcctcgccctgaggagctg

SEQ ID NO: 82265 - DNA, 256 bp, Homo sapiens
  chr18:77576934-77577190
  hypo
atggcctgaaaggcacggctgtcacatggctgtcacaaggctgccactcacatgcctgtcacatggttgtcacacggctgccacacggttgtcacgcagctgccacatggatgttacacggctgtcatacagctgtcacacggctgccactcacatgcctgtcacgtttgtcacacggctgccacatggctgtcacgcagctgccacatggatgttacacggctgtcatacagctgtcacacggctgccactcaca

SEQ ID NO: 82266 - DNA, 47 bp, Homo sapiens
  chr18:77578855-77578902
  hypo
gccaccagaagcacccggcagccatgaagagccgaaggtccgcaggt

SEQ ID NO: 82267 - DNA, 30 bp, Homo sapiens
  chr18:77582757-77582787
  hypo
gactggagcctgctgcgtgtggctcttcta

SEQ ID NO: 82268 - DNA, 30 bp, Homo sapiens
  chr18:77605211-77605241
  hypo
atgacaatattatgacgatgaagaacagat

SEQ ID NO: 82269 - DNA, 92 bp, Homo sapiens
  chr18:77609586-77609678
  hypo
ggcggtaaagacaaccgttgtttcttagctgtcgtggtttctgagggcccagcgcggacgcttgcctttctctgctgcgtgaagtctgggcc

SEQ ID NO: 82270 - DNA, 40 bp, Homo sapiens; identical to SEQ ID NO: 45467
  chr18:77612204-77612244
  hypo

SEQ ID NO: 82271 - DNA, 30 bp, Homo sapiens
  chr18:77612868-77612898
  hypo
gtacaaagcaatgtccgtgtggggatgcag

SEQ ID NO: 82272 - DNA, 222 bp, Homo sapiens
  chr18:77622385-77622607
  hypo
atatagattcttaaacgtctggaatgaaaactgaaacttgtttttgcagatgggctctgcgtgtcttggagcaaccttcagcactcatccaggctggtcaagcctctgtcttatcacctcctgctcgcagaatctgaaggtcagcccgaggaggcacttcagggacttctcgggtttttcccggcatgtgcgcagccgaggcgtgtgcgtggcattccagat

SEQ ID NO: 82273 - DNA, 52 bp, Homo sapiens
  chr18:77627776-77627828
  hypo
gggcacccctcccctcggcaccggcctccctggactgcgtggagacccctcc

SEQ ID NO: 82274 - DNA, 136 bp, Homo sapiens
  chr18:77628334-77628470
  hypo
ccgtgtccgagcgtccggttaagaagcagtcgccctccgcgtggggcctggtgacccgtgtccaagcgtccggttaagaagcagtcgccctctgcatggggcctggtgacccgtgtccgagcgttgcagctgctgc

SEQ ID NO: 82275 - DNA, 124 bp, Homo sapiens
  chr18:77628901-77629025
  hypo
ctgtttgtcaggacacgagttcttgagaactaggagtcggtgttactgacagaatgtgagctctctgatgggatgtgtgcgggaggctgagtccagccaccacacgggtcggcttccacagggt

SEQ ID NO: 82276 - DNA, 56 bp, Homo sapiens
  chr18:77631027-77631083
  hypo
tccaaagaccagcaccgagagaccagagctgtggtttccgtcgagcctgaggcagg

SEQ ID NO: 82277 - DNA, 218 bp, Homo sapiens
  chr18:77631760-77631978
  hypo
gcggtgcagaggggccggcatcacatcctaacccagaggccacaggcctgagcaaagctgcggctgctctttaccagggaggcaggtgccagtcagcagcgtctgccactgcgacattggcagcaaattcctgccagcaccgagtgaggacccgcagcagatgtgtcaccagggccagctgctctggggccgcacaatgccaccggaccaagctctgg

SEQ ID NO: 82278 - DNA, 44 bp, Homo sapiens
  chr18:77635572-77635616
  hypo
gaaagagatcactcccgtcccaccctacacggtggcaccacaga

SEQ ID NO: 82279 - DNA, 30 bp, Homo sapiens
  chr18:77635848-77635878
  hypo
ctcagtgtctgcccccgatccccaatgccc

SEQ ID NO: 82280 - DNA, 40 bp, Homo sapiens; identical to SEQ ID NO: 45473
  chr18:77636150-77636190
  hypo

SEQ ID NO: 82281 - DNA, 265 bp, Homo sapiens
  chr18:77636534-77636799
  hypo
actcgtgacttggaacgattctgtcccgggaaggatgccctcttctgcatccacaggcagtggtgccctctgcgagcagcttgctcacctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccgggccaccaactccgtgtccttcttgca

SEQ ID NO: 82282 - DNA, 217 bp, Homo sapiens
  chr18:77644664-77644881
  hypo
ggtttccaaagagaccggacacgcccaaggcccacagacacgtggcttcgtgatggggagccacgggggcaggggtccgcccggctctgtgttcctcgggggggctcatcctggggcccaggaactcgggagcggtttacccacaggttcctgtgcgtgggagcaaacttgcttttcccattcacagaaacacagtagcgtgcgcgggtcggtgatg

SEQ ID NO: 82283 - DNA, 36 bp, Homo sapiens
  chr18:77664997-77665033
  hypo
tgggcacctgggtgccgtagccgccctgtgtgagag

SEQ ID NO: 82284 - DNA, 30 bp, Homo sapiens
  chr18:77685415-77685445
  hypo
tgtgtttctagagagcggcaccaaagataa

SEQ ID NO: 82285 - DNA, 32 bp, Homo sapiens
  chr18:77713122-77713154
  hypo
ctgcccctgctcagccgcgccctagcctgagc

SEQ ID NO: 82286 - DNA, 16 bp, Homo sapiens
  chr18:77718382-77718398
  hypo
gcgcccggccaacctc

SEQ ID NO: 82287 - DNA, 24 bp, Homo sapiens
  chr18:77725938-77725962
  hypo
ttttattttttgagacggagtgtc

SEQ ID NO: 82288 - DNA, 16 bp, Homo sapiens
  chr18:77728894-77728910
  hypo
gattcagaagccaggc

SEQ ID NO: 82289 - DNA, 30 bp, Homo sapiens
  chr18:77795658-77795688
  hypo
actctgggagaaagtcgctgtgtgcagccc

SEQ ID NO: 82290 - DNA, 30 bp, Homo sapiens
  chr18:77809156-77809186
  hypo
ggccttccctgggagcgggttagggacacg

SEQ ID NO: 82291 - DNA, 171 bp, Homo sapiens
  chr18:78004571-78004742
  hyper
gggccgggggagagccgggtgcgtgctctgggtctgcgcgggggagcgcgcctggtgcctagatgtttggtaccgagcgggtgggggacgccgggctcggagccggcggcaagtctcctcctggcaggtaacaagcctcctttgcagccttgaaggcgccttggccagggc

SEQ ID NO: 82292 - DNA, 78 bp, Homo sapiens
  chr18:78005084-78005162
  hyper
tccccctccgcggggcgccccattcattagccaggagactgggcgcagggccgccggggcgggcggggggcttacctt

SEQ ID NO: 82293 - DNA, 98 bp, Homo sapiens
  chr18:78005567-78005665
  hyper
cccacgctgcagctccgcgtcggatcgccagtgggtgcgcgccctcctgtccacaatcccagagcctggggaaaggagcatcgcggccagcccaaggc

SEQ ID NO: 82294 - DNA, 53 bp, Homo sapiens
  chr18:812816-812869
  hyper
ctgtttgcttctcagcgctacgcttccgcaccctttgtcgttggtagtaaaat

SEQ ID NO: 82295 - DNA, 36 bp, Homo sapiens
  chr18:8261957-8261993
  hypo
agaaaggatagtgaacgtgcccgtgtgccagcatct

SEQ ID NO: 82296 - DNA, 30 bp, Homo sapiens
  chr18:8390038-8390068
  hypo
gtcttcaacagctgccgaaagtattaggtg

SEQ ID NO: 82297 - DNA, 97 bp, Homo sapiens; identical to SEQ ID NO: 45326
  chr18:8570976-8571073
  hypo

SEQ ID NO: 82298 - DNA, 116 bp, Homo sapiens
  chr18:8608722-8608838
  hyper
ctctgagtgagacagcgatcagagttaaaaataactgatttcgcgcgtttccgtgcaaaatgggagacagacgtgacggagagagaccgagcagtgccacggcccggtagagggtg

SEQ ID NO: 82299 - DNA, 81 bp, Homo sapiens; identical to SEQ ID NO: 36894
  chr18:8608901-8608982
  hyper

SEQ ID NO: 82300 - DNA, 78 bp, Homo sapiens
  chr18:8612204-8612282
  hypo
ggagcacagtgaaagcgcctccagtcgaggctagtgatgaggcctggtcagagaaggcttcctcgtcattggaatgtt

SEQ ID NO: 82301 - DNA, 30 bp, Homo sapiens
  chr18:8658999-8659029
  hypo
agggggcagagggagcggtaggaagagagg

SEQ ID NO: 82302 - DNA, 40 bp, Homo sapiens
  chr18:8659257-8659297
  hypo
agtggcagctgaagacgggctggcccgagaggcagcgccc

SEQ ID NO: 82303 - DNA, 30 bp, Homo sapiens
  chr18:8663049-8663079
  hypo
gtcccctgtcatctgcgagctgcgctatgg

SEQ ID NO: 82304 - DNA, 200 bp, Homo sapiens
  chr18:8706608-8706808
  hyper
ggagcccagcctgggcgagcagtctcggctcgtgccagcggcggaggaagaagagctgctgcgggagatggaggagctgcgctcggagaacgactatctcaaggtgagccgcgcctcggccgcaggtgtcccggggcgcccccggagggcctggctgcggcggggacccgccaacccctccttcccgggcctgtccagcg

SEQ ID NO: 82305 - DNA, 84 bp, Homo sapiens
  chr18:8779033-8779117
  hypo
aatggtggaatggagcgccctgggaactgcaggcccgcaaccaaaacccaaaggaagctggcgccccggcgcaaggtaggcacg

SEQ ID NO: 82306 - DNA, 45 bp, Homo sapiens
  chr18:8823136-8823181
  hypo
ccaccatactctcttcgttccacctgcaagcgcctacacatgctc

SEQ ID NO: 82307 - DNA, 40 bp, Homo sapiens; identical to SEQ ID NO: 16294
  chr18:8845133-8845173
  hypo

SEQ ID NO: 82308 - DNA, 174 bp, Homo sapiens
  chr18:903670-903844
  hyper
atttaggcgatgaatcgccacgttaatagcactactgccaaatcttcaaatttagaggctctggtgaaaaattaaaccggtggcaattttcaacgtttgtagcatctgttaccctacacttcagcacccggagtctggacagctccgcaggccgcgctccggaggcagcatgag

SEQ ID NO: 82309 - DNA, 504 bp, Homo sapiens
  chr18:904374-904878
  hyper
ttcatgaataaaaatcggagcgcaacagtgcaacaaaatattctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccgccgaccctcgcggctgcctggcccgcggctcctacaaaggcgggctagccgcccgccctctcccttgccttcctccccttcttttctgactttccctctttcccttaatcgcctgcttcttcctccgggtggacttacggccaccttgctcctccgcgcttcacctcatcgccccctctttctttcttctgcctctctctctgcgcccccttctctccgtgtcacgctccctcctggttctgcgcgtctacaaacttttgagcagaacac

SEQ ID NO: 82310 - DNA, 6 bp, Homo sapiens
  chr18:904879-904885
  hyper
agcctc

SEQ ID NO: 82311 - DNA, 730 bp, Homo sapiens
  chr18:904886-905616
  hyper
gcaaacgagtcccgcagctcctcctgctgctcccgctggttcctgcggcttctgctcagacaccaacgccagacggcgatgcctctcgggtggtgactccagcgcaggaacttgaagaagcgctttgcccgccgtcctacctggcagctctcctggcagcgggaggagttgaagggtaagggagggaaaatcttaccaaagcgaccggctcactcgactgctgattctttcgcttggcatcgcgtcaggggagttagctttccttcagccgggtctggctagttattgggcgccgggtagatgcatatatatatatttttttctaactatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagaatgaccatgtgtagcggagcgaggctggccctgctggtctatgggataatcatgcacagcagcgtctacagctcacctgccgccgccggactccggttccccgggatcaggtaggtgctggctgcctggcccaagcaggagctggggcttcccaggcacagacgcttcctcacggtctccttcctgcagtcctttgggtccagactactagcatcgccctctgcgcccc

SEQ ID NO: 82312 - DNA, 1240 bp, Homo sapiens
  chr18:905692-906932
  hyper
cggacgcctcccccagccctaggcagctcagggtcccgggtagagccagtgagcttctggccgctggagaaccccccctcccccaacccggcccacaggatgggggcagggcacggcccctagcttggtttcttttacctattcttgggacgagttaggagaacttcagctctggagcctggccgggggttgagcgtgaagctccctcggactttgctttgttactgcttgttctggactatccgggtggggtctctctctctcctccaccctttcttttcatttcattccaattctttcccctgaagagctttctttcaagtgatccgtgttccaactgcattttgaatcccaggctgtcttggggggcgtgcggtggggagggtgttggcccggtgtgattgaggaaaagcgacttaagagagggaagaacaaggacgagactgcgaaggagggggaaaaacaggcgcaaaggaggaggaagggaaagccagcaggcaggcaggaccgggagagcagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagcgcgaactattcgtttagtggcctta

SEQ ID NO: 82313 - DNA, 380 bp, Homo sapiens; identical to SEQ ID NO: 36848
  chr18:907314-907694
  hyper

SEQ ID NO: 82314 - DNA, 550 bp, Homo sapiens
  chr18:907721-908271
  hyper
cgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcctgtcctctccctggcccgatcctattgcagcgacagaaaatcagcagcgggcgggtctgtgtggacctgagggccgcgtggggaccgaggggggctgtggcccaaagagtggcagtgagtggcgtcaaggaacccacactccgcatctgccactcctagagccgggactagctcccgatcctagcagttgctctcgagatcatcccgggagttattggcgagttctgggcctctggaggtttccctgtcagcctccccggccgccgagggggcgcgcgcccaacaagggggtctctagcggccacctggggacagaaacagtgaccctgggcgcgcactttgcctccccgttagagatgt

SEQ ID NO: 82315 - DNA, 220 bp, Homo sapiens
  chr18:908299-908519
  hyper
cgcaaagtgctggaccagctgtccgccgggaagcacctgcagtcgctcgtggcccggggcgtggggtaagagtttgtggaaggattaacctgcgcgcgccggggtgggtgcctgtgcggggcgcgcggggcgggcggcggtgggtgcccgtgggggccagggtgagtctgcgcccctgggtctggggtgggcatccgccacgggtcgcagttggagattt

SEQ ID NO: 82316 - DNA, 163 bp, Homo sapiens
  chr18:908922-909085
  hyper
ttgcctacagcctgtcgacttatattattatcacgtttttcaactcggcgtgaggagggagaggagtgttcatatttgactaggaattgcaggatcgatgcaaactccagggcagcagccagactggcatatgtagggctctccggttactttctctgtatgt

SEQ ID NO: 82317 - DNA, 106 bp, Homo sapiens; identical to SEQ ID NO: 12949
  chr18:909183-909289
  hyper

SEQ ID NO: 82318 - DNA, 414 bp, Homo sapiens; identical to SEQ ID NO: 12950
  chr18:909318-909732
  hyper

SEQ ID NO: 82319 - DNA, 220 bp, Homo sapiens
  chr18:9333406-9333626
  hypo
ggtggtaggcatttacgatttaccagcataagggtttgacactaggtcatcatttccaagggaaggtgccccgcggacggtctggtctagcgggctctaacttaatcaccctggaatcttctttaaaaagcaaattccggccgggcactatggttcacacctgtcatcccaacgatttaggagaccgcggtgggaggatcgcttgagccccgaaatttga

SEQ ID NO: 82320 - DNA, 156 bp, Homo sapiens
  chr18:9364375-9364531
  hypo
tgatcccatgagttccgacggtgaaagtctgatccctttgtgataaaggtccccatcagcctttcacctggtgatttcaccccttcttgatgaccattgcctgagtcagctacttcattagaagctgtaaaacagccaggtgtggtggctcacgcg

SEQ ID NO: 82321 - DNA, 30 bp, Homo sapiens; identical to SEQ ID NO: 45331
  chr18:9547786-9547816
  hypo

SEQ ID NO: 82322 - DNA, 30 bp, Homo sapiens
  chr18:9615430-9615460
  hypo
tgtctaggaggtgctcggtgaagggtgcct

SEQ ID NO: 82323 - DNA, 233 bp, Homo sapiens
  chr18:961751-961984
  hyper
cctggaggctagcatcggaactgtcaccggcataatttcgttgtttttaacttttcagttaaaaaacttttaacttttcagttaaaaaagaaagcaagcgttctttggctgtctctgtgccggatgcagagggcacaactgctctgtggcacagccctctgtgatcggccgcgtgagggtcctgtcatcttgtctttcccttgtttcttccttcagggcgctagggacaccac

SEQ ID NO: 82324 - DNA, 145 bp, Homo sapiens
  chr18:9707918-9708063
  hyper
gcaaacggcctcggccgagagcattcgctttccagatgagaatggcatcttcagggacccgctggtagtggggccaggtctccacagggccggtccagtccttcctacccacccgggccctgcggccaggcggggccgggagggg

SEQ ID NO: 82325 - DNA, 192 bp, Homo sapiens
  chr18:9708338-9708530
  hyper
ggggcgcgggcgcggcggccccggaggatgctgctgagccccggcactgcctggctgcgagcacatgatggcgatacgggagctcaaagtgtgccttctcggggtgagtcctggccgccacccgccggcggaccccggcccgcgctctcgcgccccttcgctcccctattccctgcgcgctcagtccccgtg

SEQ ID NO: 82326 - DNA, 673 bp, Homo sapiens
  chr18:9708733-9709406
  hyper
ggtccgagcctgccccgggcttactccgctctttcctcccggcccgcgagtccccggatccgcggcgacctcgcggggacccccagcggggacggggcagtggcggcgagtctggggccccgagggctttctcctccgcttttgatagtttccttccggcagaaagtttaagttgctcagccaagtcgctgagtgctcttttgcctcctgggggcaattgatttactcacgtaaaacagaaaaataaaaccaaaagcgaacccagccaagggggtgaaagccgagggcgcggccggggtggaaggtgaggcagtgacctgtgcggagcgcgccctgcaaacttccctgctgcgggtgaaagaagctgcctgggaaagtcctccccaccatcactcccctaaagtggggttttctccgcccgaagaagccttaaagcagccagaaacaaaaaagcagtcaatccgtgcggcccggggactgcagacaggggacccggcgaggacgcagggagccgctggcgaaccgcccctgggaattcagataaacgtagggtcgcttcctttcgggggcccactccgcattccagaattccttcttctaaaagaagagccggttctaagggcgttttcagcagccattagcatctggtgtacccgcccgtgtcattggcaaa

SEQ ID NO: 82327 - DNA, 39 bp, Homo sapiens
  chr18:9720510-9720549
  hypo
atgtcaggtgaggtgcggagggggcgtgtctgggagccg

SEQ ID NO: 82328 - DNA, 34 bp, Homo sapiens
  chr18:9737968-9738002
  hypo
tggcaggcagccagccggccggcatttaaatgat

SEQ ID NO: 82329 - DNA, 59 bp, Homo sapiens
  chr18:9771710-9771769
  hyper
ctgcatccacttgagcggtcccaagccacgggtcagagaggattcgatggtggtgttct

SEQ ID NO: 82330 - DNA, 80 bp, Homo sapiens
  chr18:9797320-9797400
  hypo
aataagtcaattttgcgaatcgctggcttaatgtcagcgatgcttctgcttctcctgctggcggacgttccctgatgact

SEQ ID NO: 82331 - DNA, 30 bp, Homo sapiens
  chr18:9800222-9800252
  hypo
actttcatctgccagcggcccctcctgggt

SEQ ID NO: 82332 - DNA, 30 bp, Homo sapiens
  chr18:9836107-9836137
  hypo
ccgtctcccgctcaccgctgctgtgctgct

SEQ ID NO: 82333 - DNA, 236 bp, Homo sapiens
  chr18:9912767-9913003
  hypo
ccctaatacctggatcgcacatgaaaacttggatttggtgcctacttctagactgctgtttcgtctcgtttattttctagacaaactgtgctgctccatggcagtagcatcaatatgtcttttgtttcgtggcgctacctagggatttaaattcaaaccgtatcacaaaatacaataaaggtttatttacagcacattggtttcatttgacgttcctgtaccggactaccctggca

SEQ ID NO: 82334 - DNA, 133 bp, Homo sapiens
  chr19:1000497-1000630
  hyper
ggggccaccctcagccgtgcggcgtcctggcgcgcctcgggggctccgtgcgcctgggcgccctcctgccccgcgcgcctctcgcccgcgcccgcgcccgcgccgccctggcccgggccgccctggcgccgcg

SEQ ID NO: 82335 - DNA, 252 bp, Homo sapiens
  chr19:10024331-10024583
  hyper
gtcccttctctggcccgccgcggggcgctcggtccctcgacacccaggcgccccgggggggcgtgggggagggggcacgagcgcgagctgcggggcagggggtccgggacggggtgagggggggctcggggacgcgggctgcggctcggcgcgcctggcgggctcctcttataaagcgccggctcgggcccccgccccctcccgcgcctccgcgccgggcacttccagccgccgtgacgtcacgcctccggc

SEQ ID NO: 82336 - DNA, 195 bp, Homo sapiens
  chr19:10024804-10024999
  hyper
cacgcagaccctcttcgagcctgagccgcgggaccccgcgcgtaaaggcgccctcggcccaccccggccacccaaagacggcagggggccggagtcgcaaatccccacccacccactgttgggacacccaccctggctacctaaaacctcggacagcgggcattggggggcgtgggggggcgacacgctcgtgcg

SEQ ID NO: 82337 - DNA, 681 bp, Homo sapiens
  chr19:1003156-1003837
  hypo
ccagccccctggagacgctgctggatgtgctggtggcggtgctgcaggcgcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaactgcggggacctgcagccggccgggcccgagtccccggggcgcttcttggcacggtgagtggggaccctgcttcccttaggagggtgtccaggccactgagtctgcactgctcatggatcacaaaaggcaacgtgaggccagacgcggtggctcacgcctgtaatcccag

SEQ ID NO: 82338 - DNA, 666 bp, Homo sapiens; identical to SEQ ID NO: 45526
  chr19:1004775-1005441
  hypo

SEQ ID NO: 82339 - DNA, 61 bp, Homo sapiens
  chr19:1007604-1007665
  hypo
gctgacggggtcccccgcgcagctgcaccacccggcgcagggcttccgcttcggcaccgtg

SEQ ID NO: 82340 - DNA, 33 bp, Homo sapiens
  chr19:1007908-1007941
  hypo
cgaggtctccatcgacgccgactgcaaactgct

SEQ ID NO: 82341 - DNA, 30 bp, Homo sapiens
  chr19:10120011-10120041
  hyper
ctgaaccctgaggggcgggacagggcgccc

SEQ ID NO: 82342 - DNA, 184 bp, Homo sapiens
  chr19:10121048-10121232
  hyper
ggcggttccccatcccggcggggcccacgggcaaggcggggaaccagtcggggcggctgcggggcgcggcgacttctcgggctcggtgcagtcactcgcggcggccgctcctctcagggtccgcgggaaactgcccgagaccccgccctggcctcgccctgcgctccagcgcctggccaggcgg

SEQ ID NO: 82343 - DNA, 30 bp, Homo sapiens
  chr19:10142022-10142052
  hypo
ttggtcagggagtttcgggtttgagctcca

SEQ ID NO: 82344 - DNA, 147 bp, Homo sapiens
  chr19:10197672-10197819
  hyper
tctgatgaggaaattcggcagcgaccacacgggagtggggcgctccatcgtgtacggtgaggctgcaggggtcccgggcctggtgcggggaccgcgcgtgggagcgccgagggggcgtggtctagggagaggcgttgagatcacctc

SEQ ID NO: 82345 - DNA, 214 bp, Homo sapiens
  chr19:10207229-10207443
  hyper
gcttccccatcgcggcggacctgcaggcagaggaggaacggaaggaagacggggtgctggggcccagcgagacccctccgcttccacgcggggatgcgcgcgtctacacccgcgatgtcccgggcccataatttcagtccccatctcattccccccacggctggagggccccagggtgatcccactctggcttcaacaccgagctcttggcgcc

SEQ ID NO: 82346 - DNA, 145 bp, Homo sapiens
  chr19:10229584-10229729
  hypo
ctgtctttatgtttccgttgatgacctccttgggaggcggcagtggagctggcagaaggggaaaaacagagaaagactgagccctgggtcatggggatcaggagcggcagggctggagggagaggcagcccggacaccgagtggc

SEQ ID NO: 82347 - DNA, 31 bp, Homo sapiens
  chr19:10231211-10231242
  hypo
ctgcagagtgagactccgtctcagaaaaata

SEQ ID NO: 82348 - DNA, 30 bp, Homo sapiens; identical to SEQ ID NO: 16430
  chr19:10231504-10231534
  hypo

SEQ ID NO: 82349 - DNA, 42 bp, Homo sapiens
  chr19:10246211-10246253
  hypo
gaaccagcatagggacgcagcctgactcggatgtctcagcac

SEQ ID NO: 82350 - DNA, 193 bp, Homo sapiens
  chr19:1030032-1030225
  hypo
cccgctcccgctacacgacctgcccccatgcttatggccccctatacactttgccgtctgcctcagtgctgtctccgcggtcactagtggctggatagggacactcgaggtccccactggtgcacacccactgcccaggagcacacagcccattccccacggcggtgtctcagagcaccgaaggccaagaaag

SEQ ID NO: 82351 - DNA, 125 bp, Homo sapiens
  chr19:10347133-10347258
  hyper
ggtcagccaagggagcgctacagaggactggaaaacgctggaggcctggacttcctgatggtcttggtgggggtcaggaggagagcttggcctaccccggtggcggggggcggggggctgagtga

SEQ ID NO: 82352 - DNA, 31 bp, Homo sapiens; identical to SEQ ID NO: 45695
  chr19:10362045-10362076
  hypo

SEQ ID NO: 82353 - DNA, 265 bp, Homo sapiens
  chr19:10370310-10370575
  hypo
tgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcac

SEQ ID NO: 82354 - DNA, 39 bp, Homo sapiens
  chr19:10371536-10371575
  hypo
tatagacaatgtgatcgatttatttaaagtcaaccagct

SEQ ID NO: 82355 - DNA, 70 bp, Homo sapiens
  chr19:10394284-10394354
  hypo
gagaaggagctgaaacgggagccagctgtgggggagcccgctgaggtcacgaccacggtgctggtgagga

SEQ ID NO: 82356 - DNA, 16 bp, Homo sapiens
  chr19:10397626-10397642
  hyper
ccttatctctagagcc

SEQ ID NO: 82357 - DNA, 350 bp, Homo sapiens
  chr19:10397643-10397993
  hyper
gccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgct

SEQ ID NO: 82358 - DNA, 394 bp, Homo sapiens
  chr19:10398074-10398468
  hyper
cgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgac

SEQ ID NO: 82359 - DNA, 469 bp, Homo sapiens
  chr19:10400292-10400761
  hyper
tgtgggggcggggctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggc

SEQ ID NO: 82360 - DNA, 233 bp, Homo sapiens
  chr19:10400975-10401208
  hyper
agcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagc

SEQ ID NO: 82361 - DNA, 1118 bp, Homo sapiens
  chr19:10401486-10402604
  hyper
cccatgctttcccgccgctccatcggcgctttggagaccatggctctctgctaccacgtcccagagacaccctcgaggtttagactctgggagtgcgcctttaaaccggaggcctgggcaggacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggtgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttc

SEQ ID NO: 82362 - DNA, 66 bp, Homo sapiens
  chr19:10402894-10402960
  hyper
cacagccacagctagcgcagagcaggagggtgccaggcagctggtctgcaacgtcaccctgggggg

SEQ ID NO: 82363 - DNA, 30 bp, Homo sapiens
  chr19:10403300-10403330
  hyper
actcctgaccctgagcgaacccagcgtctc

SEQ ID NO: 82364 - DNA, 221 bp, Homo sapiens
  chr19:10405939-10406160
  hyper
tcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacat

SEQ ID NO: 82365 - DNA, 133 bp, Homo sapiens; identical to SEQ ID NO: 4582
  chr19:10406278-10406411
  hyper

SEQ ID NO: 82366 - DNA, 131 bp, Homo sapiens
  chr19:10406899-10407030
  hyper
agacagtgagctccccggggcatgaggactgacttcgtgcctgtgggagtgcggggggcggtgggagaagccccccggagcttggccaccctccgcgagggtctccaccccgcaggtccgtggctatgggt

SEQ ID NO: 82367 - DNA, 130 bp, Homo sapiens
  chr19:10407044-10407174
  hyper
cggcggggggcgcggcgctgctggccgcgggggccggcctggccttctacgtgcagtccaccgcctgcaagaagggcgagtacaacgtgcaggaggccgagagctcaggcgaggccgtgtgtctgaacgg

SEQ ID NO: 82368 - DNA, 30 bp, Homo sapiens
  chr19:1041553-1041583
  hypo
atcctggtggctgttcgccactcccacccg

SEQ ID NO: 82369 - DNA, 73 bp, Homo sapiens
  chr19:1041801-1041874
  hypo
ggcctcagcaccaggcgtctccccgcaggccacttcccaaacaagccactgccatcggcgggcaccgtgccct

SEQ ID NO: 82370 - DNA, 56 bp, Homo sapiens; identical to SEQ ID NO: 45528
  chr19:1042258-1042314
  hypo

SEQ ID NO: 82371 - DNA, 92 bp, Homo sapiens
  chr19:1047836-1047928
  hypo
gcggggtttctgggccgcctcatacctggacgccctgattccaggtgtatggccagaagctggcacagtcgccgggcgctgtggctcacgct

SEQ ID NO: 82372 - DNA, 47 bp, Homo sapiens
  chr19:10495335-10495382
  hypo
ctgcggttctaggaccgcaccagaaagaggtccgtctggttgtctgc

SEQ ID NO: 82373 - DNA, 386 bp, Homo sapiens
  chr19:1051207-1051593
  hypo
cgctgtagtgggccccgagcaggaccgtctgctgcaggatgtggggctggtctccaagcagagtgtgcagactcgccacctctctggtgagcccatccccaagggaggtcacctcacagggaggggcctggggattcatcctgaaggcagggggaagccgggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctggacgagcctacggctggcgtggatcctgcttcccgccgcggtatttgggagctgctgctcaaataccgagaaggtaagagc

SEQ ID NO: 82374 - DNA, 138 bp, Homo sapiens
  chr19:1051881-1052019
  hypo
cagctcgggcaaagacgcggcggcctgatggtagttgtgggttggtcccccgtgcctaggtcgcacgctgatcctctccacccaccacctggatgaggcagagctgctgggagaccgtgtggccgtggtggcaggtgg

SEQ ID NO: 82375 - DNA, 205 bp, Homo sapiens
  chr19:10526999-10527204
  hyper
acccgtcttcgggaacggcgtctgtgtccctgtctgtctgtttctatttccacacgtccctgtctgtctccacgcgcctctgcctgtgcgtcccccatctgtgcccaagccgccgtctctctgcgcccggcccccgcacatcggagctatttcgggtttaaggcttaaaagcccaacagctcggaggagacgcttcctccggccc

SEQ ID NO: 82376 - DNA, 393 bp, Homo sapiens
  chr19:10530133-10530526
  hyper
cgcctgaaaagggcacgggggtgcgctccgcggctacctgggaccttcctcagtttacctctggcagaagcgctttagaagaggcagcgatgtatagagcggtgggccggcagctgcggtatccgccacagggtgtcttcctggagccacaagggaaccaatgggacacaccccagaaacaccccagaggccccaggccgaccacacacatacactcacgcacacgcacacactaacatacatagacgtcctccgacactacagtcagacgacagaggccgaatcgcgtgcacaactccgcaagcacacaccgaccacaaacgcatccaagcgcttgagaacacattcacagtccccaggccacctgaaaaaagaccacgtagggatgcacat

SEQ ID NO: 82377 - DNA, 862 bp, Homo sapiens
  chr19:10531284-10532146
  hyper
ggcccgcagcgcccccgggtctgtccccggggcgccatggccctaccgcggccgggcgcacccgcggggccctgggctcgctggcttgcgcgcagctgagcggggtgtaggttggaagggccagggccccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctgggacctggcccctggttgtgcgctctacgggaggcttcctgctgaagcccatcctggggtccatttagggggcgccacgctgcgcgtggtgttaacgaggtctgggttggggaagggggctgcacacttaggggtctgtattcttggtgacagtgcagaacagctgctaagctgggaaccacttggagggaccttcctgggggcactatactgagggctagattcgcagtgtttggggt

SEQ ID NO: 82378 - DNA, 199 bp, Homo sapiens
  chr19:10562105-10562304
  hypo
gcgggggtgtatctgcggctataggtctgcgtagccgctggtttattggctacgcatttgcagcgctggggtgttgggaatagattctgaagagtggcacgccagtgtgtacttgtgtaggtgtataggtttgcacgggtaattatgcagggttataggtgtgtggggctgtgccagaggggtgcgcatgtctgcaggg

SEQ ID NO: 82379 - DNA, 30 bp, Homo sapiens
  chr19:10570048-10570078
  hypo
ctgacctctggcctccgtctccaccaggaa

SEQ ID NO: 82380 - DNA, 79 bp, Homo sapiens
  chr19:10570316-10570395
  hypo
tgacatacatgctgacgctggaggatcactaccacgctgacgtggcctaccataacagcctgcacgcagctgacgtgct

SEQ ID NO: 82381 - DNA, 30 bp, Homo sapiens
  chr19:10589751-10589781
  hyper
agcgcactcgcagaacgaggggggaggcga

SEQ ID NO: 82382 - DNA, 274 bp, Homo sapiens
  chr19:10616258-10616532
  hyper
agatagatgggatttcgccatgtaagtgaataataaatggaaactctaggcccctggagcctccagggtgaatttgaaagattgaacgtcctggctcagggtctggaaggaatcacgtgtagggctacgttggagttaccccgctaccccaaatccttgttgcgtgtagatgcagttccagacagctcctcaggggggcggcctagatagtccgtgaacacgctgagtggccgaggttgtaaccagcgccttcctggcacgttgcagaaaacaa

SEQ ID NO: 82383 - DNA, 114 bp, Homo sapiens; identical to SEQ ID NO: 37210
  chr19:10624739-10624853
  hyper

SEQ ID NO: 82384 - DNA, 702 bp, Homo sapiens; identical to SEQ ID NO: 37211
  chr19:10624965-10625667
  hyper

SEQ ID NO: 82385 - DNA, 45 bp, Homo sapiens; identical to SEQ ID NO: 37212
  chr19:10625744-10625789
  hyper

SEQ ID NO: 82386 - DNA, 249 bp, Homo sapiens
  chr19:10627965-10628214
  hyper
ctgcaaggagtggtgcgcctttttagaccgggaaagtggccgccagggcgaccccctccgggtcaggcccagcccagcgcccccaaaggtccagtgcagtccactcactctgcgccctggtcgtgcgccacccgcagtcgcgctgccttgaaccgagtgagcggacgccgctccgggggcggggctggagctggcaggcgagggggcgggccagcgacgcaaagggccggcggtcgccagcagttgccc

SEQ ID NO: 82387 - DNA, 96 bp, Homo sapiens
  chr19:10628453-10628549
  hyper
tctgtcctgggtgtccgggcactgcgccctcccattgcccacccacctgtgaactgagcttcctgggctgcaccccaaggacgccccgtcgatgat

SEQ ID NO: 82388 - DNA, 637 bp, Homo sapiens
  chr19:10629012-10629649
  hyper
cctcccatctcagccggctgaacgtagctgctgggactccagtcgcttgcaaccatgcccagataatgaatgagtgtctccctcacttcctctgtatctctctcaggaggatctcagagtctctcgcctgcgtgtctctttgtctctgcgtgtctctttgcctctgcgtgtctctttgttgctgtctgtgatgctctcccacgcctctcccaggccactgctcctccaacgaccagtcccgctggccccgaaacgcccccaccccgacttcccaggaacttccagacggtcccagctcttccaccctcagattcaggaagggaggctgggtcccgctgctgcgaccttctccaggaccgtgccctttgcccctgatgcttcaggccctgctggccgcgggtggggtgagggcgccccaggagagatgagccagaggctgagaataagtgtggatccgggataccctcgtgggaggaaactcagggggcactcaggccgggtcaggcccccatgtagccccttggggatcccagccctcctgcccccgctgttccctcggtgggcagaacctttcctgcctgctctgctcaaagacacagccaatgggacccgcagggtgggacggtgttaacccttc

SEQ ID NO: 82389 - DNA, 30 bp, Homo sapiens
  chr19:10665777-10665807
  hypo
gacttgaagacctgccgctttttccatgag

SEQ ID NO: 82390 - DNA, 185 bp, Homo sapiens
  chr19:10691879-10692064
  hyper
cgtggggcgggtttgcgactcccctgtgcatttctcagaagaaaggtcccctaaatgcttacggccagtgagctcgaagagcacgcggtcattgaggcccagccgcagctctggcattcctgacagaaacaccttgagcttgatggtaccgacgatttcgctcagaaggacgctgccgttggcat

SEQ ID NO: 82391 - DNA, 185 bp, Homo sapiens; identical to SEQ ID NO: 82390
  chr19:10691879-10692064
  hypo

SEQ ID NO: 82392 - DNA, 30 bp, Homo sapiens
  chr19:10692126-10692156
  hyper
ccgtggaaggggtgccggggaggtgtgcag

SEQ ID NO: 82393 - DNA, 30 bp, Homo sapiens; identical to SEQ ID NO: 82392
  chr19:10692126-10692156
  hypo

SEQ ID NO: 82394 - DNA, 139 bp, Homo sapiens; identical to SEQ ID NO: 45700
  chr19:10711944-10712083
  hypo

SEQ ID NO: 82395 - DNA, 65 bp, Homo sapiens
  chr19:10738627-10738692
  hypo
taccccactgacagccggggcgagttctgcgggcagaagggcacaaaaaacgagtgagttgactc

SEQ ID NO: 82396 - DNA, 162 bp, Homo sapiens
  chr19:10762073-10762235
  hypo
tggaattacaggcgtgagccaccgcgcccggcgtctttggcacatttgacgtatcatgtgactatgctacctattaaaaatccacagtaaaatgtaaataaaatagaaaagcagagggtacagcatgcactcatttcttttttgagacggtctagctgtgcc

SEQ ID NO: 82397 - DNA, 30 bp, Homo sapiens; identical to SEQ ID NO: 37216
  chr19:10806164-10806194
  hyper

SEQ ID NO: 82398 - DNA, 36 bp, Homo sapiens
  chr19:1080710-1080746
  hypo
ccagtggtaccatgtcgtccacggaggagctggtgg

SEQ ID NO: 82399 - DNA, 30 bp, Homo sapiens
  chr19:10823603-10823633
  hypo
tgagctgtcccctgccgctctacaggcaca

SEQ ID NO: 82400 - DNA, 36 bp, Homo sapiens
  chr19:1082973-1083009
  hypo
gtggccctggcaggtcggctgcgggagctcctgcgg

SEQ ID NO: 82401 - DNA, 30 bp, Homo sapiens
  chr19:1083466-1083496
  hypo
ttggacagggctgttcgggaggccactgtc

SEQ ID NO: 82402 - DNA, 30 bp, Homo sapiens
  chr19:1083719-1083749
  hypo
gcgaggtcaattccccgcttcagattttct

SEQ ID NO: 82403 - DNA, 150 bp, Homo sapiens
  chr19:10859213-10859363
  hypo
ggatgaggcagggaccgaggtgggcagaggagactgggcatgggtccccacttctgctccaacagagcgacagagaagcccctgaggtgggtgcgggtgactgcgggtctgcctcattggtgtcccacccacattcgtgtcctggctctg

SEQ ID NO: 82404 - DNA, 185 bp, Homo sapiens
  chr19:1085976-1086161
  hypo
gcagggaaaggcagccggaattcgtgtgagctggggtggggctgggaccacaggtggcttctctcttgcctgctcctgtccctccagcacgtcccctgcaccacggcatagcttaggtgcgccgtcctggggtcgctgccgagagcgcctggacttcgacgtcccaccagcgggcgcctcctccc

SEQ ID NO: 82405 - DNA, 75 bp, Homo sapiens; identical to SEQ ID NO: 45702
  chr19:10872535-10872610
  hypo

SEQ ID NO: 82406 - DNA, 154 bp, Homo sapiens
  chr19:10875953-10876107
  hypo
tctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggg

SEQ ID NO: 82407 - DNA, 30 bp, Homo sapiens
  chr19:10949173-10949203
  hypo
ccaaaacattttcatcggctcagtaaagat

SEQ ID NO: 82408 - DNA, 72 bp, Homo sapiens
  chr19:10954418-10954490
  hypo
gcatggtgggagacacgggacactgcaggtaacaacacagaccccatccttgtgctccgagaggaggaggaa

SEQ ID NO: 82409 - DNA, 43 bp, Homo sapiens
  chr19:11002349-11002392
  hypo
agacgccggccctcccgcccccagccttcgccattgccttttg

SEQ ID NO: 82410 - DNA, 95 bp, Homo sapiens; identical to SEQ ID NO: 45706
  chr19:11002992-11003087
  hypo

SEQ ID NO: 82411 - DNA, 30 bp, Homo sapiens; identical to SEQ ID NO: 16438
  chr19:11005335-11005365
  hypo

SEQ ID NO: 82412 - DNA, 25 bp, Homo sapiens
  chr19:11008369-11008394
  hypo
atgctagctctgggccgggcacggt

SEQ ID NO: 82413 - DNA, 30 bp, Homo sapiens
  chr19:11009412-11009442
  hypo
tcctggggtgctgttcgcaagccaggagac

SEQ ID NO: 82414 - DNA, 30 bp, Homo sapiens
  chr19:11029618-11029648
  hypo
ggcaggtgtgttagtcggatataaacattg

SEQ ID NO: 82415 - DNA, 288 bp, Homo sapiens
  chr19:11029961-11030249
  hypo
agtgtgtcgctaccacggacaatctaattatacatgtaagtttgttgatgtgttcatgtatctggaggttaaactcctgtagtgccaaatcttttatgtggataaacacttgtcatttggagagctgtcacctgattgccctcggtggcgttgtgccggtcccctcctcacggcgtgtctgggaagagcaagctcgttttagctgcacagcctagaagccgtgggcagacctgggggaaggggcagggctctcccctcccatgctggccctggcgtcagatgccacgt

SEQ ID NO: 82416 - DNA, 45 bp, Homo sapiens
  chr19:11049756-11049801
  hypo
gctgggattacaggcctgagacaccatgcccggcctcttaagtct

SEQ ID NO: 82417 - DNA, 93 bp, Homo sapiens
  chr19:11052037-11052130
  hypo
agtcaattatgtattcgtctggcgcccagtaaatggtcactttccataagataaagtgaacacagggtaggtacctatggagctttttttttt

SEQ ID NO: 82418 - DNA, 38 bp, Homo sapiens
  chr19:11053258-11053296
  hypo
ctgggattacaggcgtgagccaccgtgcccagccttgc

SEQ ID NO: 82419 - DNA, 186 bp, Homo sapiens; identical to SEQ ID NO: 45533
  chr19:1105541-1105727
  hypo

SEQ ID NO: 82420 - DNA, 35 bp, Homo sapiens
  chr19:11063746-11063781
  hypo
tcacccaggcaggagcggagtggcataatctcagt

SEQ ID NO: 82421 - DNA, 508 bp, Homo sapiens
  chr19:1112253-1112761
  hypo
gaagacatactctggcgcggagacctggttggaccggtgggtgcggcctgggggcagagctgctctcagggcccggccaggcgggggcggggccgagaccatgttgggggcggggccaggcagcgctgggggcggggccggactcaccgaactgctggatggcgcggtcggcgctccacggcagctccaaggtcatgtgcacgcggcgccgctggttctggacacggcggtcggcttggagggagacacccgagctggaggcctccgagatgatggccacgagctagggggaaagaaggggccgggacacggttggtgcaaggcccgccccagcgttgccgccacctcctcacccactaggcccccgctccaggtcaccaggacgtcccggggcagcgagaggcctgcggggcgcggacaccacccgccacacggccactcgcgcccgcacctggcacacacacactccagaagtgcgcgggtccacagtccccggggacccttgggc

SEQ ID NO: 82422 - DNA, 342 bp, Homo sapiens
  chr19:11128983-11129325
  hypo
cagtctctaggctgtcggtctcaggtgactcacccctccccactgcattctgcctgcccccatgtcctccctcattccagccctggtcatcccacaggggaacagccacgagttgccgctccctcccatccctgtcctcccgcctgccacctgagccaggccccgcctcgcccctcactgtcctcgttctctctcacagtcaggaaccttccgtggctggagggtggcagaaagactgtttggtgtctcctatatcctcaggtctccacagcactgttgctagcctggctctgggcgtgaagcctgtgctctgaagctgcattttcccggcagcaggtccag

SEQ ID NO: 82423 - DNA, 107 bp, Homo sapiens
  chr19:11129719-11129826
  hypo
tttcctctcttgctacggaggtgcaggcggtggtgggcaggacgtccacacatacctctggacagtgaacctgagaatgctgggtctccagtcgcatggagtctcca

SEQ ID NO: 82424 - DNA, 405 bp, Homo sapiens
  chr19:1113252-1113657
  hyper
ggtgcgttcaggcaacgatctaagcagaggcctgcgcaggccaggctgggggatctggggcttagagggatggggcaggccgtccacaggaggtcgtggcctcccgggccgagctggacagcacgctgctgccccagggctccccaaacgccccctcctcgcagggccgcggagacgcagagtgaccagcaggggccaccagagctgcacacagcctgcgtgaagccccacccactgcccatgccccgcccaccacactccagctgccacgtcccacccacctccgccacccgctgggggccgcccagctggtcgatgagctcgtccagggtgttgactggcagttcccggcccagccgccgcactttgtccagcagatcctgcttcagccgctccacccgctcc

SEQ ID NO: 82425 - DNA, 30 bp, Homo sapiens
  chr19:11145922-11145952
  hypo
ctcctggccaggctccgcaggcagccgaga

SEQ ID NO: 82426 - DNA, 82 bp, Homo sapiens
  chr19:1123343-1123425
  hypo
cacttctcccctctgcgaaccccggttttgtataagcctggattgtagaacctgtccccgggctctccggccctccctgaag

SEQ ID NO: 82427 - DNA, 165 bp, Homo sapiens
  chr19:11252652-11252817
  hypo
gtcctcaggagaagccgcccagggagcactagggcccgaggaagggttcaacctcgagactccatagcccctgggctcccgtccccagaaacaccagttacgagcagggggctggccatggtgtgaattcatgacctgcacacctcttgccgtaatgactaagtg

SEQ ID NO: 82428 - DNA, 61 bp, Homo sapiens
  chr19:11285211-11285272
  hypo
tgttgccgttgctgtcggcgatgttgaccacgtagtccagcagccgcgcagacatggcccg

SEQ ID NO: 82429 - DNA, 30 bp, Homo sapiens; identical to SEQ ID NO: 45714
  chr19:11406534-11406564
  hypo

SEQ ID NO: 82430 - DNA, 23 bp, Homo sapiens
  chr19:11490382-11490405
  hypo
tttttttttttgagacggagttt

SEQ ID NO: 82431 - DNA, 67 bp, Homo sapiens
  chr19:11492786-11492853
  hyper
cgcccagggaagggagcaggttgggaggggggaccggggagttggcattgcccggcctgtggggggc

SEQ ID NO: 82432 - DNA, 767 bp, Homo sapiens
  chr19:11529414-11530181
  hyper
acaccgcgccgtcctcggtctcttcaccccagtcctgcagcggtgcctggacgcacaggcggactcagggcaccaaaggggcacaggtcctggggcctcagcctccttggccgctcggactcgggccgagtcctcctgctgcatccccacgccccttcccggccagaagctgcgagactagggctggggtcccaggctagtcccctcctcgctgcgggtcccctcctcccaggtcctgaggacatggggtggcatttggggatgtcccagggcccagtctaatagaacctgtctctagctctttctgccgactgcgctcagagactcgcgcccccatccctaagaggaaccagtcgcttcactgggtcaagggccgcgagtccccaggaggggactccagggcaagttcagattgggagcagataccgtccgacgggcgggcgcttggagtttctggacctgcgggtcaccagggatgcggggtccggggatcccttgtccccttaccagggccagctctttgcctgctgtgcgctccatggccggcgcccgtccctctcagtggcgccgctgagtgaggcggaagggccggcgggtggcgggtggcgggcggcgggcagtggccgggcgctgaggccagaggggcggagcggccgagctgctggggcggggcggggcagggcaggccggacccagcctctgggtgcctccagccggacccagcgccagcccaggagaggtcctggctcttccgctgggtgcctatc

SEQ ID NO: 82433 - DNA, 560 bp, Homo sapiens
  chr19:11531328-11531888
  hyper
gatttactgtgggaacgtctggcccggccccttcctcccctccgggcgccgctggccgcctccgttcccggtccgggccgcgttcagcccctgaaggggccccgtggggcctgcgctagacccggagggatcgggggctccgaagggggccgcctggtgggtgtcaggacgagtctaggacctccgagagcgacggtgcttcttgtgactttcgattaatttctgggaacggatcttgagtgatgcgcgggtcactacctcgttgtcctcctcctcactctcttcgtctaaggggggtggggggatgagcagggagcgatgtgggatccaggtccccatccctggctccccttccctttaccaccccactccacccccaccttggccctgaacagggtatctgacaacctcctgctacccagcttggggccccaaccgcaccccttcatccccccacccatactgaccaaaaaacttgtccttggaagtggcaaggggcagggcgatgcgggtgttgtattcgggcagccttccctctaagctggcgaggaactaagcgg

SEQ ID NO: 82434 - DNA, 229 bp, Homo sapiens
  chr19:11532425-11532654
  hyper
cacgaggcccagcaggtttggcacatagttatctgcctggggatccagctcctttcccgcgaagcggccgtcctcctgcggccagggtagagccgggtcagccgagaggggtggggcctcttggaaggctccacccaggggcggggcttttctttcgggggcggggcctaggaggtaagggcccacctgcagggtcgatcctagccattgggggcggggacttaggtca

SEQ ID NO: 82435 - DNA, 609 bp, Homo sapiens
  chr19:11533023-11533632
  hyper
ggatgtggcaggccacgttccctcgggcaagctggtgtggcaggaaccccgcttcgtggctgcgcctctgcggtcccaggagggcctgtcggggcttcccctgggcggggcctaccacagtgatgtggatcagcttgctggccaggtgctccaggctgtccttggccacttgcatcgcccgcaaggcgcgctccagctggtccttggcctcggcgtgccgccgctcctccttcttgagacgctcctgcgcctcggcttgcagtttctgctggctgcagggagccgggaggtcaccccgggggctcagcccgccccgccgccctccccagagccccggtgcctcacctcaccagcgtggcctcccccgagtacttgaggtcttccagctcccgctgcagttgttgcttctcctgcttcagcctcaccaacgtctgctcgttctcgctcttgagcgtctccaactgcgcgaaggtgtcgccctgggccaggaaccgccgcaccaacgactgcgggccacccagccccagtcagagccagggcctagggagcgtaggggcgctccacctcctctcccccaccctgcgaaccctcgcacgcaggacaggtggc

SEQ ID NO: 82436 - DNA, 30 bp, Homo sapiens
  chr19:11537793-11537823
  hypo
cctggtgccgcagggcgttctgctgcttca

SEQ ID NO: 82437 - DNA, 30 bp, Homo sapiens
  chr19:11547189-11547219
  hypo
gagcttcctgtaccccgcagatcatcactt

SEQ ID NO: 82438 - DNA, 69 bp, Homo sapiens
  chr19:1156214-1156283
  hypo
ccccacgtctgtggacgccccttccaggcggcaaccccaggaggctcaggggaccgggttcttcaaggg

SEQ ID NO: 82439 - DNA, 104 bp, Homo sapiens
  chr19:1156524-1156628
  hypo
cacaccacacagaaacgtggccatgcacgtccacagcagcaccactcacaacagccacccgaggaagcagcccagtgtccacggataggcgagtggaccagcat

SEQ ID NO: 82440 - DNA, 30 bp, Homo sapiens
  chr19:11569191-11569221
  hypo
tggtcggtttccccacgttggtcccacctg

SEQ ID NO: 82441 - DNA, 42 bp, Homo sapiens
  chr19:1157959-1158001
  hypo
gctctctcctgagtccggataactgtccgcctcccagctctc

SEQ ID NO: 82442 - DNA, 512 bp, Homo sapiens
  chr19:11590692-11591204
  hyper
tcccaccccatctcccggggggcggagacccgggagcccagaggtgcccccccaacccgcgggccctcctctcccctccccctccccgcagcccgaggcgcccgcgcgaggctgcggcccgcgaagaagcgccgagaaacaaagggacgcggcagcagcggcggcgggcccgcggggcctccgggcgcgccccctcctctcccctccccgcttgccgcaaggtcgacgggctcgaggacgagacgcccgcctcccgggtgcggccgaggcccggggcgcgcgatccgacgccacccgctttcccagggctctcggggacgctttgtcgctttggcttggcccagcaccagtgatcgggccctgcgtttgcctgggcggcctgcggggtctgggcctggatggaggaagcatccttagccgccgcggcccctcccccatcaggcctgctggagagggggcaatcccgcctccagggcggcgtcggacgcctcccgaatcgcagtcagtctccc

SEQ ID NO: 82443 - DNA, 102 bp, Homo sapiens
  chr19:11591537-11591639
  hyper
ccgctgcagatgtggcgatgaaggcggcggctccctcgagggccagggacgggcccgaacccggggatgcgcgcgcggatggccgggccccggggtggcctg

SEQ ID NO: 82444 - DNA, 340 bp, Homo sapiens
  chr19:11591672-11592012
  hyper
cggggttgaggacgccccctgcgcggccccgcggggcccggggaggttgcgcttcccgacagagatcgcggcgctctgcctttcgccgccgcccctcggtcggtcctgtccggtcccgtgtgttcaagtcctctcccctcgcccaccctccctccctccctccggcccgcgctgcgcgctccgcgctctggaccgcgccgccgccgcccccagccctttatagcagcagctgccagcgccggcgtcgctcattggctgcggcgaccgagctccgcctcctcgcggctcccgacggcgcggcaggtggaagtgagcgcgcactggtcgggactctgaatcc

SEQ ID NO: 82445 - DNA, 782 bp, Homo sapiens
  chr19:11592671-11593453
  hyper
aggcgttgggggtggcgcagcctcctttggtgcgcgggcgccggtgcatgtttacgtcggggcgcgggaactagcacacactggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcaccaggggatgctgccacgcctggaaagggcaggccaatcgcagtggcccgcgcaataggggcggtggcggtgcagatccccgggtggcccctcttgggctcgccggggcgacctggctgcgggcgctaggggccccaagcgatggtctgttccccaccccgtgttcctcccggtttccgtcatcggaaactgagctaggaggggggctgctcctgggcgcgcggaccccgctgcggttcccatggaaacctgccggctccggcagtgcggggagagtggaggggacctgcctcgcggggggagggagctcgcgggggcggccccagcggccggactcgctcatccttgccgattcttctgtccccggctggggtagccccccggtccgcagcaggaactgaggcatagctggggccccgcctcatcccccga

SEQ ID NO: 82446 - DNA, 213 bp, Homo sapiens
  chr19:11594589-11594802
  hypo
gttgtactgcacctccgcagtgtgcttcttcatgtgccagttgagcgacgcgcgctgccggcactggtagccacagatctcgcacctgccgggagcccgtggcgggacggggcggggtcagagtgggcggggcggggcggggccctacaaggccgagcgcaggtggaaccgggcccagacactgcgttggggcgaagccgcccctgggacctg

SEQ ID NO: 82447 - DNA, 177 bp, Homo sapiens
  chr19:11650656-11650833
  hyper
agagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggc

SEQ ID NO: 82448 - DNA, 135 bp, Homo sapiens
  chr19:11658622-11658757
  hypo
aggaaacaaggtgaacgtgggagtgaagtacgcagagaagcaggagcggaaattcgagccggggaagctaagagaagggcggaacatcattgggctgcaggtaccgccctgtcctcactgcgcagaggtcataga

SEQ ID NO: 82449 - DNA, 117 bp, Homo sapiens
  chr19:1167208-1167325
  hypo
agggaactgagggcccgaaatcacagaagcaggaactccaggttcgccagtgcggcctgatccaccttccctcaaacgtagctgctgacaacgacacccacgcgccctctctgggcc

SEQ ID NO: 82450 - DNA, 362 bp, Homo sapiens
  chr19:11689266-11689628
  hyper
gctggtgatagcgcgcgtgaccacagacctctgaccctcatagtctcagcagctgtctgcaggccctccacgggaccgcagcctgggagggcaggaggccctgcacctgcggccggtctgacctgctcctcacctccctgcctgcctcctccgtgctgggcgccgccgcgacacgtcccgcggacattcaggagtcccttcagtccctgcgagcgcggacccgggagagagctctcattcaacgctgaggccactggctcacagatctccccgggtcaccctgcgaagtgcttggtcccccccattcccagccctgcagcagcaacaaacgggaaggaagtgggtgacgaggacaggcagag

SEQ ID NO: 82451 - DNA, 45 bp, Homo sapiens
  chr19:1170185-1170230
  hypo
agctgatggggcccacgcatccgaaatccccgtcttggccagaac

SEQ ID NO: 82452 - DNA, 142 bp, Homo sapiens
  chr19:1170687-1170829
  hypo
aagacatgcacaagcaggggtgcatgagaacacgcagcacgcacacaacacacacaacggacacgtgcataacggacacaggtgcacaggcaacatgcgggcacacacaacatgcacacaaagtacacgtttgcatgagcac

SEQ ID NO: 82453 - DNA, 354 bp, Homo sapiens; identical to SEQ ID NO: 45539
  chr19:1171068-1171422
  hypo

SEQ ID NO: 82454 - DNA, 30 bp, Homo sapiens
  chr19:11788723-11788753
  hypo
gtggaaagtgggagacgagggagagcagct

SEQ ID NO: 82455 - DNA, 171 bp, Homo sapiens; identical to SEQ ID NO: 37228
  chr19:11805426-11805597
  hyper

SEQ ID NO: 82456 - DNA, 99 bp, Homo sapiens
  chr19:1181413-1181512
  hypo
tctctctttgtctctgtctctctgtctctgtctctgtgtccctctgtctctctgtttgtctctctctgtgtctgtctctgtctccgtgtctctctgtct

SEQ ID NO: 82457 - DNA, 73 bp, Homo sapiens
  chr19:11878759-11878832
  hyper
gcagttctgtgaacccggtgaggaggctgcacggtgatgacaggtcaccaggcagactcgtgtgtggggtttg

SEQ ID NO: 82458 - DNA, 399 bp, Homo sapiens
  chr19:11909333-11909732
  hyper
tgccaactgtcaatccggggaagcagaaggccgcactcagagtctctgcactcctttgttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggtaaagtgcccggcctagcgtccagatacgtggaagaggggctgggtggaaccaacaggatcctgctgtggcgggacccaggcctccgctcgggcgaccccggcgattgggacccgcgtcccccatggcgtggcttggccctcggtccgctcggccgccaggtggggctgggcccgcagctgggaccccg

SEQ ID NO: 82459 - DNA, 159 bp, Homo sapiens
  chr19:11909792-11909951
  hyper
agctccgcgcccgcagcccggcgtcttcccagattgtgcgggggccacgggagggtcatggggggtcggatgtgtcccgcctttcttctgctaaaaattaaactgaggctctgttaacagttaaagagtttgttggagcaacagcgattccgagtgaga

SEQ ID NO: 82460 - DNA, 30 bp, Homo sapiens
  chr19:11925559-11925589
  hyper
ttagaaacaagtgcccggtgccgcaaagaa

SEQ ID NO: 82461 - DNA, 202 bp, Homo sapiens
  chr19:11926261-11926463
  hypo
aggagacaaggaagtcggtctcaagaaacaaagaacagcttactaaagcttttagaaaagtaatttatcatctctgacaggttcgtgtgggaggagtagcggtctttggggtccccagtgcccacttttttctgttaaaaattaaactgaggtacgttaacaattaaagagtttagggccgggcgcggtggctcacgcctgt

SEQ ID NO: 82462 - DNA, 82 bp, Homo sapiens
  chr19:11926703-11926785
  hypo
tccatctcaaaacaacaacaacgattcacgaatgagaaacacccagtcctggcttgtggtttgtcaacggaaaaagccaagc

SEQ ID NO: 82463 - DNA, 333 bp, Homo sapiens; identical to SEQ ID NO: 37231
  chr19:11959427-11959760
  hyper

SEQ ID NO: 82464 - DNA, 572 bp, Homo sapiens
  chr19:11959761-11960333
  hyper
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagtgtattcagagccgagtaggagagaccttggccgagggaaacacaaccccaagcagcctggagtaagtggtccggaggcggctcaggacagtt

SEQ ID NO: 82465 - DNA, 80 bp, Homo sapiens
  chr19:11980787-11980867
  hypo
tttcactcataataccaaaagttatctcatgtatctctgagtaccttcttgcccaaaaccagcagcgccatacctgctgt

SEQ ID NO: 82466 - DNA, 750 bp, Homo sapiens
  chr19:11998469-11999219
  hyper
gctgtggtcagaatccgtctgtctggctctgcagggcccgatacccagggcttccgctgtcactcagacatggggggcggggcctagcattccatccaatcagaggcattgtggcgggtccctgcccactgttcctccagacactgagggggtcgcattccttacctcacctttgtccctgcgcgggctgcggctgggatccggtctttccagccccgagagggacctggttcctctgcccaggcttctgtcactctgtcacctacgctatgccctgctgtagtcacaggaggtgtagagaggaccccgggacatctgaaagccaggaaatggtgcgtgtctggggccgggtgtcgtgagacgggggaggggctgcctggaccgaccggaaccgactgtggcgagaccctggctttcctgcgggcgactttgggatctgggaccgagtcctcctggagccgctcggccctcggtcccctcgactgctcggtgtggctgggccggtagccgggacaccaggcgtcctgtctcgtctctgcgcggcgactgcggttccagagccctctatgggcagctccgcgcccgcagccacgcgtctacccagattgtgcgggggccacgggagggtcatgtgggtgatcccgactcgggtgtggggttcgtgcttgggaggagcagcggtctgtggggcccccagtgtccactttttctcctgttaaaaattaaactgaggaacgttaacaaagagtt

SEQ ID NO: 82467 - DNA, 85 bp, Homo sapiens
  chr19:12075733-12075818
  hyper
gatacccaaggcttccgctgtcactcagaagtgaggggcggggcctagcattccatccaatcagaggtgccggggcagggccctg

SEQ ID NO: 82468 - DNA, 307 bp, Homo sapiens
  chr19:12076072-12076379
  hyper
ggaaccggccggaaccggctgcggcgggacccgggcctccctgcgggcgactccagggtctgggaccgagtcctcctggagctgctcggccctcggtcccctcggccgctggatggggctgggctggcagccgggaccccgggtgtcctgtcctgtccctgcgcggtgactgcggccccgccccggagccctctctgggcagttccgcgcccgcagccccgcgtctccccagattatgcggaagccacgagagggtcatgggggaaatcctgactcgtgtgtagggttcgtgcgtgggaggagcagt

SEQ ID NO: 82469 - DNA, 30 bp, Homo sapiens; identical to SEQ ID NO: 45540
  chr19:1208940-1208970
  hypo

SEQ ID NO: 82470 - DNA, 458 bp, Homo sapiens
  chr19:12098632-12099090
  hyper
aaaatggtgagtgtgcggagccggaaaccccgaggtgggtttgggggttaggggacggtctagtcagaaccgcggaatcggaacgcgggcctccatgttgcgactcgggggtctgaggcccgagttcccctggcgcagctcagccctgggtccccttggcctcagggtgggtctgggcggcagtcgggaccccaggcgtcctgtcgtccctgctcggcgactgggacccctgccccggagctctctctggggagctctgcgcccgcagccgcgcgtctccccaaattgtgcggaagtcgtggagggaatcccgcctcgtgtgtggggttcccagtcgcacgtttcttctgttaaaaattaaactgagacactgttaacaagtaaagagtattttgggtaaacagccaatcatgaaggagaaacaccgggtcatgacttgttaacggaaaaaaaaaacc

SEQ ID NO: 82471 - DNA, 487 bp, Homo sapiens
  chr19:12146544-12147031
  hyper
gcgcccctgattggacgaagcgccgggccccgccccctcagccgtgagtgacaatagaagcccttggtaacggggctctgaaaacgggtttgaccggatccagcgatagattctttaagccagaggtctgtaacctttttagcaccagaaccggtttcgtggaagacagttctcctacgggggcagatagtttcggaatgaaacttccacctcagatcaggcattttatcctcataaggcgaacccaacctagatccctcgcatgtgcagctcacaatagggttcgggctcctatgacagactaatgcctctgctgatctgacaggaagcatatctctggcgataatgcccgctggctcgcccgccagccgctcacctcctgctgtgcggactggttccttacaggccatggaccgggggttggggacccctgccatagagtactgttgaatagaaactttagctcgtccggcggtgggctgggggg

SEQ ID NO: 82472 - DNA, 29 bp, Homo sapiens
  chr19:12147710-12147739
  hypo
cccccgcacccggccgaggctagggtttt

SEQ ID NO: 82473 - DNA, 276 bp, Homo sapiens
  chr19:12163055-12163331
  hyper
tgtgtttccctcagccgaggtctctcctattcggctcagaataaacttattctacacgatttgggtttttccgttaccaaaccacaagccaggactgggagtttctcattcattaatcgctgtttgctaaaataaactctcattttttaacagtgcctcagtttaatttttaactggaaaaaaaaaggaactggggaccccacagcccacagctcctcccacacgaaccccacacccgaggcaggatcccccatgacccttccatggtcaccgcac

SEQ ID NO: 82474 - DNA, 576 bp, Homo sapiens
  chr19:12163451-12164027
  hyper
ccacccagcggccgaggggaccgagggccgagctgcgctagggggactgtgtctggagcccagagtcgctgcaggggggcccgggccccgccacagcgggttcctctcggttccacccagtccctcctttcgccttgggactccccagcaccgcatgctcaccatttcctggcttccaggtattctggcgtcctctctaaaggtcccgtgaacagtgcaggtcacagcgcagtcgacagagcaacagcagctacggcggaagtaactggtccctctcggagcaagaaagccccagaccttaactagcgcgagcagccctaggagtgaagagagcgggaatgcaacctccccttccctggaggacagtggcagggccccgccctagcgcccctgattggataggggtctagactccgcccccttccctgagtgacagcagaagccccgggtaactgggcgctgcagagccgaagcgactggttctggccacactttccaaggtcagctccctccctccctcccacctttacttcgaatatttgccttcggccaaacttgctccgaactgctagaagg

SEQ ID NO: 82475 - DNA, 718 bp, Homo sapiens
  chr19:12175445-12176163
  hyper
tcaggatgcagggggcggggcctggcgctccacccaatcagagtcgccggggtggggcccggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctggggcccgagccccgctggcgcagctcggccttcggtccattcggccgccgggtgcggctgggccggcagccgggacccctgggcgccctgtctcgtcgccgcgcggcgactgcggccccagcccgggagccctctctggacagctccgcgcccgcagcccggagcctctccatattgtgcggggccacgggagggtcatgggggcaatcccgccttgggtgtggggctcgtgcgggaggagctgcgctgtgaggccctcagtgccccctttctcctgttaaaacttaaacaggcccggtgctgggaatagaggcgtgagccaccgcgcctggcctagcgtggagaacttgtg

SEQ ID NO: 82476 - DNA, 336 bp, Homo sapiens; identical to SEQ ID NO: 1357
  chr19:12203013-12203349
  hyper

SEQ ID NO: 82477 - DNA, 288 bp, Homo sapiens; identical to SEQ ID NO: 37244
  chr19:12203350-12203638
  hyper

SEQ ID NO: 82478 - DNA, 322 bp, Homo sapiens
  chr19:1220427-1220749
  hypo
acaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccaca

SEQ ID NO: 82479 - DNA, 30 bp, Homo sapiens
  chr19:1221029-1221059
  hypo
actcccctcctaccccgtagcctccactag

SEQ ID NO: 82480 - DNA, 101 bp, Homo sapiens; identical to SEQ ID NO: 45716
  chr19:12220383-12220484
  hypo

SEQ ID NO: 82481 - DNA, 132 bp, Homo sapiens; identical to SEQ ID NO: 45717
  chr19:12222626-12222758
  hypo

SEQ ID NO: 82482 - DNA, 141 bp, Homo sapiens
  chr19:1226687-1226828
  hypo
ggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagg

SEQ ID NO: 82483 - DNA, 415 bp, Homo sapiens
  chr19:12266893-12267308
  hyper
aatttctgggctgaagcaatccccccgcctcaacctgccaggcgtgacccactgcgcctggccttcaatttagtttttcaggaaaaaaggggggactggggaccccgcagcccaccgctcctcccacacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagcc

SEQ ID NO: 82484 - DNA, 390 bp, Homo sapiens; identical to SEQ ID NO: 37246
  chr19:12267309-12267699
  hyper

SEQ ID NO: 82485 - DNA, 190 bp, Homo sapiens
  chr19:1227469-1227659
  hypo
tgccccccaggagtccggtagccccatgactgtacctcagcttctccatcctcccaggggcccgcgggaggcggagaaccggtgcccaggctgacctcttccgtcttccttccaccctgcagcccgtgtccaggagccccgccaggtgcccgcgccaggccctcagtcttcctgccggttccgcccgccc

SEQ ID NO: 82486 - DNA, 281 bp, Homo sapiens
  chr19:1227891-1228172
  hypo
cgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctt

SEQ ID NO: 82487 - DNA, 341 bp, Homo sapiens
  chr19:12305853-12306194
  hyper
cgactatcacctgaccgtagtaatatctcccgctacgcgcgttgtgaccaatgctgcatacaggagatgagggaggacggccagacacctggaagccggaaaatggtgagtgtgcggggccggtgtcccgagacctgaggagggacaggttggaaccggccggaaccggctgtggcgggacccggggctcccctcggcgactctggggtctgggacccgggtccctctggcgcagctgggccctcagtgccctcggccgcagagtggggctgggctggcatccgggaccccgggcatcctgtcccgttcctgcgcgacgcctgcggccccggcctcagcct

SEQ ID NO: 82488 - DNA, 74 bp, Homo sapiens
  chr19:12306229-12306303
  hyper
cgtgtctccccagattgcacgggagccccgggagggtcatggggaggattccgactcgtgtgtggggttcgtgc

SEQ ID NO: 82489 - DNA, 9 bp, Homo sapiens
  chr19:12306304-12306313
  hyper
tgggaggag

SEQ ID NO: 82490 - DNA, 106 bp, Homo sapiens
  chr19:1231206-1231312
  hypo
cccctcctcctgctccgtgctctcactggctgcccgctgccgctggaagtggtgccgcttgggggaacctgcgcacgggatgtgccgtaagcgtcagccggcatgt

SEQ ID NO: 82491 - DNA, 30 bp, Homo sapiens
  chr19:1234436-1234466
  hypo
tgctccaccccaccccgcccatcccgagat

SEQ ID NO: 82492 - DNA, 484 bp, Homo sapiens
  chr19:1234905-1235389
  hypo
ggtccctgcagcctccgcacccagctcctcccccgtcccggcggccaggacctcagacaggccctggggtgcctcccaacgccgccccgcttaccggcgacccttgtcctgcgtcttgcggctctgctcaaacagcgccgcctcattgaaggagacccggcggcccgtggagctggtggacaggaagcgttcggtctccgcatcctggcactcggggtcctctccccggaagtcggggtctgcgtggagaggcaggagagggtgggccccgggcgggccacgccaggcgcctggtcccgggagggctgctcctccgggcggccacggcagggagggctggggccgcggcacgggcggccgggctggcggggcgagggacactcgtccatccgctcacacactcactcgctcagcacgcgcctgggcccacctacgcctgggcgttaaggaaacagagatgagtcggaatcgagctgcgcccagt

SEQ ID NO: 82493 - DNA, 306 bp, Homo sapiens
  chr19:1236238-1236544
  hypo
gagaggtagcagagccggaggcagcctccacccggcttggctctgcccagcgggccccgggggctctctctggacctccatctcccatccccatggcgggggaggaggcctggccctctgagggtgcgcctgtacccatcacaactgcacacagccggtgcggcctgtcctgcaaggtagcgccaggccctggagctcagcgctgggcagggcaagcactcggaggaatggggacgccaaggcggtgcagccggctcgagaaggactccagacgccctgtccgccccatcacgggggtggggggct

SEQ ID NO: 82494 - DNA, 586 bp, Homo sapiens
  chr19:12475782-12476368
  hyper
agggtgaaaaccccacgagggaacccactcagcaggagaatgcggtttcttcacctcccgtcccaggattcgcctgtcacttccccaccaaccagcgaccccacacttcagccgcccctgtccagacccctaaacacccccatccccaaacctctcatggaggcggaactggggtcttctctcctctccccctattaaactgtttctgctgcaggccttggagtctcggtgcagtgactcggaccgcgaacctgtgccggttacagccgcacaatctgggaagacgcggagctgtgggcatggagctgccccagagagggcgcgggagccggggccgcagttgctgcgcagaaacgggacaggacgcccggggtcccggctgccggcccagcccccagctcccaccccgcggccgaggggactgaaggccggctgggccaggggaactcgggtccacagaccccgcagtcgccgcggggacgcccgggtcccgccacagccggttctggccggttccaaccagtccttcgccctgccccaggacgccgggccccgcacactcaccatttcccggcttccgcggtgt

SEQ ID NO: 82495 - DNA, 95 bp, Homo sapiens
  chr19:12476602-12476697
  hyper
aagaaggatcttacacggctgagtggagcgagatgaagcggttccagacacagcccttgatagggtgggcttcctcccttcgctgtgacctgacc

SEQ ID NO: 82496 - DNA, 104 bp, Homo sapiens
  chr19:1257622-1257726
  hypo
ggagagtgaaggagacggagaaacgcgccccatcccttccgccgcctcctttcccccccgaccctattcaggttttaagtcaaaaatgtcgatatgtcattatg

SEQ ID NO: 82497 - DNA, 298 bp, Homo sapiens
  chr19:12606167-12606465
  hyper
ctgtccaattggagacgccgccggagcggtgggtggggccgccctgtacaaaggcgcgtggatacggtggcgcgatttccagtttgtgtctctcctgcctcgaacgtcgctaggtggctctgccgcagcctctgtcgctctgggacccgcactggcagagggagtcgtagttagggggtggggacaccgcggaagcccggaaatggtgactgtgcggggcctggaatcccgagacctgaagagctgctggccggaaccggctgtcgcgggaaccgggcctgcccgcggccactcctgg

SEQ ID NO: 82498 - DNA, 40 bp, Homo sapiens; identical to SEQ ID NO: 45718
  chr19:12675871-12675911
  hypo

SEQ ID NO: 82499 - DNA, 30 bp, Homo sapiens
  chr19:1268427-1268457
  hypo
gtgggcctggccccgcgtggggagcgagtg

SEQ ID NO: 82500 - DNA, 30 bp, Homo sapiens
  chr19:1271429-1271459
  hypo
cgtgggggccgaggacggggccgtgggttc

SEQ ID NO: 82501 - DNA, 83 bp, Homo sapiens
  chr19:1274044-1274127
  hypo
tctgatgtctgttgccgccattagtttttttctagagcccacactggcccacatagctccatcccatacgggtagctggctcc

SEQ ID NO: 82502 - DNA, 250 bp, Homo sapiens
  chr19:1274641-1274891
  hypo
ttccaggaggcgcttcgccagtgaggtgcgggctcagggcctcgagtctctcctggagcacgggctgcggtgcgccggcagcttacggggcggccagtccttgcccacaacgatgtggagccctgtgaaagtcggattcgaataaagggccacgtgtgcacccagaaagccgagtctgtggttcaggggggtctgtcggcggagcggggccactggaagaaaagcctgcggacctcggttcagcgcacga

SEQ ID NO: 82503 - DNA, 50 bp, Homo sapiens
  chr19:12747555-12747605
  hypo
cctcttgcccctgtgcggccccgccgaactggaaacgtttccagcaggtg

SEQ ID NO: 82504 - DNA, 384 bp, Homo sapiens
  chr19:12750831-12751215
  hyper
caccaggtgggaaagcggccaagctcagggcaccctactccgctcacctgcgacggcagcagccagtccccacgggcggaggggacctcatgcgacattcagcccgcgagattctcagagactgctcgcccgcaacacgcagtaacgatctcaggagagcccatgatggggcggcgcgtgtcgtagccgagaagactctgtcatcgccggcgacctcctggaactctctcttgcggtttgcagccagatcacttcccatacacgcggcagccaagctcaggggatggcatcagactgaccctaggtggcgctcgaacacccgccggacctcaccagacaggcactttccccagtctacaccgcctggttcgggtcccacatgaa

SEQ ID NO: 82505 - DNA, 16 bp, Homo sapiens
  chr19:12835315-12835331
  hypo
gttttgtttttgagac

SEQ ID NO: 82506 - DNA, 39 bp, Homo sapiens
  chr19:12846163-12846202
  hypo
gtcacactccgtctccgaggctggagtgcaaaggcatga

SEQ ID NO: 82507 - DNA, 23 bp, Homo sapiens
  chr19:12846825-12846848
  hypo
tggagctgaagtccccgtctgag

SEQ ID NO: 82508 - DNA, 192 bp, Homo sapiens; identical to SEQ ID NO: 45720
  chr19:12863412-12863604
  hypo

SEQ ID NO: 82509 - DNA, 30 bp, Homo sapiens
  chr19:1288467-1288497
  hypo
ggtgtgtgggggatgcggggaccccaagtc

SEQ ID NO: 82510 - DNA, 398 bp, Homo sapiens
  chr19:1289167-1289565
  hypo
ttgcacatgtgtctgcgtgattgcatatgaggtgcatgtgtgtgcatgagtgtgtctgtgcgtggcacccgcgtttgcatgtgcgtgcccttgcacgggatgtctgcagtgtccgaggtccctgtgcgtgtctgcctgtggcatgcatgcgttttgtctgtgcgtggagtgcaggtgtgtgtgcgtgtctgcgtgtggggtgcatgtaagtgtgtctccctgggggcagtgctggctggctgagggcctgcaatgtgggggcagtggtggccccagcacggtccacaatggcaaccccgctgttggccctccctctcctcctcccctggggacgggaccagggcccgtgtgcagacggccatcaagcctcagagcagggtggacgcaggggcctgtgg

SEQ ID NO: 82511 - DNA, 108 bp, Homo sapiens
  chr19:1290482-1290590
  hypo
aggggactggccctacgtgggtccctcggggtcacggcggaggcagtgggttgtgcattcatgggggtccgggtggtagcgtttctgtggagccggtggtctccttgt

SEQ ID NO: 82512 - DNA, 23 bp, Homo sapiens
  chr19:12906634-12906657
  hypo
actgcgcccggccttgggagcag

SEQ ID NO: 82513 - DNA, 30 bp, Homo sapiens
  chr19:1291641-1291671
  hypo
cggggtcctggctgccggccacaccactgc

SEQ ID NO: 82514 - DNA, 211 bp, Homo sapiens
  chr19:12936426-12936637
  hyper
agaaggccgagaggacgaggggtggggttctgggtgtcctgaggggcggggctgggggaagggtcgctcccccaactcagggccacgcgtccgctaggggccgctgccgcttccactgccactcccgctgcccgcagcgtccaggatggaggtgcgagggctgcgggaacgccgggagggagcttcccggccccgtcgtcctggtctggga

SEQ ID NO: 82515 - DNA, 101 bp, Homo sapiens
  chr19:1293979-1294080
  hypo
ccagtgtggggcctgcggcgggctcacccctgcaggccggggtggcggtggctgtgccgggctagaggcagtgccagggccgggatcgtagcagcctgcac

SEQ ID NO: 82516 - DNA, 101 bp, Homo sapiens; identical to SEQ ID NO: 37253
  chr19:12945480-12945581
  hyper

SEQ ID NO: 82517 - DNA, 45 bp, Homo sapiens
  chr19:12946269-12946314
  hyper
tgcacggtgtgtccccgccctccaggccggcgtcaactctcattg

SEQ ID NO: 82518 - DNA, 64 bp, Homo sapiens
  chr19:12947063-12947127
  hyper
tagaatgtttgggggcgctagcgggtggggctgggttccaggtcttcttcgggtggtgcttaaa

SEQ ID NO: 82519 - DNA, 30 bp, Homo sapiens
  chr19:1294903-1294933
  hypo
catgttaggtagatgcgaagtttctggaga

SEQ ID NO: 82520 - DNA, 76 bp, Homo sapiens
  chr19:12949855-12949931
  hyper
tatgctcagtcactgcggctgtgggtgaggggacggacggaggggcttggggctccctcttcgggagctggatgct

SEQ ID NO: 82521 - DNA, 453 bp, Homo sapiens
  chr19:12951676-12952129
  hyper
ccacaggcgaaggggcgtggtctccccataataggcgggactagactaaagacaggacatgctgctgtttgcacgccgctttagggaacgagagacctgacaggatttgccccctctttctctcataggcagcagtcccctggacagcccccgaaacttctcccccaacacccccgcccacttctcgtttgcctcctcccgaaggtgagtccctcccctccagggccccagaaccctgggcagaccctccccaaccactgtctgggccgccatctgttctcctcctaattgcacccgagctggggcctgaggggaccagcgagtgccccaaggtctcagcgggaaggagcgcctagccttcggggcggggcctataagaaggcggggtccaatcgccgatctggaacggggaaggcggtggggctccctttgcggcaggtcgaaagcgcgtgc

SEQ ID NO: 82522 - DNA, 149 bp, Homo sapiens
  chr19:12952130-12952279
  hyper
ccctgggcgcggggtcttagtctctccgagccttgctctcctggccaggtgtttccatagcaacaggacggggcagccaagatgacgtgcgcaagcgcagattgcgcgatgcctatcgagggactcttggtccccgaggtgggggagga

SEQ ID NO: 82523 - DNA, 30 bp, Homo sapiens
  chr19:12963030-12963060
  hypo
cagctgggcctcacccgtgacccctttcca

SEQ ID NO: 82524 - DNA, 62 bp, Homo sapiens
  chr19:12969408-12969470
  hypo
cagaacttgatcctccgcaaccagatccagcaggcctttgtggagcgcgatatcctcacctt

SEQ ID NO: 82525 - DNA, 30 bp, Homo sapiens
  chr19:12976945-12976975
  hypo
tcgaggggtgggatccgggaagagggaccc

SEQ ID NO: 82526 - DNA, 106 bp, Homo sapiens
  chr19:12977473-12977579
  hypo
agacaggtatcaccacgtgaactcctatgacgaggatgacacgacggaggaggagcccgtggaaatccgccagttctcttcctgctctccgcgcttcagcaaggtg

SEQ ID NO: 82527 - DNA, 160 bp, Homo sapiens
  chr19:12978416-12978576
  hyper
ggcggcctgaccctgcgtgagaagacctggagagggggctctccggagatgtgagcaggggaatggcggagtttgggggcggggtcgaagggggcgtgtcttccataaccacgccccctccatgcagcaagcgattctccgcgtccgaggccagtttcct

SEQ ID NO: 82528 - DNA, 42 bp, Homo sapiens
  chr19:12985184-12985226
  hypo
gggctgtggccaaggcggcgctgagcccggtgcaggaacacg

SEQ ID NO: 82529 - DNA, 809 bp, Homo sapiens
  chr19:12996071-12996880
  hyper
cccctgtaactacagcgggcgccgcgccctttctcatgtccggggccccgccccctcacctgtgtgcgtgcgcagatgcgccttcaggtgggagctcttggtgtagctcttgccgcaacccgggtgcgcgcacgtgtgcgctgcctgcctcttgcgcgcccacgaacgtcggcctcgcttggatggcgcggtctcggctatcacacctggatcctctgcagtccccccgagtccagtgcccaccgtcccgggtcccaaacaactcaggaaggagggggacgtggcgggaccgggcgcgggtccctggagcccgcggaagagctggaagtgcccttggtactgaggcgccgggtacatcgcggggtacccggacagtagcccgtagggggcgcccgacgccgcaggcactgaaagcccggtccgcgggaagtagccacccgaggagccggcgccgggccccgggtacaccggttgcagcgccagcgccttgggctcgggggccggggctggagccagggctgggcccacgaaggcgtcgggagcccgggctcgcagggcagggcgcacccaacccgagtgatcctccgaacccaaaagcccagccaccagccccgggccgccagcatatgcgcccagagtctcgggcggcggcggatattgcgccccggaggcctcgctgggcgccagagcgcaggtctggggcgcgccaccgggctccgggcccgagaagttggtgaggaggagatccaggtcccaggtggcgtccgcgcccctctcatcgtcctcttcctccccgggctggtcctcag

SEQ ID NO: 82530 - DNA, 45 bp, Homo sapiens
  chr19:1301300-1301345
  hypo
gcttttgtagggggtcggcggggcgggccgcgttgccaggcctgg

SEQ ID NO: 82531 - DNA, 443 bp, Homo sapiens
  chr19:13029873-13030316
  hyper
tgcgtcagtcagggccgggttcagtcagtcaggaaatttgaggccaggcctgatgagagggagccccaatggcaaaggacaagcggccgggctcgggtccgctggagatggctgggatcgcagccgttccctgcctatctgtccgcccgccccacgcgcgagaaggaaacaagcgccgcgtactccctgtcgctccattccgtattttcccgccttcaagctcgcaccctctgcgcatgcgccgaccccgcccctggccagctgcgctcccgcggacgagtgtgttgtgacgcgtgctcccggccccgccctctttgagaacttgcgcggccaactgggcggggccgaccgttaagcagcagtttcgcggtccgcgggctgcgcgcgcagtcggcgccccttgggagcaggacggcgcgctctgggtgcgcttgtgtgcccct

SEQ ID NO: 82532 - DNA, 30 bp, Homo sapiens
  chr19:1306675-1306705
  hypo
caaccacacctggctcgggcatgcacctgc

SEQ ID NO: 82533 - DNA, 20 bp, Homo sapiens
  chr19:13071955-13071975
  hypo
tttttttttttgagacggat

SEQ ID NO: 82534 - DNA, 200 bp, Homo sapiens
  chr19:1308145-1308345
  hypo
ccgaggccggaacttcggagtcacctgctccgcacttgagtctggaacgtctcagaccggacccctccctttacagcctgagagagggagagaccctgcccaggcctcccaggggcctgcccacccgacagctcctgactcccccaccctcattggtccagaaatggaaggcttcggcccaggagcgatcaatgcaccct

SEQ ID NO: 82535 - DNA, 90 bp, Homo sapiens
  chr19:13084316-13084406
  hypo
agctgtatgcctgctcgcaagcgttgggcacccgtggtcctgtggtgtctcactggcagctcagcctcccgtcgacgggtgaagatatcc

SEQ ID NO: 82536 - DNA, 30 bp, Homo sapiens
  chr19:1310520-1310550
  hypo
attgtatcccatgaacgttcctgagacccc

SEQ ID NO: 82537 - DNA, 24 bp, Homo sapiens
  chr19:13107011-13107035
  hyper
gcgggactccggctgacctgtggg

SEQ ID NO: 82538 - DNA, 173 bp, Homo sapiens
  chr19:13112120-13112293
  hypo
ctccatgtctcccagcgtccatcactgggtgctacctgcatgtgactccacggatcatcgcacgccctgtctcttgtgtatttggtagtgggggtcggggagcgtgccaccatgcgtgtcagtgtgccggatgtagtctctgtgtcacggtggcgctgcgcacgtcaacgggt

SEQ ID NO: 82539 - DNA, 140 bp, Homo sapiens
  chr19:1311273-1311413
  hypo
ggcacttttgccagccgctcctgcctttgtcgcaaacccaggggtattttcccacaaggtggactcggtgggtttgaaagatggggagctggggacccctggacccggcttaaggctccgtggcccggcccgcatctcct

SEQ ID NO: 82540 - DNA, 46 bp, Homo sapiens
  chr19:13113959-13114005
  hypo
tctcactggcacatgcgggcacaaagaatcacgctgacacacactg

SEQ ID NO: 82541 - DNA, 92 bp, Homo sapiens
  chr19:13119930-13120022
  hypo
accggcacaatctgtcgtccacgcacagtctcacacacaacctgtcacacacgcacacacacacacagcggcacagtcgcacacacagccag

SEQ ID NO: 82542 - DNA, 35 bp, Homo sapiens
  chr19:13201150-13201185
  hypo
gtcagcatcggaccccgggacggcaactttctgaa

SEQ ID NO: 82543 - DNA, 48 bp, Homo sapiens
  chr19:13208430-13208478
  hyper
tcctcgccccatccccgtccgggtacgggggcgcggcaggggtccccg

SEQ ID NO: 82544 - DNA, 262 bp, Homo sapiens
  chr19:13208683-13208945
  hyper
ccctccggggaacaccgggaaggctcgacgctccaggacaggaccagccacgcagacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacg

SEQ ID NO: 82545 - DNA, 30 bp, Homo sapiens
  chr19:13209229-13209259
  hyper
tcttaggctaagaaacgcagtatatacgag

SEQ ID NO: 82546 - DNA, 147 bp, Homo sapiens
  chr19:13213616-13213763
  hyper
ccctctcacccctggcggcgcagcggccggaggatgctggcccagtgcagataagggccaggctgcctggccgcgcctgataaggagcctggctgaccccggaggaaaccagcgggcggggacctagcagcgcgggcctcccggccc

SEQ ID NO: 82547 - DNA, 45 bp, Homo sapiens
  chr19:13213789-13213834
  hyper
cggtccgccacccctcagggcttcgccttccgctcccccagccac

SEQ ID NO: 82548 - DNA, 30 bp, Homo sapiens
  chr19:13226114-13226144
  hypo
gtaccaggtgggccacgtcattgagctgga

SEQ ID NO: 82549 - DNA, 209 bp, Homo sapiens
  chr19:1325788-1325997
  hypo
cagactccagccaggcgccgtggctcacaccaacggggcacagtggctcacaccaacagggcacagtagctcacacccgccgggcacggtggttcacaccagccgggcacggtggctcacacccgccgggcacagtggttcacgccagccaggcacagtggctcaaacccgctgggcacagtggctcacaccaacggggcacagtggct

SEQ ID NO: 82550 - DNA, 148 bp, Homo sapiens
  chr19:1329407-1329555
  hypo
ggacatcgggaacctagaaaatttgaccaacacggaaaagcaccccaaaccaaaccacacagcaacagcaaaactcagactcttagcacctccacccagaaccagtactgtttatacgattccagtcacgacccggcatgtgtcgggt

SEQ ID NO: 82551 - DNA, 30 bp, Homo sapiens; identical to SEQ ID NO: 16444
  chr19:13335742-13335772
  hypo

SEQ ID NO: 82552 - DNA, 45 bp, Homo sapiens
  chr19:13365938-13365983
  hypo
gatcatggccatgatcgtgtactcgaaaggcggagacaccacgaa

SEQ ID NO: 82553 - DNA, 109 bp, Homo sapiens
  chr19:1339058-1339167
  hypo
ggggaaaattggggacgtcgcctatcccgacccctgtgcctgacacgcagcccgtcacagggcgtgggaagcacggggcagttgcggggaccgccgtgttctcagccac

SEQ ID NO: 82554 - DNA, 78 bp, Homo sapiens
  chr19:13397451-13397529
  hypo
gggtcttgggggggccgggattggatgggttccccgggttgttgggcgtccggcggctggcggcgttctgggggttgg

SEQ ID NO: 82555 - DNA, 85 bp, Homo sapiens
  chr19:1340897-1340982
  hypo
gtggtcaccttcccccgccggagccctgcgtacctctcctgtctgtgctttgagagaggagtttttttcccgttgcttctggaac

SEQ ID NO: 82556 - DNA, 115 bp, Homo sapiens
  chr19:1357669-1357784
  hypo
ccccagtcagtcctgcgtgattgtggcgagggcgcgtctggcaccgggaaggtgtagatcatctagaatgacggcgattccgacgccccggtcagtcctgcgtgattggcgaggg

SEQ ID NO: 82557 - DNA, 280 bp, Homo sapiens; identical to SEQ ID NO: 37262
  chr19:13616677-13616957
  hyper

SEQ ID NO: 82558 - DNA, 307 bp, Homo sapiens; identical to SEQ ID NO: 1360
  chr19:13617158-13617465
  hyper

SEQ ID NO: 82559 - DNA, 95 bp, Homo sapiens
  chr19:13617489-13617584
  hyper
cggtttgcaaaggacgccccccccgggacgcagtggaagcttcaaattcctccgaggtccgggtcaggctggcatcttgcaaaaggagtgcgctc

SEQ ID NO: 82560 - DNA, 928 bp, Homo sapiens
  chr19:13617585-13618513
  hyper
gcccattaaaaaaaaataaaaaataaaaaataaaaaaatatatatatatttaaaaataaagaaagacgaaacccaggtctgggtggggagggcaaaaaaaaaaaaaaaaaaaattaagtgcccttctgttttgctggagttcctagaccttaaaaatgctgaaagatctgtagctccaaaaataaaataaaataaaaacaaagaagatgaaagggaagggaaagaggagggaaggggagtaagacgctccagagggttcctaaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagccactcaatagctgcccctggatgcggcaatgcctctccaccctccaaatccctccacctcctccttctctaggttttgctaaaataagactggtgtggagggttgcgggtagaagaaggtaaagaggaaaaaaaaatgggcgcaaaggtctgaaccactggccagcaaacggaaaaggggagcaattgatgagtttaacagtagaaggacccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 82561 - DNA, 163 bp, Homo sapiens; identical to SEQ ID NO: 45723
  chr19:13781908-13782071
  hypo

SEQ ID NO: 82562 - DNA, 30 bp, Homo sapiens
  chr19:1379073-1379103
  hypo
agaggcccccttgtgcgtcccaccccgcct

SEQ ID NO: 82563 - DNA, 30 bp, Homo sapiens
  chr19:1379390-1379420
  hypo
acacacgcagggagacgccaggagccctgc

SEQ ID NO: 82564 - DNA, 32 bp, Homo sapiens
  chr19:13915613-13915645
  hypo
ctgagcggaaacatccgcgagccagggagtcc

SEQ ID NO: 82565 - DNA, 135 bp, Homo sapiens
  chr19:13936577-13936712
  hypo
actgactgtgagctgcgcctcccggggcatgggctgagtgtgagccacttcgctgggggcccggcatttgcgtgagctattcctctgtggctggggactgagcgagaaccactcttggggcggggactgtgagtg

SEQ ID NO: 82566 - DNA, 28 bp, Homo sapiens
  chr19:13943608-13943636
  hypo
agaaagggcacccagcggccgggcgcgg

SEQ ID NO: 82567 - DNA, 120 bp, Homo sapiens
  chr19:13965902-13966022
  hypo
ctcccacatcggccttccaaagtgctgggattacagcatgagtgaccacgccctgcccaactttagaacatttccatcacccgcaaaagaaatctcaagcccattagaaatcattttctg

SEQ ID NO: 82568 - DNA, 83 bp, Homo sapiens
  chr19:13975708-13975791
  hyper
cttgggtgtgtgtctcgcagccccctgcacaccgttccctatgtctgtggcccgcgtgcctttgtgcgcgtgtgctccccccg

SEQ ID NO: 82569 - DNA, 30 bp, Homo sapiens
  chr19:13983835-13983865
  hyper
ttcgtgggggcaggacgcagtcccggggcg

SEQ ID NO: 82570 - DNA, 458 bp, Homo sapiens
  chr19:13988269-13988727
  hypo
tcgccagctcccgaacgcctgtgctctttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtgcctgcacaggtggctgggggggacctgtccgagggtagtggctgagcccccctgtgaagtaagattagccccagtacccacctccaagggttaggggaagaccttagagagagcttagaacagcagttgattttatttacgtatt

SEQ ID NO: 82571 - DNA, 124 bp, Homo sapiens
  chr19:1401700-1401824
  hyper
ctgcggagcgggcaccgcagccccgcgcccggggacgcgaacctgcaggctggggactggaatccccgccttgccgcttacgcgccatagattcctcatctgtcagcaccgcagaaaggccccc

SEQ ID NO: 82572 - DNA, 35 bp, Homo sapiens
  chr19:14029963-14029998
  hypo
gcccacaaggctggccgagccgtggatgtcgctga

SEQ ID NO: 82573 - DNA, 20 bp, Homo sapiens
  chr19:1403814-1403834
  hypo
gaacccgggaggcggaggtt

SEQ ID NO: 82574 - DNA, 141 bp, Homo sapiens
  chr19:14042824-14042965
  hypo
cccacgtggccgatgcggttgccctcgaggtgcagctcctctagggcctcaggcaggtccgggggcacaaaggacagctcattgtggctgaggtccagcatctgggcagggggttatagatggcatcgtggcagccccagg

SEQ ID NO: 82575 - DNA, 184 bp, Homo sapiens
  chr19:14044040-14044224
  hypo
aggccccgcagcggccgcagagccccggcgggcagccctgagctccccagctggttgtgctgcagcaacaaatagcgcagaccacgcgccccgtgcagccgagccgcctccacctgccggatgcggttgcggcccaggtgcaggatagccagggtccggggcaggccggcgggcactgtggtca

SEQ ID NO: 82576 - DNA, 40 bp, Homo sapiens; identical to SEQ ID NO: 45555
  chr19:1409921-1409961
  hypo

SEQ ID NO: 82577 - DNA, 30 bp, Homo sapiens
  chr19:14116323-14116353
  hyper
actgcaggaaaagggcgatgtcaatgattc

SEQ ID NO: 82578 - DNA, 274 bp, Homo sapiens; identical to SEQ ID NO: 45727
  chr19:14181305-14181579
  hypo

SEQ ID NO: 82579 - DNA, 44 bp, Homo sapiens
  chr19:14199744-14199788
  hypo
caaaggcacgggggacggggagtctggcccggtggcaacagaag

SEQ ID NO: 82580 - DNA, 79 bp, Homo sapiens; identical to SEQ ID NO: 45728
  chr19:14209036-14209115
  hypo

SEQ ID NO: 82581 - DNA, 39 bp, Homo sapiens; identical to SEQ ID NO: 45556
  chr19:1424255-1424294
  hypo

SEQ ID NO: 82582 - DNA, 104 bp, Homo sapiens
  chr19:14244886-14244990
  hypo
attacaggcgtgagccaccgcgctcggccacaaccatttttaaatgcaaggaacacaaacaggctgattgaaacctgatctcctgccgtcggggagctgggaat

SEQ ID NO: 82583 - DNA, 370 bp, Homo sapiens
  chr19:14320287-14320657
  hyper
tcctggacttgtgagcggcgtgctcaggaggcaaagagtgcggaggggctggggggcgcgtaaagagccctggcgcccctcaggccttcggctgcgcagccgcagtggaggccgcgccagcaaccgggctccgggaaccaaggcgtccgcgcgcgcacgcagactcgcccgcgcgccgcgtgccccgcgctgcccaggtcggtacccgcgcttcggacaccctgctcccagggcgctcctcgcttccagcctcccactttgcgccttgggctccccatgagccccgctcctgagacaccccacgctctgtgtattccgtcccacgggacctccacgcccacggtgccacgcgcctcgagtaccccatgtt

SEQ ID NO: 82584 - DNA, 30 bp, Homo sapiens
  chr19:14327424-14327454
  hypo
acacaggacggggcgcgctggctcacgcct

SEQ ID NO: 82585 - DNA, 30 bp, Homo sapiens; identical to SEQ ID NO: 45557
  chr19:1437261-1437291
  hypo

SEQ ID NO: 82586 - DNA, 91 bp, Homo sapiens
  chr19:1440112-1440203
  hypo
aggccaagaaggaggcgccgcccatggagaagccggaagtggtgaagacgcacctgcgggacatgatcatcctacccgagatggtgggcag

SEQ ID NO: 82587 - DNA, 30 bp, Homo sapiens
  chr19:1440545-1440575
  hypo
ggcctgcttcaggttcgtggtgtgaggagg

SEQ ID NO: 82588 - DNA, 30 bp, Homo sapiens
  chr19:1442939-1442969
  hypo
ccaggttcacttcagcgtgaacagcagaag

SEQ ID NO: 82589 - DNA, 44 bp, Homo sapiens
  chr19:1445113-1445157
  hyper
ggcacctgctggaggcggcctgtccccgccgccctgctaaagcg

SEQ ID NO: 82590 - DNA, 648 bp, Homo sapiens
  chr19:1446431-1447079
  hyper
ggggggcgcatggggcgagcgcgcggaggctgcagagtcgggggtctagtgccgtcgccgtagagaccgttgccgggaaaccgcctcggaaggctggcggggatggaagcccctctcgtgcgccgctgcgacccccagccccgggtctgcgcaagcgcagggctcgcccagcccagccctcggcctctgcaggagaccctcggacccctcctcactgcgccgacgcggaggctgcgccagctggggcggcgggggcggctgcgggggcatcctgcggaggctcggccctgcgcagggtgggggcctgggccacgccctgcgcttctttgggcctcagtttccccttctgggcgcgagcgtatggcctgctttgacgttcgccgccgctgctgttcgtatccgtccgctcccgaccccagcgcttctccagcctccggaatcgtctgaatttcgcggctgtgacatccctcattggaggggaaactgaggctggggggtgcagcggggagcccaaggtcacgcttcgaggccggagcctcgttgcggagctaaggcgcccgcaagagaacgcggggcgggggccggggagctgtccgcggtgctgacggaggcgcacgtctgccgactcgccgccggggaaactgaggc

SEQ ID NO: 82591 - DNA, 454 bp, Homo sapiens
  chr19:1450041-1450495
  hyper
gccatggcaccagcccgtcttcccgcgccctcattggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagcccagctgcacgtaagcgggtgtgtgtcctcggggaggagggcaggggcgcgacctccgcctcgcgtcgaggtttccatccctggctctcagcattgcccgtcagcacagactctggaccctccatttccccagagtgggagctggaggggaaactgagtcccggtgagctgggcgt

SEQ ID NO: 82592 - DNA, 60 bp, Homo sapiens
  chr19:14508107-14508167
  hypo
accaagcagaatgagcgctggaggcacctggctgtgccaggcgttcgttcattcttctga

SEQ ID NO: 82593 - DNA, 52 bp, Homo sapiens
  chr19:1455211-1455263
  hyper
cagggcctgtccaagcgcctggacgagctgccgcacgtggagacggtgagcc

SEQ ID NO: 82594 - DNA, 363 bp, Homo sapiens
  chr19:14583153-14583516
  hyper
gcgccctcttctggtaggccccggaactgcatccaccctggaggcgcacgcggcgtccctgcagccccccgcgcggccccagtggatgccgaagccccgacgggacacacggtcctgcctgggctcgcagaatggctttttattcccaaaggctctgcgccgcgcacctgggcccagcccagggtgggctggcttagtcgttgggcctctggttgtgcttagaagtggctgaggccgctgtgccgggagctgcgcagcgagctggcctcccaggcgctcggtgttaggcccagccccgcggggccgcccttggctccggccctcgggggcaagaggcgaagcagttggcgcagcacggcctgg

SEQ ID NO: 82595 - DNA, 107 bp, Homo sapiens; identical to SEQ ID NO: 13230
  chr19:14583613-14583720
  hyper

SEQ ID NO: 82596 - DNA, 214 bp, Homo sapiens
  chr19:14584199-14584413
  hyper
gctccagcagatgcacgacaccaccatgataccgacaagctggcccaccatctccacgtcgtgggcgcgagctctgcgtgccgagccgctgctccgagagccgccaaagaaggtggaggccgaagcgatggacgaggcggacgaggcggaggccgagcggggtccgtgcgccccccagcgacgccggctgtcggggcctgaggccgggggaggc

SEQ ID NO: 82597 - DNA, 346 bp, Homo sapiens
  chr19:14584536-14584882
  hyper
cgccagccgcccgggggacccaggccgatgaagcaccacgtgcccgggtactgcagctcatagcggcccacgcgcgccagcggcagcagcgccacggccaaggccaccgcggccaccgcggccagcgccaggcgcgcgcgggcgaccgagacccgcgcggcgtggagcagcggccgcgtgacgcccacgcagcgctccacggccatgccacagcccagcagcagcgggcacaggccgaagaagaccatgcagccgcccaggaagtggcaggccccgccggccggagcgcgccccgcagtgtacagacgcagcaccagcgcgcccgggatcacgtggcccgccaggt

SEQ ID NO: 82598 - DNA, 30 bp, Homo sapiens
  chr19:14586108-14586138
  hyper
gccgctcagccctgccgcccactgcgccct

SEQ ID NO: 82599 - DNA, 30 bp, Homo sapiens
  chr19:1461213-1461243
  hypo
agcgggcgagctctccgacttgggaggaaa

SEQ ID NO: 82600 - DNA, 30 bp, Homo sapiens; identical to SEQ ID NO: 45730
  chr19:14616913-14616943
  hypo

SEQ ID NO: 82601 - DNA, 134 bp, Homo sapiens
  chr19:14630529-14630663
  hypo
ccccgttcttacacacgtgcttctttttcttccccaactacctttataatttggggggacataggtgtgtcacacacctttcaaggcctctgtttcctcaattgtaggcaacacgatcgcgtttggctctgaaa

SEQ ID NO: 82602 - DNA, 19 bp, Homo sapiens
  chr19:14648564-14648583
  hypo
tttttttttttgagacgaa

SEQ ID NO: 82603 - DNA, 30 bp, Homo sapiens
  chr19:14660906-14660936
  hypo
gatgtgagttccatgcgagcagggattttt

SEQ ID NO: 82604 - DNA, 317 bp, Homo sapiens
  chr19:14667536-14667853
  hyper
caccagagctgtctccgtccctgacatcggctttgggactgttcctgagccggctgctgcgggtgcccttccagcaggcgggagtaagtctgtgcggccacaagggggcagtggggagcgtcgcagcctccgccgcttgcagccagtcatcccggtggtgacgggtcagctcggcctctgcaccgaaagtatctcgctattgttagggtttgggttcactgtgaccagctgggcgaggcatcagtgcaccagctctctggccctggcttcctgtggatgggccccttcaagagcatggtcagcgtcccaggagaagg

SEQ ID NO: 82605 - DNA, 57 bp, Homo sapiens
  chr19:14675015-14675072
  hypo
ttccactacatcaagcgcctgctggagacgctcttcgtgcaccgcttctcccatggc

SEQ ID NO: 82606 - DNA, 30 bp, Homo sapiens
  chr19:14711331-14711361
  hypo
cacatgcaatcctcacgacaacctatacat

SEQ ID NO: 82607 - DNA, 46 bp, Homo sapiens
  chr19:1471164-1471210
  hyper
ctggcctctccccagcggagcctgcacgttacggagaccatcacat

SEQ ID NO: 82608 - DNA, 16 bp, Homo sapiens
  chr19:14797872-14797888
  hypo
aacaatggaaaacagc

SEQ ID NO: 82609 - DNA, 841 bp, Homo sapiens
  chr19:1481985-1482826
  hypo
ctgctgctggtccagcgtggaggatgggggacaggaggtgcagtccctcggggagccgccgcggcaggtgtagcaggaggcatggcagctggagcagaccctcagcgcgggcgccgccgtgtgcccaggcccagcggtcaccagccttgtgtggttgaagaaccgcggggggcagtaggccaggcagagctgtcccaggatgtaggcggggccgtcacacgctgctcggggacacgcacgcaaaggcccgtcagcttgccacccgcagcctgttactcgccacccgcccgcctggggccacatgcacgctgcccacggtggccgccaccgcctcccagcagtgggccctgccccgccggcactcaccctggcacagcccctctgtgtcccgctgcacacacgcgctgctggtcacctgggggcctgtaggccgcgctgtcatgtcctcggccgtcccatagagcagcagcgtgtagcggtacaacgtccctggacaggggtcgcgggtgggcacaggaggaaaaggaggctctcggcagcctggtcctggtagtccccgggctccctccccttcagctcccacgcggggccctggactggttcacatctctcagggaattgcacacctactgtgcgcctgtcactggacaccgacatctcccgggtgactgcacacctactgtgcgcctgtcactgggcacctacatctcccgtgttaccgcacacctactgtgtgcctgtcattgcacaccatctcccgggtgactgcacgcctactgtgtgcatgttctcttggagaaggccactgggaaccccttttgcagtgcggtcaccaaggcta

SEQ ID NO: 82610 - DNA, 30 bp, Homo sapiens
  chr19:14839808-14839838
  hypo
gttacaatggtgggacgtgcagttttgaag

SEQ ID NO: 82611 - DNA, 30 bp, Homo sapiens
  chr19:14863133-14863163
  hypo
tcaataccttgtgtccggtttgatcaattg

SEQ ID NO: 82612 - DNA, 89 bp, Homo sapiens
  chr19:14877970-14878059
  hypo
tcggggctgagggtccgccatgtttcctggcacggaagcatctggaaggcaccactgtctgctcccttttcttttctttctttcttttt

SEQ ID NO: 82613 - DNA, 73 bp, Homo sapiens
  chr19:14886822-14886895
  hyper
cgggcgcccctcccacaggaaaacgctgtggccgcctgttggggtgcatgtggcgctgcggttcccagcactc

SEQ ID NO: 82614 - DNA, 146 bp, Homo sapiens
  chr19:14887415-14887561
  hyper
tgtggctttctccatcgccggccccacagacaccagcggcgcctcccgtttctcagacgcatccaaggggtcccgctggagcttcctcgctaccacccccagcggggccccaaagtacttaccgagaaagacgagaaagacgcggc

SEQ ID NO: 82615 - DNA, 49 bp, Homo sapiens
  chr19:1491380-1491429
  hyper
caggtgagccgtcggcgctagcccgtttcgccgacgggcacaccgaggc

SEQ ID NO: 82616 - DNA, 399 bp, Homo sapiens
  chr19:1495001-1495400
  hypo
gctattccgcacccacccccactgcccagcgtcgagctcctgcctgcccttggggagctctcaaccccggtgggggacatggacacgttgaccagttacaggcacaaggctcagggcctagaggcacgatgggggatgtacaggcacatcaggggcagtggacatatcctggaggcggctcctgggaggaggtgacggttgcagtcttcgtcgactgaaaggcggcctgggtaccgtcgtgggggctcagcgggtccccagccctggcacaccaccgcctctctccggcaggagccgtcactctgctaagcctgtatctgctgttcggctacggagcgtctctgctgtgcaatctcatcggatttgtgtaccccgcatatgcctcgtgagtgcacggct

SEQ ID NO: 82617 - DNA, 30 bp, Homo sapiens
  chr19:1495607-1495637
  hypo
tgggccctgccagggcgggcacagccgtgg

SEQ ID NO: 82618 - DNA, 332 bp, Homo sapiens
  chr19:1496340-1496672
  hypo
tatcagcgcgtcgtgcgtccgctgttcctaaggcaccacggggccgtagacagaatcatgaacgacctcagcgggcgagccctggacgcggcggccggaataaccaggaacggtgggtgctcgcaggcgcctggctgcctcaggccatctcccgggtctggacctgtctctctccaccttgcctccctttctgactttggccgccccctctcactgtccgcctctctctctcacgcttccgggaaccagtcttgcaggtcctggcccgtagccgggcaggcatcaccccggtggctgtggccgggccctccactcccctggaagctgaccgt

SEQ ID NO: 82619 - DNA, 152 bp, Homo sapiens
  chr19:1496732-1496884
  hypo
gtgtttgagcgtatgtttgctgtgtgcacatgtattattgtgtgtgcatgttttgtcatgtgcaagagggtgcgtgtgcatgggctcaagtgtatgtttggtgtgtgagtgagcaagggagtgagcatgttttctcacgtgtgcatatgtgt

SEQ ID NO: 82620 - DNA, 32 bp, Homo sapiens
  chr19:15079221-15079253
  hypo
gatgccgatgaagaccgcgatgatggtggtca

SEQ ID NO: 82621 - DNA, 689 bp, Homo sapiens
  chr19:15090040-15090729
  hyper
tgtgtgcggaggccacgggttggggaggtggggagacgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgct

SEQ ID NO: 82622 - DNA, 1 bp, Homo sapiens
  chr19:15090745-15090746
  hyper
c

SEQ ID NO: 82623 - DNA, 306 bp, Homo sapiens
  chr19:15090747-15091053
  hyper
cccccgccccctaaaccgcctccggagccctcggaggccccagcatccctggcggagcgcggggaacaggccctggcaccgcgggacccgctccagcagcctcggcggaggcctggggaaggcgcggctctagtgtcccagtaacaacagccagggagagggctccgctgcccccttctccttgcgggtgcaccttccggccttggccacttggctgctgtgtgcccttgggccaactcctctccctctctgagcctggcttcctccgctaaacaaggaagatggcttggccgaccccacagaaaa

SEQ ID NO: 82624 - DNA, 657 bp, Homo sapiens
  chr19:15121625-15122282
  hyper
caagcagggaccatgcgcgtgttggtacccccggctgagcgcagccaggacacacgcgttggggccccagcatggcgcgaggcagctcaggccatggcgaggaccgcgcacattctgaccgatcgctgcgggcaggaggcggtgaccatgtggcagcccaaggacagcgtgctggacccgaacgtggcccaccacctcggccgcgccgcctacatccagccctggcgcttccgcgtggagatgatcaaaggcggcggcaccttggagaagccgccgccaggcgagggcgtcacgctgtggaagggcaagatgaagccgcccgcctggtacgcccgcctgccgctacccttgcaccgcaaagcgcgcgccctgcagaccaccgaggtggtgcacgcgcacgcgcgtggagcgcgcctcaccgccgcccgcctcggccgcgcgcagcaccagattaacgggcgggtgcgacagctgctgcgccagcgcgaggtcaccgaccacaggctcagcgaagtgcgcaagggtctgcttattaaccagcagagcgtcaagctgcggggctacaggcccaagtctgagaaggtgggaccctcccccacgcccaaccccagcctaactgcaaagactgaggcctccgctatgcggtgtccagccccg

SEQ ID NO: 82625 - DNA, 73 bp, Homo sapiens
  chr19:1516288-1516361
  hypo
ccggtttcttgtgcacgctcggaatctgttccctgcaggcacccagtgccccgggcaccgtccagaattcctg

SEQ ID NO: 82626 - DNA, 370 bp, Homo sapiens
  chr19:15217949-15218319
  hyper
atcgggcctgcgccacgatcgtcacgtcccatcgaagctggagcggatccgggcacccggagcccccattccaacccctcccggccccaggcaactacatctcccagcatcgcccgctcgggccgcgggaaaggggaaaaaaaaaaaaagtttgggccaagcattcccggaatgtgcttcctgctggcgcggggcggggggcgggcggggaggcccgggcggggcggggagggcgcggggcggcgcggccggagcccggggcgcgcactcggctcggcccggcccgggccgcagcatggccgagccgctactcaggaaaaccttctcccgcctgcggggccgggagaaacttccccggaaaaagtcggac

SEQ ID NO: 82627 - DNA, 164 bp, Homo sapiens
  chr19:15220615-15220779
  hypo
cgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcga

SEQ ID NO: 82628 - DNA, 30 bp, Homo sapiens
  chr19:1522696-1522726
  hypo
gacagctcagacactcgggccccgagcagc

SEQ ID NO: 82629 - DNA, 140 bp, Homo sapiens
  chr19:1523753-1523893
  hyper
gcccccaaccccccacgcgcgagagagcctcagtttcccgctcggtaaagcgggcgtatcagcggttcccagccagcccgggtgtgcagggtcggaggagctcgcgggctgagcgcggcccctggcgcccggttggcgtg

SEQ ID NO: 82630 - DNA, 103 bp, Homo sapiens
  chr19:1523906-1524009
  hyper
cgctctggtccgtggaacttccccagccgcggcgtccccgccgctcacgcgccccccactccacggccgggcacctcccgcccctccccgggctggacctgcg

SEQ ID NO: 82631 - DNA, 126 bp, Homo sapiens
  chr19:1524442-1524568
  hyper
cgtgtccgtgggttgcgtgtccggggtgtgggcgtgcggctcggcctcgggatgcgacgctgtgttgcccctgggtgtgtgtgcgagcctggcgagggtctgagtgtgccgcgtctgtgcccgctg

SEQ ID NO: 82632 - DNA, 32 bp, Homo sapiens
  chr19:1525191-1525223
  hypo
gtggagagacctggacgcgcctgcgtccctgg

SEQ ID NO: 82633 - DNA, 364 bp, Homo sapiens
  chr19:1525617-1525981
  hypo
agccgcctgcgaccccgcaacatcgtggctttccacggacactttgctgaccgcgaccacgtgtacatggtgctggagtactgcagccgccaggtgcccaggggcggggagagggcaggattcatgtcagctgtgcccgtctctgtccaccccgtgtccatctgcacctcgccgctgccccccgtaccatcctgtgtgccctctgctgtccattcgccagcgcttcttacgcctacgtagggccaattgtgtccatcctttactcacctgggcacacccaggctctcttgatccacctgggcccagcttacgctgtgctcatcaggcccgtctcagactcacctgtgaccgcctgggcccatca

SEQ ID NO: 82634 - DNA, 305 bp, Homo sapiens
  chr19:1526247-1526552
  hypo
aggtggtgccaggtgcggggccggggccgggcagctgtgcccgtggggaaaggttcgtgccccccctcagtggccacctgggcccatctgaacccgcatgctcctattggggtgggtcatctttgctcacctgtgtgcacctgcgctcacctgtgctcatcccataatcagccataccaccttggccaggctgagcttacatttgccttctaatccggggccgctggtcacccacagtctttggcccacgtgctgagggcgcggcagatcctgacggagccagaagtgcgcgactacctgcgggg

SEQ ID NO: 82635 - DNA, 147 bp, Homo sapiens
  chr19:1527160-1527307
  hypo
gtgtgtgagggaggacgggggagggtgtgcacagagaggtggacaggtgtgggcaggtggcagtggcacaggcaggtcagggcgtatgtgtacagggatacagcgtgtgtgggcgcagggcaggtgtgagcaggcatgggatagcat

SEQ ID NO: 82636 - DNA, 266 bp, Homo sapiens
  chr19:15272249-15272515
  hypo
gctcttcttggaccccgactgtgccgctttgaggccagggaggaaggcccctggaggacagagcagaggccccaggccgtggggaccgggggggctgcggggcccactgggttgatccagcaagcgcacgatgtcctggtgcagtctctcctgggctacgtcccgcggcagcctgtccaggtggtcggtgatctcacggttggcaaagtggtccaacagcagcttggcagcctcatagctgccctcgcgggcggccaggaataggg

SEQ ID NO: 82637 - DNA, 115 bp, Homo sapiens
  chr19:1528065-1528180
  hypo
tcctagcacccaacccggccgagcggcccagcctggaccacctgctgcaggacgacttcttcacacaggtgggcggcggtcctcggcgtggggtccctggcgtggggtccctggc

SEQ ID NO: 82638 - DNA, 739 bp, Homo sapiens
  chr19:15288174-15288913
  hyper
acacacggacagacacgtgggacacaccgatgggcagatagagtgcacagagaaacagacggggcaagtggatgggcaggtggaaagagaggcagggcccacggacaaacagactgggatggatgcatagacagacggatcgatcgggtggatgggctcacttgcaagtgcgctcgcggccaccggcgtggcagtcgaagttgtcgtagaggcaggcgggcgagctgcaggcggggtcgcagcggctgttgttgaagaggcgccagcactgcagcgcctcgcattgccgccaggggtcgcccacgctcagcgagcagtcgccgccgtcccagccgcagcctgggctgttgcactcgcggtcgcagcgctggtccccgcgcttggcctggcaggcggcgcgcgggcaccgcggctcctccgagacctcgggtgccgcggcgggcgcctcgcagcgcggcccggtccagccctgcgcgcaagcgcagcggaagaagggcgcgagcggcgcggggcggcaggagcccccgtggagacagggggcggccgcgcagctggcgttgctggcccccggcggcgaccccgggaagctgcggcaggagggtcccgacaaccctggggggcaggcgcagcgcggcccgcggggcgtctgctggcatgggacgcccaccgggcactgcagctcccggcaggagcgcgccacccgctcgcaacgcggaccccagaacggctgggggtcggg

SEQ ID NO: 82639 - DNA, 357 bp, Homo sapiens
  chr19:15292255-15292612
  hypo
tcagtcatcagagtccgcagtgggtaccaagctgaggactcccccaagtcgttgctgtccccacttcgtcccaggtcccaggccccatcccaagccagagtccctgctctccaagcagaggccccgcccacctggggctgcagtcgggcaggtcctgttcgcagtggaagcctccgtagcctggcgggcaggtgcaggtgaaggaggccacgtggtcggtacaggtgcccgggccgcaggggttgctcaggcactcatccacatcgcgggcgcatcgtgggccggcgaaaccagggaggcaggagcaggaaaaggagcccacgccgtcttggcacgagccaccgttcaggcatgggt

SEQ ID NO: 82640 - DNA, 132 bp, Homo sapiens
  chr19:15298622-15298754
  hypo
tgttattggccctgtcgcccacaagccccgcctcctgattcttgtcggactgtcattggcccgcctcaccctcggcacagcggcactcgtagccatcgggctggtccacgcatttggcgccattcctgcagg

SEQ ID NO: 82641 - DNA, 96 bp, Homo sapiens
  chr19:15300050-15300146
  hypo
cagcccattcacagacgatggagctcccctcaccgatagagcactcgtccacatcctggtcacatgccccacccgtgaagccgggaggacaggtgc

SEQ ID NO: 82642 - DNA, 30 bp, Homo sapiens
  chr19:15306935-15306965
  hyper
tcccacagcccaactcggaggactgagccc

SEQ ID NO: 82643 - DNA, 30 bp, Homo sapiens
  chr19:15311325-15311355
  hyper
ctgatccccgcacctcgagctcccagtctc

SEQ ID NO: 82644 - DNA, 361 bp, Homo sapiens
  chr19:15311593-15311954
  hyper
ctcacctgcagcccccggccccgctagcagcagcagcaggggcagcgcccgcacgggtggcggtggcggtggcggcgacatcgggcgacggcggcggcggcggccacgggcccccggccccatggcggccggccgcgaccctcccctcctccctccttccctgggctccgggcgcgtcccgggccagcctccgcgccgccaacttcgccgaagtgaggcggccgggccgccccgcccccagccctcgaaggctcgccccgccccggggccggcccagcgcgcccccgccccccgcccggcctcccggggtccctgcccaccctccacccgcacagcctgggacgcgcggaccctcggaaac

SEQ ID NO: 82645 - DNA, 298 bp, Homo sapiens
  chr19:15333522-15333820
  hyper
tctgtaccttctcagcgtatctgctcctcttccagtgcctggacttgagtctcgttctccactgcctggaccacgcccatcctcctctgaggccttcccgtcctctggtccggccttctcaccatcccccaagtaacattccagacacacggatctgtccgagaccctcccctgctggcatgtgaagccttttatagtctcacgtcttcctagcccaaactttcctcccagtctcacggaaatgctaaatcatcccggcgtgggaggcttctgtgggtcggggcgcagctttgcaagg

SEQ ID NO: 82646 - DNA, 140 bp, Homo sapiens
  chr19:15334711-15334851
  hyper
gccccgggttggacccggctctgggggtccctgctcggtcgggacagtgggaccgccctgtgctgtggccgcgcgcagccccccgcaggcttcggcgctcgcactcttgcgtgggactgtccaaccgccacagggagctc

SEQ ID NO: 82647 - DNA, 48 bp, Homo sapiens
  chr19:1533726-1533774
  hypo
ctacatgcccaactgcgggaggctggaagccttcgccctgagggatgt

SEQ ID NO: 82648 - DNA, 824 bp, Homo sapiens
  chr19:15342587-15343411
  hyper
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcgaccccacgcgaccccgcagccccgatagcgcccccgtgcgatcaccttgaggttcaggaaaccgtgctcacccagcgaggggtcgctcaggcaggcgggggacgcgctccgacggcgcccgcagcagccgcgccggggccggcacagcacgtgcgtgagcgctatgcagccgtagaccgccgcggccaccagcgccaccgagaacaccaggctccacatgaaggcgcgcagcagcttcagcgacaggcgcgacggcgccagcagcgcggtcaccaccagctccggcatgtcgccgcgctccgggaccacggcggcgctgccggccaggggcacctgcagcagcggcgaagcggtgtcagggctcaggggcccatcgcccttggcctggggcccctccgtgccgtcgggatttgtgggacgcgctgaaggaagaggcgggcggctccgacagaaaacagccagagcgcaccactcacctgagtgccaggtaaacacctgggcgcgacagggacaggaaacaagggtagggtgcggaggctggggaggaagaggttggaaaggggggaaataaatgggcggggcctagcaggtcctgtgcggggcttagggccggggcggggcccaggaagactcagcagcgggtgggtgagggtctaaaggcggcaattccgggccgg

SEQ ID NO: 82649 - DNA, 202 bp, Homo sapiens; identical to SEQ ID NO: 37283
  chr19:15343929-15344131
  hyper

SEQ ID NO: 82650 - DNA, 7 bp, Homo sapiens
  chr19:15344417-15344424
  hyper
cgtggat

SEQ ID NO: 82651 - DNA, 30 bp, Homo sapiens
  chr19:15364996-15365026
  hypo
ctcactggagctctccgactctgaggacga

SEQ ID NO: 82652 - DNA, 94 bp, Homo sapiens
  chr19:15370805-15370899
  hypo
cccgccagggaacaccgagtgcaggcattctgttgggctgacagtctcttgagacccagctgaggcccagccccctgcccggcatcccacagac

SEQ ID NO: 82653 - DNA, 33 bp, Homo sapiens
  chr19:1546860-1546893
  hypo
ctccccaacccccaccgccgcccagtaattcag

SEQ ID NO: 82654 - DNA, 40 bp, Homo sapiens
  chr19:15488544-15488584
  hypo
ctgggattacaggcgtgagtcaccgcgccaggcccttcct

SEQ ID NO: 82655 - DNA, 30 bp, Homo sapiens; identical to SEQ ID NO: 45739
  chr19:15547714-15547744
  hypo

SEQ ID NO: 82656 - DNA, 30 bp, Homo sapiens
  chr19:15551609-15551639
  hypo
gtttgaagcaggccccggagatccagcccg

SEQ ID NO: 82657 - DNA, 174 bp, Homo sapiens; identical to SEQ ID NO: 45740
  chr19:15558347-15558521
  hypo

SEQ ID NO: 82658 - DNA, 30 bp, Homo sapiens
  chr19:15558960-15558990
  hypo
gtgacaggcaggtaacgggtggaccggaag

SEQ ID NO: 82659 - DNA, 385 bp, Homo sapiens
  chr19:15619208-15619593
  hyper
ttttctagggggcagcgctggagtccccgcccagaaccctgcgggagcccggggcgggatgtccgggggcggacccctcggcacggccgggcggggttaaagggttgggccgtgggacggcgcggtcagatcccaggtagtggcgccggtggatccggatcgagggcaggaggctgagacccgcgggtgagtgcgcgcgtggtgagggctgtaacctgagcgcggccgcggcgctgcgctggaacccgaggctcgcgcggttcggtgctggcggggcaagggcgaaggtctgcgcgcggcggcgggcggggcgcagccggccacggggacccccccaggacccaggacggggctgcatgcccggggcactcgtggggagaggggc

SEQ ID NO: 82660 - DNA, 30 bp, Homo sapiens
  chr19:15622487-15622517
  hypo
gggtgatggggccagcgttggggtgctctt

SEQ ID NO: 82661 - DNA, 31 bp, Homo sapiens
  chr19:15630862-15630893
  hypo
aagaaagtctcagcccggcgtggtggctcaa

SEQ ID NO: 82662 - DNA, 62 bp, Homo sapiens
  chr19:1565891-1565953
  hypo
atgtggccatagcctcgctcaaaggcccttgggtgccaggacaagcgcgttcacaaagaaca

SEQ ID NO: 82663 - DNA, 30 bp, Homo sapiens
  chr19:1567524-1567554
  hyper
ttgacgcttttcttgcggctgccgatcacg

SEQ ID NO: 82664 - DNA, 45 bp, Homo sapiens
  chr19:1569221-1569266
  hypo
taaagccacccttgccgggcgcggtggctcatgcctgtcatccca

SEQ ID NO: 82665 - DNA, 386 bp, Homo sapiens
  chr19:15695283-15695669
  hyper
gttgggagtcccagacgaggttcccggcgcgatggggccgggatgggggtcctgggcacagtcagagtccccaccccctcccccgggaactgcatcggccagacgttcgccatggctgagatgaaggtggtcctggcgctcacgctgctgcgcttccgcgtcctgccggaccacgcggagccccgcaggaagctggagctgatcgtgcgcgcggaggatggactttggctacgggtggagcccctgagcgcggatctgcagtgacccaccactgtcaggtctcagagccacccgcgccctcctcaggcacctttgcagattccggggaatcaatctgtgcctgagtcccacagacagccagcagggggcgtcggagaactgcaggg

SEQ ID NO: 82666 - DNA, 33 bp, Homo sapiens
  chr19:1577654-1577687
  hypo
cagggcagagagtggcgccgtcctgcatgcccc

SEQ ID NO: 82667 - DNA, 269 bp, Homo sapiens
  chr19:1578234-1578503
  hypo
ctcttgggaggcacccgtcatcccaagcacatctgtgttcaccaggcagtccccactgccaggacccgactccagggagcccccgtggccccgcagcacctgccctagacgtgctccatctccgggtccgggtcgggctcctcctcctcctcctcctcgtcttcctcgtcgtcgtcctcagcgcaggccttgtccagcggcgcctccccgtcacgggccagctcctccacgtgcgccagcatgtcggccatcagcgcctcctccagccg

SEQ ID NO: 82668 - DNA, 16 bp, Homo sapiens
  chr19:15968359-15968375
  hypo
gcgacagagtgagact

SEQ ID NO: 82669 - DNA, 79 bp, Homo sapiens
  chr19:16013614-16013693
  hypo
ctccaccacagagcccgtgtgggagacgaggtgggcgctctcgatcagccagtgctggatggcccgggtccccgagaac

SEQ ID NO: 82670 - DNA, 32 bp, Homo sapiens
  chr19:16130658-16130690
  hypo
gccatcccggctgcccgcggggctcttgctca

SEQ ID NO: 82671 - DNA, 37 bp, Homo sapiens
  chr19:16186963-16187000
  hyper
ggagaagaaggcctccgacgtacgtgtgcagggatgc

SEQ ID NO: 82672 - DNA, 51 bp, Homo sapiens
  chr19:16232444-16232495
  hypo
atcacagtggctgaacggtgagaaagccaggcatcccgggtagatgctcct

SEQ ID NO: 82673 - DNA, 143 bp, Homo sapiens
  chr19:16275680-16275823
  hypo
ctgctccaggtcccacgcacaaatgtagtcgtcgttgttaaaatctgcagagcaggatggatggggagtgacagcaggtggcaggagggctaggccggctgtgggcacatactgtgcccatgttacaagaaggggaaactaag

SEQ ID NO: 82674 - DNA, 59 bp, Homo sapiens
  chr19:16436279-16436338
  hyper
gccgctttctgctggcgccgcccggccgcctggtcaaggccgagccccctgaagcggac

SEQ ID NO: 82675 - DNA, 119 bp, Homo sapiens
  chr19:16472658-16472777
  hypo
gtcttttccactaaacgggtccccaaacccctttttactttggaacgggtcgccgctgtcagccccgagtggctggaatggatcgggggcctcgggaaagtctgcggaaccaagctggc

SEQ ID NO: 82676 - DNA, 49 bp, Homo sapiens; identical to SEQ ID NO: 45568
  chr19:1654563-1654612
  hypo

SEQ ID NO: 82677 - DNA, 40 bp, Homo sapiens
  chr19:1657945-1657985
  hypo
tgtcctgccacattccggggccgcccgtgcaaacacaggg

SEQ ID NO: 82678 - DNA, 35 bp, Homo sapiens
  chr19:16585115-16585150
  hypo
ccaaacttggctgggcgcggtggcccacacctgta

SEQ ID NO: 82679 - DNA, 40 bp, Homo sapiens
  chr19:16608429-16608469
  hypo
gattacaggcgtgagccactgcgcccggcttggctacttt

SEQ ID NO: 82680 - DNA, 58 bp, Homo sapiens
  chr19:16620382-16620440
  hypo
cgaggcaggcccaggcgaggagctgggcatcacagggaaaggccgcctctgcagaggg

SEQ ID NO: 82681 - DNA, 54 bp, Homo sapiens
  chr19:16638261-16638315
  hypo
cacctggaaaggccacgctgcgaagccaaccaggccccacgggcaagggggaaa

SEQ ID NO: 82682 - DNA, 68 bp, Homo sapiens; identical to SEQ ID NO: 45744
  chr19:16638668-16638736
  hypo

SEQ ID NO: 82683 - DNA, 135 bp, Homo sapiens
  chr19:1667706-1667841
  hyper
aggctccgaagagggcggcctgacaggcatctgggagccccggcccaggcgaaggtatttcctcctggcccagggcgccgtggggtcccggggcagctggtggggccgccaaagggtggccgtgtgtgtggcggt

SEQ ID NO: 82684 - DNA, 31 bp, Homo sapiens
  chr19:16684446-16684477
  hypo
agcctgggtgacagagcgagacccagtctca

SEQ ID NO: 82685 - DNA, 30 bp, Homo sapiens
  chr19:16693656-16693686
  hypo
agcaccaaagccctgcggcaggggagaggc

SEQ ID NO: 82686 - DNA, 201 bp, Homo sapiens
  chr19:1672902-1673103
  hypo
ttgacccgaggcacacgtggtcctgtgtggttggtgtgtttctgaatgaacagtgttcacgtagattcaggtgtgccacacgtgatgtatacggggcatgcttatgcgtgttctcgcatgctcgtgtgcattctagcatgtgtgctcactcctatacacaggtttgcatgcgtgtgctggcatgtccgtgtgggtgcacac

SEQ ID NO: 82687 - DNA, 84 bp, Homo sapiens
  chr19:1676120-1676204
  hyper
cagcgctcccgggaacgggggatgggtaactggggcccccattttgtgttttgggtttggaaattgaggcgcagagaggggtgc

SEQ ID NO: 82688 - DNA, 226 bp, Homo sapiens
  chr19:16939668-16939894
  hypo
agcaaaaattcaccacgcaaggccctatattagggcgctgggggctcatacctcatcgtcccgtcaactctataaagcaggggccaacaaactttttccataaaaggccagatcgtaaatacttcagggtctgcagatctgtaggatctttagcaactacctactctgttgtaaggcgaaagcaggcagagaagccaggtaaacgcgtgggcgtgtctgtgtgcta

SEQ ID NO: 82689 - DNA, 48 bp, Homo sapiens
  chr19:1699130-1699178
  hypo
ctccgagtggagggccgggcggggcgggcgccgcgggggcctgggagc

SEQ ID NO: 82690 - DNA, 96 bp, Homo sapiens
  chr19:1699504-1699600
  hypo
cgatccggcctgtctcggagtcaggacttgaatttccttcgaactgcaaggggctctgccttctacagagccggggcggggcggccctgacagtgg

SEQ ID NO: 82691 - DNA, 303 bp, Homo sapiens
  chr19:17007086-17007389
  hyper
aagccaggtcatccccgtaggtggaggacgacgaggccggcagccgctgctctggaaggaagggggcctcggtcgggagggcgtggcggggaggggacccaagggccgaggggaggagatccgtggcccagagcagcagcgatggtgtccccgaggctaggcggggggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctggg

SEQ ID NO: 82692 - DNA, 347 bp, Homo sapiens; identical to SEQ ID NO: 1363
  chr19:17007446-17007793
  hyper

SEQ ID NO: 82693 - DNA, 160 bp, Homo sapiens
  chr19:17008359-17008519
  hyper
cccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcagggg

SEQ ID NO: 82694 - DNA, 114 bp, Homo sapiens; identical to SEQ ID NO: 4603
  chr19:17008585-17008699
  hyper

SEQ ID NO: 82695 - DNA, 32 bp, Homo sapiens
  chr19:17048874-17048906
  hypo
gtgtgagccaccgtgcccgggcagcctaacct

SEQ ID NO: 82696 - DNA, 48 bp, Homo sapiens
  chr19:17049220-17049268
  hypo
tgcgctgtaggtgtacgcccgggggactccttccgcctgaaacaaaga

SEQ ID NO: 82697 - DNA, 333 bp, Homo sapiens
  chr19:17137026-17137359
  hyper
acttctcagccaagacgctcctcttaccttcataccttggacaactggaaatcgccacccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactca

SEQ ID NO: 82698 - DNA, 76 bp, Homo sapiens
  chr19:17137395-17137471
  hyper
cgccgacagcagcaggagcaggagcgggagcaacggccagagcagggcgccgctcatttttcggctcctggggggc

SEQ ID NO: 82699 - DNA, 50 bp, Homo sapiens
  chr19:17137729-17137779
  hyper
cccatctccggaccccgacccgccccgatcccttccggggatcgtcccct

SEQ ID NO: 82700 - DNA, 90 bp, Homo sapiens
  chr19:1718840-1718930
  hyper
cgggaggagaggaggcggctccgtgctgcggggtgccggggcgcagagcccgcggcgggagctgtcagcgccgatcgtggggagggggct

SEQ ID NO: 82701 - DNA, 32 bp, Homo sapiens
  chr19:1719135-1719167
  hyper
tctgccccccacccacgcgaggctgcagcccc

SEQ ID NO: 82702 - DNA, 579 bp, Homo sapiens
  chr19:1725526-1726105
  hyper
ggaggctccgcggcgcggtcccgcaggcgggaggcgatgctgccgacgctattgctgccattactattacggagagatggggcggggcgggagcaccgggcccttcccggaagcccttcctgagcttattcagtgcctggggccgcggcgatcgatgacagctgggcgccggccgagccccctccgggccgcgcgggggcgcatgcgcggggccgcgggatcgatcggccgcgctcgggcctccccgcacccgcccgaccccgcccccccggctcgttgcccggcaacctctgcccggcgcgctcccattggctggcggcggcccgggccccggccgcgcgtggtcacttggtcagcgcgggctcggcgtggccgggggcctggctccgggcgcgggtcgatgccgcctcgcatctgacctttcccggcgcggggagggggcccgagaggatggagagagctggaccatcttggaagaaaactttattgacccgtctcttatcttggggacgcacggttccagcggcggggggcgagggtacggctgggtgggggcaggggcggccaggaccttcctcc

SEQ ID NO: 82703 - DNA, 72 bp, Homo sapiens
  chr19:1726136-1726208
  hyper
cggccatctccctgggcgggctgctctccattccctagacaggaaaattgaggctcacgagggcccggggat

SEQ ID NO: 82704 - DNA, 137 bp, Homo sapiens
  chr19:17264960-17265097
  hypo
gcctgccctggcccccgaacccgctcccagaaggcagcattaaaagaacccattcattcccctggtcctggggccctgccccaccagctccagccaaaatcactctggcacgccacccttgccggcccaggaatgcc

SEQ ID NO: 82705 - DNA, 86 bp, Homo sapiens
  chr19:1729190-1729276
  hypo
gcagaggcacgccagcgtctgactgtgtgtattgttaagagtgttgtggggtacacgtgtgtatgtgagctcgtgagggtgtgcaa

SEQ ID NO: 82706 - DNA, 30 bp, Homo sapiens
  chr19:17321616-17321646
  hypo
gagattctcattgaacggatccagtccatc

SEQ ID NO: 82707 - DNA, 53 bp, Homo sapiens
  chr19:17362406-17362459
  hypo
aatccctgttcagctcggcactctgagaccgtctggctcgccccttctgagcc

SEQ ID NO: 82708 - DNA, 62 bp, Homo sapiens; identical to SEQ ID NO: 45748
  chr19:17365683-17365745
  hypo

SEQ ID NO: 82709 - DNA, 19 bp, Homo sapiens
  chr19:17379193-17379212
  hypo
cagtaagcggctcatcgcc

SEQ ID NO: 82710 - DNA, 628 bp, Homo sapiens
  chr19:17392502-17393130
  hyper
cagaccctgcttgagcgcctccgggtgtcaagggcccctgaggacactaaagctctcgaaccccgatgtggacccccgtgcggcgcggggcagcctggctgggaaccctgctcggccctggagaggggccccccgagccgaggggaggagcggcgcatgcccacaagccccccgcgggaagtaggaaatcgaccgaccaggcggtgcgcttcggacccagccagggcatgtgctcggaggcccgcctggctcgcaggttgcgggatgcgctgcgggaggaggagccgtggtgagggcggggccgggggcgggccaggagtgggggtctttggccggggtccactctgaccgcggtgtttgcagggcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatccgggaaggggcgccccatcatcccgggccaggcctcggggctcgagggtggggttta

SEQ ID NO: 82711 - DNA, 21 bp, Homo sapiens
  chr19:17398566-17398587
  hypo
atggagcctgccaggcgcggt

SEQ ID NO: 82712 - DNA, 104 bp, Homo sapiens
  chr19:17399513-17399617
  hypo
gcctgtgtgatgaggcgtgagcagggctgggaccctcctcaggatcattgtgcaaccccagcctcccctgttgcttctgggaacctgtttatccactataaaat

SEQ ID NO: 82713 - DNA, 821 bp, Homo sapiens
  chr19:17404590-17405411
  hypo
ctcctgggttcaagcgatccgccccactcagcctcccaagttgcagcgattattggcgtgaaccacctcgccgggctagtatccagggctattctaagtgctaaggatccccagaccctttctaatctgaactcgctaattagagtttctaatctaaagatcccctggtgccggtcttctagaattatataggtcaccggtctcatacaaatcctccgctgtgaggagagccttcttacagcggtggggacagtgcgtaattgctaacacctgtccagggcagccctgctttctagattctacttctgatgctagacctaatgctcctgtttgcctggggtcagaacaagatacagcaactagaggccacgcccacccggcagccacgccccctcgggaagaaagcacgcccaccaagcgctaccacgccccccgcagaggccacgcccctcccgggcagcaccctggggatttgtagctgtggcgccccaggtgcccgcctctacctcggccatgcgctggtcttcctccaccggcacaaacttatcgtgcatgccgtggacaagcaggacgggcacggtgagctcggcgtggtagacctcgtcgccctcgggccagtactggccgctcatcatggcccggagtacgaaggatgacacgttgaaagcgttgccctcctttaacagctgcttctccttggctccttggcgggcgaagccggccctggtggtggtggaggcaccgctagagccccttatgccagcccgactgccgtggggtgcccccgatgccagccctagtcccagcggtacagtcccccc

SEQ ID NO: 82714 - DNA, 30 bp, Homo sapiens
  chr19:17415369-17415399
  hypo
gccagagctggattccgtccagacacctac

SEQ ID NO: 82715 - DNA, 490 bp, Homo sapiens
  chr19:17438072-17438562
  hypo
gcttggccatttcctcggccacccagcccgggatatcggggatggccacgtggatgaggtacttgaggagcagagcgaagtgctgcaggggtggcagagaggaggctgcaggctgcagacgctggggccgccctctcgcctcccagctgcccccgcccctgtcgccggccccacctcgagcactaccaccgacacgatggctgcctccgggctcagccaggggaagaggcgctgcagctgcccgcactggccgattaagtagcagttgaccacaatcgctaggacacccatggcctccatcaccttctgcagggcggcaggagggctcaggcggggtccagccggcctccccagaccccaggctcctcccagctgcacctgggctccctctgggcctcagctcggatctcttggcttccccccacctgccactggccgatgctttccacgcgctggccgaagggccgctgcagcccggtgcacagcttga

SEQ ID NO: 82716 - DNA, 246 bp, Homo sapiens
  chr19:17449212-17449458
  hypo
acgtgcatggaggcccggcagtggtgagcggcgtcctgcaggccttgggtgagttgcagcgttgggtgagatgcttggtcctcccaatgggcctgggtggggaccagggggtgtcagactgggaccttcctgcaggcagcgtgccagggcttcgaccggcggaggcaggcgagttcaccagacgggcgttcgccaatgggaagctgaacctgaccgaagtggaggggctggcggaccttatccacg

SEQ ID NO: 82717 - DNA, 76 bp, Homo sapiens
  chr19:17462843-17462919
  hypo
cgtgctgcatctgcacgacgccatcgctatatctcttcgtgacgtctacatggccacgtgacgccatcaccacggt

SEQ ID NO: 82718 - DNA, 65 bp, Homo sapiens
  chr19:1746791-1746856
  hyper
agctcccccaactgccgggtccagagggtcctgcgctccctgggatcgcccgaagggctgggtcg

SEQ ID NO: 82719 - DNA, 60 bp, Homo sapiens
  chr19:1748879-1748939
  hyper
gcccaacgcgggtttcgttgcgtcggggaagtccgtggcctgcagcgtccagtccccagg

SEQ ID NO: 82720 - DNA, 30 bp, Homo sapiens
  chr19:1749288-1749318
  hyper
agcagcctgacctcccgcctgagcccggac

SEQ ID NO: 82721 - DNA, 38 bp, Homo sapiens
  chr19:1749518-1749556
  hyper
tgctgagggaggggacgaggacgcggggccccagggac

SEQ ID NO: 82722 - DNA, 415 bp, Homo sapiens; identical to SEQ ID NO: 37107
  chr19:1749776-1750191
  hyper

SEQ ID NO: 82723 - DNA, 618 bp, Homo sapiens
  chr19:17501171-17501789
  hyper
tttctgtgcagtttccgttcaggacgtctccagggtctaaagctgagtgtcgcatccagcgtgggggtgcctctatacacgtccccgcagaccccccccccatatgtgtcctccaggccgacgcccccttccggcagggggccgactcaccctcgtgcgcgccgcgccggccgccggcagcccccggagggtccggagcgagagcgcgagcgagggctgggccggggtcgggaccccgagcggggacgcggccggggcactctgcgctgtgggctcatctcggcttccaggacgttactgccgggaagggggaagggggctgtcagcctctggacccctgtccccagacatcgccagccctcatccgccagagcgtccctttgctgggaactccatccccagagatccccatctcccagggtttcccgctccccaggatccggcatccgttctcgacccccagccattcccgggacgcctccctagagactcccagctacatccccagaagctctgtccccctaccaccagcctctccctcgatactcccttttccttgctcccttctcttccgttccccgtccctctcggggctcccaccgacgctggatcctgggg

SEQ ID NO: 82724 - DNA, 88 bp, Homo sapiens
  chr19:1751409-1751497
  hyper
cccccacctggtctgcgcttcttgagcctgggatgctagcgttttatggcggctgattgatttttagatctcacgattatttttaatt

SEQ ID NO: 82725 - DNA, 36 bp, Homo sapiens; identical to SEQ ID NO: 37108
  chr19:1752836-1752872
  hyper

SEQ ID NO: 82726 - DNA, 42 bp, Homo sapiens
  chr19:17531354-17531396
  hyper
ggagaacgtggtggccgatatccagatcgtggtggacaagag

SEQ ID NO: 82727 - DNA, 692 bp, Homo sapiens; identical to SEQ ID NO: 37109
  chr19:1753502-1754194
  hyper

SEQ ID NO: 82728 - DNA, 726 bp, Homo sapiens
  chr19:1754224-1754950
  hyper
cggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggccagaccctgggggcgccggctctggactcccgagcacctagcggggcggcggccgatgcccggggccagcgcccc

SEQ ID NO: 82729 - DNA, 50 bp, Homo sapiens
  chr19:1755177-1755227
  hyper
ctcattgtgtgtgtgcgtgtgtgtgtgtgagcgcgcgcctgttgggggga

SEQ ID NO: 82730 - DNA, 171 bp, Homo sapiens
  chr19:17559117-17559288
  hyper
cctggcccagcccctcggcgcgcagcccccgcagctcggcgcggcccgcctgcagctgaaacagcagctgcgcgcccagcgccgccagcacggccgccgcgatgcccagcagggtcattgcagccagcacccggccgccgtaagaacgggccatggcgggggttcctgcgg

SEQ ID NO: 82731 - DNA, 62 bp, Homo sapiens
  chr19:1755964-1756026
  hyper
cacagggacaatagccgcggcggctggcgcctgatcgatcgcttctccgagcacaagggcga

SEQ ID NO: 82732 - DNA, 840 bp, Homo sapiens
  chr19:1757222-1758062
  hyper
acccaggtgggtgttcgctcctgccgaccccacagccatccaggcctccgccgtcccctttctgccacggggagagttgcagatggggaaacaggctccgtttgtgcctcgccttcctgacttgtgacaatgacaaacagtctcagctctgggagtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgcggggttcacgccgtcaaccttgcgcacctgtcgcgtctcaggtgccctgggggccgcgtctacaccaccggactccgcctggggcgtaagaggtggcgggggcgagggccgcggggtcactaggctccggcccaggcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggtgccgagtg

SEQ ID NO: 82733 - DNA, 87 bp, Homo sapiens
  chr19:1758717-1758804
  hyper
gctctcccctggcgccgtctccaacagtaattatgggagaggggctgggggaggggcgggcgggctcctcggcgggggtgggggcgg

SEQ ID NO: 82734 - DNA, 93 bp, Homo sapiens
  chr19:17605703-17605796
  hypo
acatctggtcctcaccggtttttcacggtctatttagatcagatacagcctccctgctagcttgtctgtaaaaatccttgccttttttttttt

SEQ ID NO: 82735 - DNA, 334 bp, Homo sapiens; identical to SEQ ID NO: 37113
  chr19:1762172-1762506
  hyper

SEQ ID NO: 82736 - DNA, 193 bp, Homo sapiens
  chr19:1762627-1762820
  hyper
ggcgccaggagacccgggacccgggaccacgcgcccgcggccttggagcctcagggtcactggtgcgggctccgcaggaaagcgcagcccccagcaggcacccaccatcccacccccgcatcccaccccaggggaaaccgcgccgcaccaggcgcgagtgttcttcttccttgtctggcgccccagaaccgcg

SEQ ID NO: 82737 - DNA, 30 bp, Homo sapiens
  chr19:17627117-17627147
  hypo
gtcacatccacgaagcggccacaccccggg

SEQ ID NO: 82738 - DNA, 30 bp, Homo sapiens; identical to SEQ ID NO: 37115
  chr19:1764269-1764299
  hyper

SEQ ID NO: 82739 - DNA, 30 bp, Homo sapiens; identical to SEQ ID NO: 45752
  chr19:17644708-17644738
  hypo

SEQ ID NO: 82740 - DNA, 391 bp, Homo sapiens
  chr19:1765633-1766024
  hyper
tgcaggtccgtgcttcggcgttcattccttcgtgactctcgggactgcggcccggtggggacacagggctctgggtcactgcgtccacttgataaaccaggaacctgatgtccagagaggccagggtgcgcgttcaaggccactcggcccgcagagcccacccgcgtccccatggctgcagtggtgaggggagcagggggaggcagagaggagcccaccctggggctgggcggacatggatgcgtaacccacaccgcaggcttctgcggggtgacacccagactcaccccaagaccctgcacaccctacagctctcacgtctcacgtccacaccgcgagccagctgcatcccacacagggatgtcacaccaagatccgttgcctcatccac

SEQ ID NO: 82741 - DNA, 30 bp, Homo sapiens; identical to SEQ ID NO: 37117
  chr19:1768342-1768372
  hyper

SEQ ID NO: 82742 - DNA, 130 bp, Homo sapiens
  chr19:17687961-17688091
  hypo
ggctccttaccccagcgactcctcaacgtctgtgccccacagtgaagcacccgcccgcagagccctcccgcttcatctcggctcccaccaagacaccggacaagatgggcttcgacgaggtgagctgggc

SEQ ID NO: 82743 - DNA, 230 bp, Homo sapiens; identical to SEQ ID NO: 37118
  chr19:1769737-1769967
  hyper

SEQ ID NO: 82744 - DNA, 30 bp, Homo sapiens
  chr19:17716509-17716539
  hyper
tgaggtggtgcctcccggtaccagagcccc

SEQ ID NO: 82745 - DNA, 746 bp, Homo sapiens
  chr19:17716778-17717524
  hyper
gaggtcccaccaaggcgcaagccccgtccctccccgcccagcgccctccgcgcaggcgcagtgccgctcggccgaccgcccgcgctaaggcgcaggcgcggcaccgccctcctcggcggagcgcgtgtccgacttgagcttcacgaactccttggccacctcgtcgttgctgcgctgcgagaggattcgcagcaccgtgaggcccgtgtcgtccatgtggatgcggcggccgagcggcagccagcaggcggcgctcccgcgctgggccagctcacgcagctgcagcacggccagccccaccgtgcggtcctcgcgcgcgaagcagtagtccttgacgcacacctgcagctcatagcactcgggacccgcgtcggcgctcagcgtgctgcgtggggaggggcggaacgtgagacaggccacacctactgtgatgccccgcccacggccccgtccccaccgcatttgcgggccacgcccacaccggggtgcccacacctgtcacctcccacgctacgctagccccgcccctgccccgttacttgacctacaaccctgtgcttggccgcgcccacagcagctgaccccgagctgggccacgcccacgcctgttcttcccatttttccacccaccgaaaaatgaccgcatagttttacatccagctcccgcccctcagacaccgccctgcaaggccatgctcccaccctgagatacccgcgcctgtgccctctgccggctgaactgctgc

SEQ ID NO: 82746 - DNA, 250 bp, Homo sapiens
  chr19:17734046-17734296
  hypo
gattctacccttagacggcaggtccgctgcgaaggaggagctgggcttggggtttgggagtgggtagtggggctcctctggacttcagtgggacagggagggtgggcgtggtctccctccctcccagccccgccccctccccatgccccgccccagacagacacaggcacatctaggcgggagggaggatggtgggtgaggagggggcgctgggtgggtggggagaggggtgcagcgacgcggtgggccg

SEQ ID NO: 82747 - DNA, 320 bp, Homo sapiens
  chr19:1775116-1775436
  hyper
tcccgctcgcccgcccgcccgccgctcgcccgcagcctgcaagcgcaaggaacaggagcagcagaaggagcgcgccctgcagcccaagaagcagcgcctggtgttcaccgacctgcagcgacgcacgctgatcgccatcttcaaggagaacaagcggccgtccaaggagatgcaggtcaccatctcgcagcagctcggcttggagctcaacaccgtcagcaacttcttcatgaacgcgcggcgccgctgcatgaaccgctgggctgaggagcccagcacggcccccgggggccccgccggcgccacggccactttctcca

SEQ ID NO: 82748 - DNA, 62 bp, Homo sapiens
  chr19:17756536-17756598
  hypo
tctgccccaggaaatcgtcagattccctcttgaacctctgtttcacgcgggatttgatgtcg

SEQ ID NO: 82749 - DNA, 57 bp, Homo sapiens
  chr19:17758076-17758133
  hypo
tgatgctgatcttggcggaccacttggacgtgccgtccagcacgctctgcttgaccg

SEQ ID NO: 82750 - DNA, 695 bp, Homo sapiens
  chr19:17759137-17759832
  hypo
tggtgccccacccatcgccttgcccttcagcctttccccgccatgcaagccccggggctccccacgccaacccgtggccctgcgctcaggccctgcgctcacgctgcaggcagtcggcgttgagcaggtcctggcacttctcgtggcacttgacaccgcactcggtgcagcgcatgccctgcctcgcgatgccccacagcagcccctcgcactcgtagcagtaggtgggcgtggtggccgtccacacttcgaagttgtgtggcgtcgtgcacgagatggggtagattaaggcttgcagggtcttcttgtaaacgtggtttttctgcagggagggatggggtgcggtttgggggcgcctaacctggcgctgtccctgtcctgccccattccgccccatcactgagcgcggtaaagtcccaggccctcccctgcctccacgctgtcggaatccacgctgccttctgccagtctgtgtcacacacacacccttcctcttcccggggacccacagaggcttggacaattccagaagctcctagcccagtccatccctgacccggggaaaaagaggtgccccacgcaccagctcctcgttgttcaacgtgctggaggccaaggccgaggtgatgcccgctttcctggactggaccagggactggggaggtcacagaagagggagtcgggggggttgacat

SEQ ID NO: 82751 - DNA, 551 bp, Homo sapiens
  chr19:1776192-1776743
  hyper
cggggggctcccacgtgcgggtaaattccagacgcccccgccccgccccgtctgttgagttcactttacctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagcccgcctcctccgggggttcaagatccgagtctagaaggaa

SEQ ID NO: 82752 - DNA, 41 bp, Homo sapiens
  chr19:17767174-17767215
  hypo
ccggaagaggcatagcggctgctacccgtggggctgtgggg

SEQ ID NO: 82753 - DNA, 66 bp, Homo sapiens
  chr19:1776966-1777032
  hyper
cccggctcggggccccgcctgccgagtgccaccccttcccgaacctgagagcgaaagagagagaga

SEQ ID NO: 82754 - DNA, 530 bp, Homo sapiens
  chr19:17790905-17791435
  hyper
ggagggaagggtgttcgcggtgagggaggggattcgggaagggggatgggcgcagaggggagggtggtatcgggggagaggcttggaggaggaagggggctcagagaaggaacccagtctctctccctgtcttccccggtcagtaaatggtccctgagtcaccgtcttcgtcgtcacatcccgccacctccccgcctgcgccgggttgctgtatcagggtcagcggggcggaagcgccacccttccccagcgggcttcgggtcacacgcatgaggctatttatagcgtgggcgcgcggagggcgtgggaggcgcgccggcggacaggggggcggggatgaggggggtgcccactgctgtccccagcgacgagcgggtgaagacaccgcgtcatgcggcctcaaaggtctttggggcccccagaagcgctgactgatgaatgtagtggccgtacccggggaggctgaggcaggagttcaggctgcgggacacccctgcagcctggcttcgcgcctccgtttctgcatctgg

SEQ ID NO: 82755 - DNA, 30 bp, Homo sapiens
  chr19:17792484-17792514
  hyper
tcacggaaggaatgacgtcacctcctccat

SEQ ID NO: 82756 - DNA, 228 bp, Homo sapiens
  chr19:17798506-17798734
  hyper
ggagaaccctcccaccgcactctccttcgaatttccagccgggtccgcgtccatgaggacccgtaacccagcccacaacaccagaccccttccaagcacccctgcaggcttcaatcaaactaccgagcccagactcttcctcactgaccctctaaaaacctggtctacacagacgccccagtctagatcgtttccgggtagaaccccggatacccgtccacgtccaca

SEQ ID NO: 82757 - DNA, 315 bp, Homo sapiens
  chr19:17798754-17799069
  hyper
cgtccacacgacccctccagcagcggccaccaggacccccgagagccctgccgcgtctacacggatcaccccctccggggcccagctgcgtcgacaagggctacccctctcaaaagtccagccacctggactcgggtcaccccccaggaaccccctgggagccgcatccacgcggaccccgaccccagcccgcgtccacacgggtcccccgacccccagcctcgcctcctacctccaacgcaaagcagagacatgtctccgagctcgcaggtgggccggaggcggccgggccggctctgtcgggtcgggctcagc

SEQ ID NO: 82758 - DNA, 140 bp, Homo sapiens
  chr19:17808966-17809106
  hypo
aaacctgcccacccccggtgccaaaagcagcgatgaaaacatctgggctttagatgagaagagtttcacggcacagcatctgtccagctcagcttttgaatggagaatgaatggtaagagctttttttcttctttttgtg

SEQ ID NO: 82759 - DNA, 104 bp, Homo sapiens
  chr19:17836551-17836655
  hypo
ggatgagggtgtcctcgcccagttttcccaccgggctaggtgttgcctggctctaggtggtcccttaccactcctcctccatacagatccgggacatcctggcc

SEQ ID NO: 82760 - DNA, 397 bp, Homo sapiens
  chr19:17905846-17906243
  hyper
agggggactggcaagcggccaaggcggagggaggcaggaaggcgtgaggcccggtgggagggaggaagcgggagaggggcgggagctctggctcaggtaaaaactctttcttcggctcgcgagctgagaggagcaggtagaggggcagaggcgggactgtcgtctgggggtgagtgtcggcagcccccggaggatctggcggaccccagtggtgggggtttgggggtggggaagttgtggctctggagaagcccctgccggtctccaccgcgcataccctgcagatgtgggaacattcgggagccccgagtctcgagaacccggttgccctcacccatccgtaattgtctccggcgttcccaaggccagctcggacctgggtcggggaggaagcctc

SEQ ID NO: 82761 - DNA, 495 bp, Homo sapiens
  chr19:17958475-17958970
  hyper
ccccacccccaaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgagaggaaagtcccactcggctccttcctgtgtgggccccttggtttcctgagccactgtcatttaccgaaagtcagggccctgcgggagctgggggcggggaggcgggcaaggaggggcagaaagttccggaagcctctgcatcagccgccccgttcagaca

SEQ ID NO: 82762 - DNA, 880 bp, Homo sapiens
  chr19:17982786-17983666
  hyper
cagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcc

SEQ ID NO: 82763 - DNA, 324 bp, Homo sapiens
  chr19:17984588-17984912
  hyper
caggtatatcctaggcggccaacaccattggcccggggcactgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcctcggctcctgggtaag

SEQ ID NO: 82764 - DNA, 51 bp, Homo sapiens
  chr19:17994699-17994750
  hypo
gtgggtggccttgggcgccacgctgtacccacccagcgagcagaccatgag

SEQ ID NO: 82765 - DNA, 159 bp, Homo sapiens
  chr19:1799741-1799900
  hypo
agacagagtgagactctgcctcaaaaaaaaaaaaaaattttcctggccccctccaaaggaaaccaggccatctggctacggttccctggttcagattcgggcggaggtgctgggcatggggccagacgtggctctggttctcaggcaccctgagcccct

SEQ ID NO: 82766 - DNA, 279 bp, Homo sapiens
  chr19:1802465-1802744
  hypo
ggaccctggagcagccgtaccagcataaatgaccagtccatagcaggtgtctgtgttgcgaatcctgcagcctcggaggaggaggttgccaatgtccagggagtatttcttgtcattccattccaggcaccccacgaagtggtgcatccgactgttaggcgcctcacacgtcactgtgcctgtgggtggccaggtggtcagtgggtcagtgggctcaggccctcctccccaggttccctgcaccgggtgcaggtgagaacattccggccaccctcacga

SEQ ID NO: 82767 - DNA, 96 bp, Homo sapiens; identical to SEQ ID NO: 16462
  chr19:18041146-18041242
  hypo

SEQ ID NO: 82768 - DNA, 783 bp, Homo sapiens
  chr19:18054252-18055035
  hypo
cggggccgggcttttcggggcaaggctgcgcccaaggccccctgacgctcatgtccacccccagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggcacttgaagcctaagtgagtgggtggggagaggcgggcgaagaatggggagaaggaacagctttggggacctgctgtgaaccgcactgggatcatagctagaaaagacaagagcccccaacagcgcgctccttcctgctgccagctgtgcttcatcggctcctgccagcacccctccttggctgtgccacttgtccagtgaggcacctgctccactgtctcctgcacacgcttagagaggtgg

SEQ ID NO: 82769 - DNA, 65 bp, Homo sapiens
  chr19:1805963-1806028
  hypo
tggagtggggggcagcgttgcaagaggggatgcaagacaaattgggggtgcggcagccctcccca

SEQ ID NO: 82770 - DNA, 30 bp, Homo sapiens
  chr19:18060062-18060092
  hyper
gctcctcaccccccacgacctccaaaccct

SEQ ID NO: 82771 - DNA, 47 bp, Homo sapiens
  chr19:18062162-18062209
  hyper
acagcaagacatatccggcggccctacggactcggagagctggaggg

SEQ ID NO: 82772 - DNA, 179 bp, Homo sapiens
  chr19:18062412-18062591
  hyper
caagaggttcctaatcgcgcaggttggggggagggtgtcaccagcccaacaatgaaatagagaagttttctgtggtttggttctggccacccaggctcccccttcctagctgggaccttccagcccggtcaacgtcgccagctgcccgaagcctctgggtcccccgatcctccccagtg

SEQ ID NO: 82773 - DNA, 30 bp, Homo sapiens
  chr19:1806293-1806323
  hypo
tcaggaagccttccccgggctcccacccca

SEQ ID NO: 82774 - DNA, 135 bp, Homo sapiens
  chr19:18063960-18064095
  hyper
cctcctcttgtcccccgtgtgcccccgctcccagcctcctcaggctgcccaagacctcatcaaaggaaatccctggggggagggggcttatagatggggaagtcaaagcttctggagccacggaggagataattt

SEQ ID NO: 82775 - DNA, 53 bp, Homo sapiens
  chr19:1807156-1807209
  hypo
cagcactcaccatgtcgtccaccaggtcccgggtggcacggatgaagaggagg

SEQ ID NO: 82776 - DNA, 535 bp, Homo sapiens
  chr19:18077737-18078272
  hyper
gcaagagggggagttcgaagaccagccgcatgccggggggttgcagggggcgccggggaatgtgggatctttaaatatgggcggggcttgcggggtcgtcgaaggcggtgccaacccgggctcggccaatcggcggcggctcccgcgtcgcaccgcccccttctctcccggcccgggcgggcgctcgccccccgccgggcccgtggactgggcggcgggggatgcgcctgccgccgccgcccccggccccgccgcccccgggccccgcgcccgctcgctgctgcccgccccgtccgcgaccccggctccggctcccgactgggggtccgcggccgcgcgggaccctctcccctccagccttgtccgcccgctcgggccgagccccgcaggtacagggtgggatgggtgagggtgcgggaggatccaggatctgcagctcagggagcccgaggagggaggcacgtctcggagggggacgcggtttggggcaggggccaagagggagggtctccgtgcggtccggagcctaggagac

SEQ ID NO: 82777 - DNA, 535 bp, Homo sapiens
  chr19:1807905-1808440
  hypo
ggggagctgcgtggccgaggccgtttaggctggggaacagctatgcctcccgatgcccagccctgcccagcaggaaccagcggggcgtggagagggtgccgtcatcagacctggagggtgcatccatccacctttgtcattcaacatgtactgagcgcctcttgtgtgccaggccctgggcagggtagtagggactcagcgctgagggtcccagtctgtggggagtgggacgtgaacccacccatcacacagacaaacacatcgatgctgccaggtggctaggggggacttcctggaggaggcaacacgcctcacctgcaggatgatgatgatgaggaagaacaggttggacacgcggtggaactgctcgtacaggttcagcggcaggaacgagtagaagttgtacttggccgtgcggatgacattggtctggaacgagagccgcgggctgcctggcagaggggtgccatccaggccaggggatgggggtgcccgaggccagacctgcctcacttggcctcgcccagcatcctct

SEQ ID NO: 82778 - DNA, 106 bp, Homo sapiens
  chr19:18084912-18085018
  hypo
tgaggaagatgaggccggcaggcagagagcctcggggaaaccctcaaatgtgggccaccgcctgggccaccggcgggcgctcttcgagaagcggaagcgcctcagc

SEQ ID NO: 82779 - DNA, 395 bp, Homo sapiens
  chr19:18092490-18092885
  hypo
tggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcggggccctcaacaagatcaccttcaacacgcgcttcgtcatgaagacactcatgaccatctgccccggcaccgtgctgctggtctt

SEQ ID NO: 82780 - DNA, 403 bp, Homo sapiens
  chr19:1809486-1809889
  hypo
aaaaagaaagaaagaaaaagaaaacgaaaaccaaaaaaagaaaactatcgagcaaatacaagcagaggcaggactcaggaggagcaaaaaatagattccccgagggtaccacggcagctcctctggagcagggaggcgcgggaggggccgcccaccttgtatttcttcctttgccagcacaggatcaccttctccttgaactgcccgttgtaggcacggttgttggcctggaccttccaggtgaatgctgcagcgagagagccgggcgtcgctggagctcgaggcccaggacaaacacccctaatgaccgcccggaggagggctcatggggcccgtgggacccaggcactggggaggcccgagatgtcagagcccgtaaacagacagtcgggcagcaggcacc

SEQ ID NO: 82781 - DNA, 224 bp, Homo sapiens
  chr19:18103700-18103924
  hypo
acctccccagagcaacggcagcccctcggccatctgggaaccccgcgcggggccctagggtggcatccccgggaggtgggcagggttgggtacatgccgaacaactgtgctgaggttaaaattgccttgtgatttttctcctgctctgcccggtcctgccagggctcagaagtaagtgttctcccaggggcttggtggggctgggaaatcgggggtgcatggtg

SEQ ID NO: 82782 - DNA, 94 bp, Homo sapiens
  chr19:18104399-18104493
  hypo
gggcaggtggggccccggagcagatgggatggggctcagctcctgccggaggagggcacaaggacccgctgtgggctgagtgcagtggcgggcg

SEQ ID NO: 82783 - DNA, 19 bp, Homo sapiens
  chr19:18105637-18105656
  hypo
ccaccgtgcccagcccatt

SEQ ID NO: 82784 - DNA, 139 bp, Homo sapiens
  chr19:1810577-1810716
  hypo
aatccctcccacctgcaccgccccctctgcccaggatcagcacctgagttcctgtcctcatcttggagatcttctctctggccgaggctgcccatgctggtggggctgtgggagagaagggccccgggtcacagcagtg

SEQ ID NO: 82785 - DNA, 30 bp, Homo sapiens
  chr19:1811141-1811171
  hypo
actgaatgggacccccgggctatatgttat

SEQ ID NO: 82786 - DNA, 161 bp, Homo sapiens
  chr19:18118157-18118318
  hyper
caggcacaagggctgcggggaaggtagggtttgccagaggctgaaaattgggaagggaacatcatttcgtaggtaccgctcctgggcgaatgcgccgaggcgcgaccgagtgacggtatgtcaagagcaggttgatgacccgggagcgaggctcttggagg

SEQ ID NO: 82787 - DNA, 93 bp, Homo sapiens
  chr19:18118573-18118666
  hyper
ggccctcaactggggcgagagtcccccgccccaaatcgggctggacatgcctcgagtcacgtcaacgaggggcggctggtgagtgattaagcc

SEQ ID NO: 82788 - DNA, 241 bp, Homo sapiens
  chr19:18118667-18118908
  hyper
agaggctgaaggctctgctaggtgacctcaggcctgggccctgcctctgcacctctttttttcctctttacccccggggtccgcgagagaccagctctggcagcctaagggcttcagtttctccccggggtccgcgagggaagggggcagccggcggtgagcaggggcgtttgttattttgctccacgcctgggcagagccacgccccttgtcgcgctattggtggagtcccttcccgggg

SEQ ID NO: 82789 - DNA, 78 bp, Homo sapiens
  chr19:18118965-18119043
  hyper
cgcacggcgcggggattttctgctccggttggtgagcgcgcctgcgcgttgacggcgattttgcgttctgaggctgca

SEQ ID NO: 82790 - DNA, 30 bp, Homo sapiens
  chr19:18126576-18126606
  hypo
ttgctgctaagaacacgtgtgttcaaggat

SEQ ID NO: 82791 - DNA, 21 bp, Homo sapiens
  chr19:18173288-18173309
  hypo
tctgtaattccaggccgggca

SEQ ID NO: 82792 - DNA, 120 bp, Homo sapiens
  chr19:18175554-18175674
  hypo
attacaggcgtgagccaccgcgtccggctgacttgttggatctttgggcaggtggatctgaggttggaggcaggattggactctggaggcagggcttggacacaggaccaaactgaggac

SEQ ID NO: 82793 - DNA, 35 bp, Homo sapiens
  chr19:18175734-18175769
  hypo
accattaccatggcaacacccggaaattaccgccc

SEQ ID NO: 82794 - DNA, 70 bp, Homo sapiens
  chr19:18193110-18193180
  hypo
gtctggaggggtcttcgtgcctaagacaaatctttgtgatgcttacatctttcagcgtcacctcagccta

SEQ ID NO: 82795 - DNA, 86 bp, Homo sapiens
  chr19:18207919-18208005
  hypo
ggtgagatcctcactcgcctcaccctagaacccgttctgctgtgtgtactgggcacattttttgttgttgttttgtttttgttttt

SEQ ID NO: 82796 - DNA, 51 bp, Homo sapiens
  chr19:18241304-18241355
  hypo
gccgtctacctggtgcggcaccgtgacacacggcagcgctttgccatcaag

SEQ ID NO: 82797 - DNA, 30 bp, Homo sapiens
  chr19:18262269-18262299
  hypo
ggtgtcagatacagccgactccagccccag

SEQ ID NO: 82798 - DNA, 30 bp, Homo sapiens
  chr19:18271945-18271975
  hyper
gccgctcgtgacccccgaggcctcggccga

SEQ ID NO: 82799 - DNA, 199 bp, Homo sapiens
  chr19:18272708-18272907
  hypo
aatcctgtgcacatgcgtgggcggacaggccctacccagccctcaccacactccccttccccctaaggagtgagcccagccctgacttcccggcgctgctggtggagaagctgcttcaggaacacttggaagagcaggaggttgcgcccccaggtgagtcccctgtattgctgtcatttcttcccgttgggggccgtaa

SEQ ID NO: 82800 - DNA, 18 bp, Homo sapiens
  chr19:18298268-18298286
  hypo
acaggcataagccaccga

SEQ ID NO: 82801 - DNA, 23 bp, Homo sapiens
  chr19:18325046-18325069
  hypo
caagactccgtctcaaaaaaaaa

SEQ ID NO: 82802 - DNA, 218 bp, Homo sapiens; identical to SEQ ID NO: 45769
  chr19:18330991-18331209
  hypo

SEQ ID NO: 82803 - DNA, 130 bp, Homo sapiens
  chr19:18335243-18335373
  hyper
ggatttggcagcattcggtccaagtatgaccgggtctgagttgggtctgatcacgtcgaattggacttggtcacgaagagtttgttcgatgagttcgggagaattcggctacgtccgattgagctcggga

SEQ ID NO: 82804 - DNA, 135 bp, Homo sapiens
  chr19:18336370-18336505
  hyper
gatgccagccacagtcggcgcccacaagccccactccgaaccccagccttgcccccatccctccccacgaggtcacagtcgtttctggaaaggcagggattcgaacccagaggggtggaccgagtgcttagagga

SEQ ID NO: 82805 - DNA, 400 bp, Homo sapiens
  chr19:18336730-18337130
  hyper
ctgcctgccccaggccggcgagggtcaggaggagacgtgagcctcagcccgtcccactctgggcctcacagctggaaggagacagacggctggtcccctgggcctatatccaggcggcgggtggagacagacggagacagagagagacagagtcaccaactgcgagacaaaagtagggtaaggtagggtagagggagagagatacagagaaagcgagggagaggcagagcgtccaagcccggactccggccccggccccagctgtccctggccttgtccctgtccctgcccttcccacctccacaccgggcgtcccggtgaccccgccaggccctctgtccagcctcaccacagcggatgggccaccgtgaagcgccgctgcaggcggatgctctgattc

SEQ ID NO: 82806 - DNA, 371 bp, Homo sapiens; identical to SEQ ID NO: 13259
  chr19:18343439-18343810
  hyper

SEQ ID NO: 82807 - DNA, 138 bp, Homo sapiens
  chr19:18343879-18344017
  hyper
cggatggggcgccggggttgccgccacaggtgcttcggggctctggtcatgctgtggcggccgcgagagcgactcaacctgctgcaagcctctgccccttcgccgacccccaggttctccatgcgccagagaaagggg

SEQ ID NO: 82808 - DNA, 48 bp, Homo sapiens; identical to SEQ ID NO: 45770
  chr19:18383303-18383351
  hypo

SEQ ID NO: 82809 - DNA, 30 bp, Homo sapiens
  chr19:18410211-18410241
  hypo
tggggccacagaggccgttgaatatgacca

SEQ ID NO: 82810 - DNA, 40 bp, Homo sapiens
  chr19:18413086-18413126
  hypo
agctcggggaatcctcgccctcactcgaagtctccttgag

SEQ ID NO: 82811 - DNA, 30 bp, Homo sapiens
  chr19:18456915-18456945
  hypo
actcccaagccctcccgatgtaaacctctg

SEQ ID NO: 82812 - DNA, 55 bp, Homo sapiens
  chr19:18459164-18459219
  hypo
aaagagggtctttgtcgtggggtcaggggaatcggtcagacgaggctgcgcggcg

SEQ ID NO: 82813 - DNA, 95 bp, Homo sapiens
  chr19:18483800-18483895
  hypo
cctagaggccccctccgccctcgcctgggtgctcccagccttactcaaaggagcaggtcggcccggtgcgttgtctcacacctgcaatcccagtg

SEQ ID NO: 82814 - DNA, 117 bp, Homo sapiens
  chr19:18485487-18485604
  hyper
ggaagggcacctgaccgaggccagaggcccagaaaggacagaaggtcatggctggggagaagcaggcaggagaaccgagtcttggccttaactggctggcaacgtaaaacctgccct

SEQ ID NO: 82815 - DNA, 240 bp, Homo sapiens
  chr19:18523277-18523517
  hypo
aaaaaaaaaaaaaaggaggaggcggaggctggagctctagacagacgaggtgaggaatgggcattgtcagggtacctcgaagtcagatctggtgcctccactccctgatttgtgtccccaggcaagttgctttgctgctctgaacctttctcagacataggtgagtgccacctatgggtctctcacacgacacccttgatgccgtgatgagcctcagtttccccatctgtaacatgggga

SEQ ID NO: 82816 - DNA, 77 bp, Homo sapiens
  chr19:18523577-18523654
  hypo
aggtgggaggactgcttaagcccgggaggtggaggctgccaaggcagctggttgaggttcagcgagagcactgaagc

SEQ ID NO: 82817 - DNA, 153 bp, Homo sapiens
  chr19:18528822-18528975
  hyper
gtcctagggagctggcggcccacccacgcgcggagacacacacgtgcacattcggcacacacttgtgcacgcaacctcactgagcgactcggcccgactcggacccacaactgccaccgcgcagccagggacagtcgccgagacagcgataat

SEQ ID NO: 82818 - DNA, 61 bp, Homo sapiens
  chr19:18544595-18544656
  hyper
ggaccttcctgcacccgttcccgagcgaaagcgtaagcgactgcgtcgactccccccccgc

SEQ ID NO: 82819 - DNA, 30 bp, Homo sapiens
  chr19:18547884-18547914
  hyper
cctgagtcagcgagccgtagtagttggcct

SEQ ID NO: 82820 - DNA, 494 bp, Homo sapiens
  chr19:1856962-1857456
  hyper
cgaccggggcaggggcgcgcagccgctgggaacacagctgccgcacgtagctcggcggcggcggcggggacatccgcagccccagccggccccgctcacgtggtcccactcccgccggggccagggggcccgggccagggtcgcctctccggcctgggtgcctgccagccccgccccgcgcttggagactgaggcgcgcacatgcgcacgtgggtggcggggcagggggtgcacgggctacccacccacgctgcgctgggcgaagcgcctctgcgaaatgccaggccctgcctcgcacacaatccactcgcagggaggagggtggggtgaacttgtgggggcccagagcgcgctgctcctagccagccgggcccccaggtgcacagccacccagctgctccgcgctacctggccgagacgcagcgccctgaggatgcggtgggtggggacaacgcgggagggcagtgtgggcggggccgcggtggacttgaccc

SEQ ID NO: 82821 - DNA, 30 bp, Homo sapiens
  chr19:18572176-18572206
  hypo
ggccatgcccagaaacgcatccatggcccc

SEQ ID NO: 82822 - DNA, 79 bp, Homo sapiens
  chr19:18600734-18600813
  hypo
gaataagggcccagacgcgcactgagcagagatatggagctggccctgaccacgctgtggagcccgtgctggtccctca

SEQ ID NO: 82823 - DNA, 30 bp, Homo sapiens
  chr19:18627227-18627257
  hypo
cctcaccatcattaacgttgaccgccggtg

SEQ ID NO: 82824 - DNA, 120 bp, Homo sapiens; identical to SEQ ID NO: 45772
  chr19:18681763-18681883
  hypo

SEQ ID NO: 82825 - DNA, 142 bp, Homo sapiens
  chr19:18707322-18707464
  hypo
atgaggccgtgtctcaaaagaaaaaaaaaagaaaagaaaacaaggaaacagaggctctagctggtttcggactggccgctggatcacccagccctaggagggtgctcaccactgcggggagtggaggcggctgtggggtggc

SEQ ID NO: 82826 - DNA, 126 bp, Homo sapiens
  chr19:18714455-18714581
  hyper
ccccctgaatgccagcgctgccctgcacttgccctcactgccccagatgggcgaggtggggtggacacggttcttgggccggccctgatgattttccggggcaaacttggctcgagggctctgtct

SEQ ID NO: 82827 - DNA, 293 bp, Homo sapiens
  chr19:18714789-18715082
  hyper
cgggtgtgccagcgtctctgccccggcccacccaccgcttcctgcctgggcccccccaacagagtgggaggcacggccaggcctgcccagaccccaggcccctctcagcccttctagagtgggtctcactcctcctgcccccaccacccgccagcttggcctgggcaggaaggggctctctggggggtcctggctggggggcgctgcccctctgccacacccgcctggcctgggccggcgtggctcacttgccagcagctgcagctgccctcccggggctgggcgggggacac

SEQ ID NO: 82828 - DNA, 15 bp, Homo sapiens
  chr19:18715120-18715135
  hyper
cgggcctggacagac

SEQ ID NO: 82829 - DNA, 45 bp, Homo sapiens
  chr19:18716238-18716283
  hyper
ccggggtggcccgtgcgcctggatggggtgcgtggagtgactgaa

SEQ ID NO: 82830 - DNA, 112 bp, Homo sapiens
  chr19:18716735-18716847
  hyper
cagcctggctgaaaacggttctaagcgccgccggtggcggggactccgcggacccccgtgcgccgggtcccgcagggggagggcggtggcgccggcccgtggagacacaagt

SEQ ID NO: 82831 - DNA, 255 bp, Homo sapiens
  chr19:18718127-18718382
  hyper
tcacccccagccccacgccctcggcgcgcgggttccagccctcccacctcatcctgcctcttttcgattctccgcgagtagcctcggccccaggctttgctggaagaaaggagaaaaagcaggaaggcacggagtccctcgccttcgccctggctgcgctgtccccttcgcgcgcgggatgggtttgaggttgctctgggcgccccgggggcctcgggagggagctcctgcgtgggcagacggggagatgtagtc

SEQ ID NO: 82832 - DNA, 95 bp, Homo sapiens
  chr19:18722263-18722358
  hyper
tcctgactttgccaacgcgtcccggagcctaagtttcccacctgtgaaatgggggacagtattggtcataacgcacagggctgtttcccaaggtg

SEQ ID NO: 82833 - DNA, 39 bp, Homo sapiens
  chr19:18722386-18722425
  hyper
cggaattctcctgctggattctggcgcaaactgcgggct

SEQ ID NO: 82834 - DNA, 93 bp, Homo sapiens
  chr19:18722675-18722768
  hyper
aacccgcagaccctgcgaggctgccgccccgtctgcgggggcggagcgtaggtgggggacctgcgggctgctgcgcggcgctgcaggcacctg

SEQ ID NO: 82835 - DNA, 35 bp, Homo sapiens
  chr19:18723362-18723397
  hyper
ctttctcctctctcccgcgtggtcggctcacacgt

SEQ ID NO: 82836 - DNA, 533 bp, Homo sapiens
  chr19:18723427-18723960
  hyper
cgacacccctggggaatagtcccctccatcccatccccctatatatttccttttggccccaagcgccagcagagatcccccgcccgtgggcaccagggaggtgtcctgggacccccgcgatgggatagacggtgggggccgcgatgcacctgccccgcccgacccgcacgcctcgggtgccgcagcgcagctaccccgcccgctctccgcatctcccaccccccgcttcccaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggtgaggcgcgtgcggtgccag

SEQ ID NO: 82837 - DNA, 99 bp, Homo sapiens
  chr19:18788365-18788464
  hypo
cccgtgtggctggagcgagagccgagccgagcataagcatgtggagccgccaggaggagggtattttttttttatttgagatggagtctcactctgtct

SEQ ID NO: 82838 - DNA, 75 bp, Homo sapiens
  chr19:18807949-18808024
  hypo
agggccagggatgcccgagagccaatgtttattatttgccaactggaaacgaagcatggccggggcctcctcctt

SEQ ID NO: 82839 - DNA, 183 bp, Homo sapiens
  chr19:18811499-18811682
  hyper
cacagcctagcagggcgcctgggactggctctgtgggctggccgtccctctggctggggacacggggaggccgagcgtgtccgcaaagacacgcgagctgtccacctttctgggctgcaggggtctgcagaacctcggaacctcggaggggctctctgtctgcttcagcgtctctttctcaag

SEQ ID NO: 82840 - DNA, 175 bp, Homo sapiens
  chr19:18819701-18819876
  hypo
ctcagttcaggcagccgtgtggccaccctggtgactcctccctgccgctccctgctgtcctgtcctccgtggggtgctgtctctaggcccgggaggaaggctgaggggaaggcctcatgggtgcagtgggtaaatgtccacccggtacctcctctgagcccgcatggtgctcgga

SEQ ID NO: 82841 - DNA, 134 bp, Homo sapiens
  chr19:18870877-18871011
  hypo
aggggggtccctgcccgacctgaccaacatccacttcccctccccgctcccgaccccgctggaccccgaggagcccaccttccctgcactgagcagctccagcagcaccggcaacctcgcggccaacctgacgc

SEQ ID NO: 82842 - DNA, 30 bp, Homo sapiens
  chr19:18872102-18872132
  hypo
gtgtgacctgcatcccgggggtggcaggca

SEQ ID NO: 82843 - DNA, 35 bp, Homo sapiens
  chr19:18878375-18878410
  hypo
gtacctggcaatgcccggcccggactccatttctc

SEQ ID NO: 82844 - DNA, 51 bp, Homo sapiens
  chr19:18879358-18879409
  hypo
gctcccagcagccaccgccgcagccccagcccccgccgcctcctccacccg

SEQ ID NO: 82845 - DNA, 194 bp, Homo sapiens
  chr19:18880005-18880199
  hypo
ggccagtccaagaggcggcagcccgttgggcacagcgcctggggcccagggctgggggctgcagctcagaccattggacttttctgcctagggccggctcaggcagacaaaggctgggctttaaccctgtacccacaaaccttcctgactgtccagaccacctgcttgctccagcggcgcgggctgggtggcaa

SEQ ID NO: 82846 - DNA, 30 bp, Homo sapiens
  chr19:18882043-18882073
  hypo
tcgggggcagctccccggaggctcaggtac

SEQ ID NO: 82847 - DNA, 575 bp, Homo sapiens
  chr19:18883509-18884084
  hypo
cactgcctgtagccccgtgttctggaggcaagttggtgggcagcagtggtctcggggaggcatgggggtcagcctggtgtctgcgcatgcttggtctgcccgcactggctctctgagctctcgggctctggcagcgtgtctggtctcgtcgtgtggtactgttggggatggggctggaggggctggagaagcggcaggtgaggcctgtcccaggtgggcagcccaggtggggctggttcctgagtgaggtccctcttgcatgtgagacaggacgggacaggaattaggagtcgagccagtttctctcaggagagagtcactggaatggttggtgaatttttgggccccaagccaaagcgggttagtctgctgggcagcgagcaggtggcggtgttgtcaagcccatgtctgtgtgtctggtgtccgtcgtgcgctgatgcaggaggcaggcggctcatggaggtatagggacatcagtacggggctctcaggggcagatggttctaggtggagccgagacctgccttccctctgcactgggtctccgaggactcacccatcggtcccacaggccc

SEQ ID NO: 82848 - DNA, 82 bp, Homo sapiens
  chr19:18895721-18895803
  hypo
ggctcggccacagcacggaaggggttcgcctgccaatacgtttgctccatctgcttccacatgaccacgtagaagctggagc

SEQ ID NO: 82849 - DNA, 86 bp, Homo sapiens
  chr19:18896272-18896358
  hyper
tccgtggcaggatagcgctgctccccgcttctcacccacagccaggcctgggtcgctgttcattgtctgcacgatctcccttccct

SEQ ID NO: 82850 - DNA, 59 bp, Homo sapiens
  chr19:18896736-18896795
  hyper
tggccccgcccccaccgcaggccccgcccccgccgtactgtccgcgtcctcctggccgg

SEQ ID NO: 82851 - DNA, 20 bp, Homo sapiens
  chr19:18898213-18898233
  hyper
aaaccagccaagccccgccc

SEQ ID NO: 82852 - DNA, 579 bp, Homo sapiens
  chr19:18899038-18899617
  hyper
gtccccgtcggcatccggatcgcaggcgtctccgatgccatcgcggtccacatcctcctgccctgagttgggcacagtcacgcagttgtcctgggggcgggcacagaaggtgtgaggggcgcggtcatgaagtcccgccctccctcctgcccaagcccgccccgctccgcccccacccaccttacggcactggcgctccgggcagcgcagcttctcgtccgggaagccgtctaggtcagtgtcgcgaccacagaggatcccgttgccggcccagccaacggcacactgtgggagagtgtaagtgggtgccctggagtggccgccacccaaccccgcctcaagcccagcccgcccgcactcaccacgcacgaccgcgagccatcgcgctctaggacgcagtctgcatgctcgtggcactcgctgggcgagccgtcggggcagaagcgctgtgcgcgccgctggcagccggacgcctggtcgcccacgaagccgggctggcacgggccgcactggaaggagccctgcgccggagccgccggaggtcagcgcaggccgcccgccgctcgccccacctcccgc

SEQ ID NO: 82853 - DNA, 2391 bp, Homo sapiens
  chr19:18899906-18902297
  hyper
ggtaaacaaaatggacgcccccttcccttctgctccaaaaatggggcccccacacctctcacctgcttgttggccttggcgaaagccagccccacgccctggtgggtggggccgctgtaccccggcgggcaagcctcgcagcggaaccccgggctggtgttgatacagcggactcgggggaagcaggggtgggcgttgcactgggggaggaggggccacagagggtcagagggcttcgagctgggccctgggggccgcacctcgtagtgtctcggatgtggaaagttcaagggccatatgccagtgcttggagctctgagatggaagcaattgtcgcaggggtcaggcacgactttgccttgatgacggcaagggcgcaaccgggagaggagaggagagctgttccctcatgggcgaggggaggaaggatgagggcgggcatccccagcagaggggggcaggggtcgtcggggcgtgcgtgcccggcggtggcggggggtctgggcgtgcgttccctggctgtggaagggtcgttgggactggcgatcccctgcggcgaggagggtagctggggcggaccacccctggcggtgagggagtcgtcggggcgggcgtcactagctatgtagggggttgtgggggcgggcgtcccgggtggtgacggggatggtccttgggttgggcgtccccccgcggtaaggaggtagtctggccgtgcgcccccggaggtgagaggctcttcggggcgaacactcccagtggaggaaggggtctcccgggcggcgagagattggggggcggtagagggagtcgtcagggcggtggagtgtcggggctagcgcacctcgttgacgtcggtgcagtgcgagccgttgcccgtgaagcccgcggggcaggggccgcagcgcgcgccgctctccgtctggatgcaggccacgccggggaagcagaagccgggcgcgcagtggagcaggggccgcacgctgggtaggccggtgcgtactgactgctgcatccctgcgggggggaggggggagaagcggcggggctgatcggtggctcgcccgggggcagagcctatcatggccacgccccggggctggaggcttccccttcccccccaccccccgccccggggcggcccgaaatcctgcgctgtccgcgatcccgccccagaggctgcgcgctctgaccgcggggtctccccggtctcttctctgagtctctgtcccgcttttctgccccgtggcgtctctcacttccccaaaactctctcaccgcttctgtctctttttgtctctgtttctacacaccccatcccattcccgttcgtccgtccacctctccgtcagcctccatctccttccgtctcttttcctccccagctttccctggctctctgtctctgtctctgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacctccgaggccccactgcgctcctctagtctcggtcccgccacctgctttctgcgcccggcacgtcccctacgaacagtccgtgagccccaaacagcctggatcccgggcctctcacgggtcctacagtccgttgtggggccgtgggcacggcgcgggtgctaacgcggcttacccaacgggctctggccctgtccggacgcgccgagggcagccagggtgagcagaagaacgcaggcggtgtcggggaccatggcggtggcggggagctgggtggctgctcgctttctaccgcccacgaggcccgcggggcctatttatccccaaggcacggccggccccagggacggcccaccacagccctgcccaacgtccagcctcaaggtaaacagatggcgctggcccctgcgttcaagtccccgcccggaatgccccgcgaagtcgcccgcggctgaatccgacatggtggggaa

SEQ ID NO: 82854 - DNA, 30 bp, Homo sapiens
  chr19:18956799-18956829
  hypo
aggcatcctgcagaacggggctgtggacga

SEQ ID NO: 82855 - DNA, 16 bp, Homo sapiens
  chr19:18957788-18957804
  hypo
acggcaggtttgggcc

SEQ ID NO: 82856 - DNA, 148 bp, Homo sapiens
  chr19:1896290-1896438
  hypo
gctgggattacaggtgtgagccaccgcgcctggctgtaattgcctcttaaagagaaacaagtcagattggatttgggcgcaccctcaggacgtcatttgaacctaataatctctttaaaaagtcctgtctcggcgggggccaagcaca

SEQ ID NO: 82857 - DNA, 30 bp, Homo sapiens; identical to SEQ ID NO: 45780
  chr19:18975090-18975120
  hypo

SEQ ID NO: 82858 - DNA, 15 bp, Homo sapiens
  chr19:18980703-18980718
  hyper
ctgctcgggcatccc

SEQ ID NO: 82859 - DNA, 343 bp, Homo sapiens
  chr19:18980911-18981254
  hyper
ggcgtcgaaacaggcgccacatgaccgggggaaccggccggagcctgggggcaccctggggctcatcgcgcagtcctagagcctggagcagggcggcggctgggcctgggggcacgggggcgcgggtcaggggcagcgagggcagcagcagggccaggaggaggaggaggtggtggccgcagggaccttgctgcggcggtggcatcttcctcccaggcgatgaccagagagtgcgcagggtccgcggcggcccgggaccagtgggctgagggcggggccggtgtccccggaggggcaggggtcctggggggcgtggccgggaactggaggcaggatgaggggg

SEQ ID NO: 82860 - DNA, 114 bp, Homo sapiens
  chr19:18981331-18981445
  hyper
cgtggccggggtattcggggtggggccgggtccacgggggcggggccgaggggttcagaagcgcttgtccttcaccaggccgttcctcagtggcttcctgggggtcagaaccgg

SEQ ID NO: 82861 - DNA, 167 bp, Homo sapiens
  chr19:18988902-18989069
  hypo
cttccctgaaaccatcgttcccacgtcaccgatggcccccaccggccaaatcagagggcctggctggtcggcaccttccagggccttccacaacctcctgccccggctcctgctcaaacactcctcacgttgcctatgagacactgcacacccgactctgcttgtta

SEQ ID NO: 82862 - DNA, 622 bp, Homo sapiens
  chr19:18989659-18990281
  hypo
ttgggggcctgcccacgaacacgcttggacgggtgacactaaaggagggaacgcggggtgcgggcccctccacactcactcggctttgctgggcttcaggctctgggcctcggctgtgtcatactcccgcaggtccttcagctcgtgcacctggcctgtcaacaccttggctgcaaacgccacgatgtactgcgagaggggaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagggggacggtgccctacccagtccctgtcctatcccgtcctagacccacc

SEQ ID NO: 82863 - DNA, 581 bp, Homo sapiens
  chr19:18994680-18995261
  hypo
tccctcaggaatctccgggcccacatcccctcctcagccttcctgcctctggtctgtcccctcgtcggacccctgagcactctgaccttggaaccctgagcactccgacctgatgtgatcccctccacggcctcctctgtgccccgccgcaacatcagcctccgcactctgtgtgggctgtgcctcggccccctgccacccgatcctgtccttaccggaaggcgtaggaggagacgatgaggatgagagtgaccacgtggtggagcagcatgaccaccgagtccttgcgccaggtgtccatgtatagcgtagcgtagatggagtggccatagaagcttccctggagcaggtaggcggctgcaatgtcccgtggcactgccatgcccggcgtccagtctggggagagccaaatctcacagtcagggccctgcgaagcctctagacgatcgcctccatgacccggtgacaccctccaagccacacgtgtcctcccagtacccaggtaaccatgcgtgtctgactgctggctttccattcccaattctatttttttttttttttctttgagacggagtctccct

SEQ ID NO: 82864 - DNA, 1401 bp, Homo sapiens
  chr19:19006016-19007417
  hyper
ataggcacaaggcagcgaccgggcagctcctgcctcttcccgattacagcgggcaagccggccccgccgccgcacggacccagcagaaaacgggcagcggacctcgctccgggccggggcgcagcccgcatggcagggaggcgcatggcgcaggccgcggtgcgccgagccctcccgttcccggtcctgggcttctcagtgtctggctcggccctgccggaaagagcgcgcggtggccggagccatccaccgcgcggggccccctggtcccaaactgaccggaaagggccgtgcctcggtcccccacgtctcaaacatcccacctgtctcgggccccccatgtcccagactcaccccagcccggccacacccccgcatctacccggttcccccacgcagcactgtctgaagggggcgcgcggcggcccgagagaccttatcctggggctccaacgtcctgggcctctccagcccgaggcccccacccacgttccggcgaccccttcatccgcagcagccagcgctggaagaaaggaacgcgccggcggccccaggtccccggtcccggcttcccccagtccggggtcccctcgtcccggcccccggccacactgacccgaaagaggcgcgcagtggccgcggagcgcagggcggtccagcccagcgcgccgagcgccagcagcagcagctcgggcggcgccaggtgcgcgtgctcagccaggccgcgacgcgccagcccccagccgcagtccgtgcagccccgcgccgccgccagcgcgctgccccagccgcgctgcactagctgcgcgtagctcggcatgggctcgggccccgtcggccccgccgcgggccccgccgccgccataccgcccgctcgcccgccgtgcccgtcgcctgcgcccgcccgcggtagccgacggagccgcgcgccccgcgtcacgcgccgcagctgggccgggggcgcgcgggcgggagagcggagggcggaggggcgggaccggcgcaagctccgccccgctgggggcgcggctggggggcggccagcggggacgcggggcgccctggaggcgggcccgcgcccctgcccgtttcccagcagagaaacccaggcgcgggggccggagctgggggcccgttggacctggaccccgagagaccccgcgcaccgccgtgtcgcgcccccatgcctgccccgcgcgccccccgctcccccaccccaccgcgccgtgcccgtgacggggggcacgggggacactagcaggcagtcccctcgactggcgacccccgcttctcccggccctccagcacgccacgccgctcccgctccatcgccccggcccgctccgacctcaccgttcttggagccctcgctccttctcaaggacccgaggcctggcacgc

SEQ ID NO: 82865 - DNA, 30 bp, Homo sapiens
  chr19:19007899-19007929
  hypo
gccactgaaggccatcgaggaagacactgg

SEQ ID NO: 82866 - DNA, 163 bp, Homo sapiens
  chr19:19042704-19042867
  hypo
gcagatgggaactgccgaggcgcggtctccacagttgcccgggccaggtgggggtctctcggagggaggggtgccctcacccgctgccgcagccgctcggcctctgcacgctgagcctccagctgctgcctccactgggctgcggcggcgttggcctctcgca

SEQ ID NO: 82867 - DNA, 63 bp, Homo sapiens
  chr19:1908377-1908440
  hypo
atctgtggggcgccccggcggctgaggcgtggaccaggcagtgcatgtcgaggagtagcaccc

SEQ ID NO: 82868 - DNA, 30 bp, Homo sapiens
  chr19:19100115-19100145
  hypo
cctgctcttttcccacgggccatggagact

SEQ ID NO: 82869 - DNA, 359 bp, Homo sapiens
  chr19:1912087-1912446
  hypo
gctgaggatggagcccgccccgggcctcgtggagcagcccaagtgcttggaggccgggagcccggagcctgagccggcgccgtggcaggccctccctgtcctgtccgagaagcagtcaggggacgtggagctggtgctggcctacgccgcgcccgtcctggacaagcgccagacctcacgcctcctgaaggaggtgtcggccctgcacccgctccccgcccagcctcacctcaagcgggtgcggcccagccgcgatgccggcagcccccacgccctggagatgctgctttgcctggctgggccggcctcgggcccgcgctcgctggctgagctcctgccacggccggctgtggaccccc

SEQ ID NO: 82870 - DNA, 30 bp, Homo sapiens
  chr19:1914573-1914603
  hypo
ggttccctttcagaacggccagggtgccat

SEQ ID NO: 82871 - DNA, 35 bp, Homo sapiens
  chr19:19214212-19214247
  hypo
ttcttataaggacaccaattcgcatttagggccca

SEQ ID NO: 82872 - DNA, 221 bp, Homo sapiens
  chr19:19218598-19218819
  hypo
acacccaggcccagccggcttcgggaggagccgagagcctctgtggctcctccctgtgcctgggaggcctgagtcccacctgctgggctgctctgtcctggcaggtacagcaacatctttcatgtcttcatccgcatctcgagagaagaggggctgaagactctctaccatggatttatgcccaccgtgctgggggtcattccctacgctggcctgagctt

SEQ ID NO: 82873 - DNA, 70 bp, Homo sapiens
  chr19:19221225-19221295
  hyper
gggtgcgcatgagtgcgaacacacgtgggggtgcaagtgcatgtgtgtatgtgcacgcaggttgctccta

SEQ ID NO: 82874 - DNA, 41 bp, Homo sapiens
  chr19:19256265-19256306
  hypo
acctggcagccctcccggacaccccacgggctcttgagtcc

SEQ ID NO: 82875 - DNA, 418 bp, Homo sapiens
  chr19:19322511-19322929
  hyper
acctgtaaaatgggacggcctcatcctggggcataatggggacgtttaacgcggttcctggggcaaagagaatgggaggagaatcgatgccatcttctcctgggtgcggtgagtgtccaaaaaatgggcggggtggggattttaggcaggggagccccctccctcgcgcagccagaggcctcgggctggcgggggcgcatgcgcagagagccctcgcggcccctttataagcactgaggcggcgctggggccagcggagcgcagggcgcaggggctggacccggcgcggagctggctgagtcggagcgcagcgtcctttgtgcccggcggccgccccgggatgcgtccgagctaggagccaggtgggggatccgtgagggggccgtgttgcgggagaagacttcgggattagagacag

SEQ ID NO: 82876 - DNA, 443 bp, Homo sapiens
  chr19:19334846-19335289
  hypo
cgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtgagggggatacacagggcagggagatgaagactagctcatggggaaggaggttccttgggggctccaggagcacacatctgagagggaccctccccttgtgttgtcaggtatcctatcacccagtcccgtcctggttgctatggcgaccgtagcagccttccaggggttcggagctatgggaggcgcaacccacaggaactctacgatgtgtattgctttgcccgggagctggggggtaagtctgggactggcaggacccggcccctccgcctctctttgagt

SEQ ID NO: 82877 - DNA, 75 bp, Homo sapiens
  chr19:19335756-19335831
  hyper
cccctgacctccacccgcccctcccgcaggcgaggtcttctacgtgggcccggcccgccgcctgacactggccgg

SEQ ID NO: 82878 - DNA, 283 bp, Homo sapiens
  chr19:19373486-19373769
  hyper
ccaagattggggagacggggcacacaccacccgcgcccgcagccccacttaccatcttgcccgcgcggcccccgccgagcggcccctacgcacccggactgcgctccccgcacacccggttaagactgggcaggtccctgcaggcggcgcaatcccggcgtctgcctgcaaggggaggaggaaggcgggcgaggcggggtgtattaaaggggccgcgggggcccacgctcccctggagcagtggctggagcgcgggcggagaaagaagcgctctggacttgga

SEQ ID NO: 82879 - DNA, 35 bp, Homo sapiens; identical to SEQ ID NO: 37328
  chr19:19383770-19383805
  hyper

SEQ ID NO: 82880 - DNA, 151 bp, Homo sapiens
  chr19:19384011-19384162
  hyper
gcgggatgtccatagcggcggctgctggaccccggctcagccccgacgcgttctccagggcgctcggctcctcgttggcggcgagtccgggccgaggctgccagggacccgccccgcacaaaggtcgaccccgctgcgccctgggcaggcc

SEQ ID NO: 82881 - DNA, 200 bp, Homo sapiens
  chr19:19391386-19391586
  hypo
gggtcacacagctaacgagtgacagggcaggaatttgcagagccagagacaagagagctgagacggcatgtgggcagcatgcatgggcgcacgcacaaacgggctctcagaaggcagctccgttgctaacagacaccaggtgtaagcgcgcacagattcagagtctggcgtaagactcagctgtgcgactcccttagctc

SEQ ID NO: 82882 - DNA, 39 bp, Homo sapiens; identical to SEQ ID NO: 45790
  chr19:19391907-19391946
  hypo

SEQ ID NO: 82883 - DNA, 86 bp, Homo sapiens
  chr19:19447944-19448030
  hypo
tcttacattcccaaacgtgactatttcctttcagaattccgttgatgcagcaaagccgctgctgcggaaggcgatccagatctcac

SEQ ID NO: 82884 - DNA, 57 bp, Homo sapiens
  chr19:19540245-19540302
  hypo
gctccttcacatgcacgtagcgcacttgcggctgaagtgggccgggccttgaaggcc

SEQ ID NO: 82885 - DNA, 80 bp, Homo sapiens
  chr19:19542144-19542224
  hypo
gtgggctcctcagatcggccccttctccttcagggttaaactatccctgctcgtccattcaataaatatttattaagcgg

SEQ ID NO: 82886 - DNA, 68 bp, Homo sapiens
  chr19:19613872-19613940
  hypo
ctccagtgggctctccggagtcaggtgcggccccaccgtccctggcatggtcccgatggcctgtttat

SEQ ID NO: 82887 - DNA, 61 bp, Homo sapiens
  chr19:19645864-19645925
  hypo
cccggaagcagaggacggtgctggtcgtgtgtggcccggagcagaacggggcagtggggct

SEQ ID NO: 82888 - DNA, 401 bp, Homo sapiens
  chr19:19649034-19649435
  hyper
ccagggcgggatctgcggtcgcatcccgcccccactctcagtcccagcggccgccagacccgccggagttggacccgagcacgccgcggagcccggaccctccctcggacgctctgccccggccatggcgtcgctgctgccactgctctgtctctgtgtcgtcgctgcgcacctggcgggggcccgaggtgaggcgcctccagcccccgcgcccagcccctgaggctcccgagggcctggcagccggccttgggtgaagccgcactcggggagagaacccagggacccacgcgcttccccggggactgggtccccttcaccagtcggatccccgcgaccacctggggcgcggagcgggcctcatccattctcttccttggctaagccgggagtgtggataa

SEQ ID NO: 82889 - DNA, 356 bp, Homo sapiens
  chr19:19651126-19651482
  hyper
cgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactaggtgagggcggggctggatgacgggggcggggctttgaatgggcggggctggcgaacgccgggaagagtcgtggtgggtggggctgggaggggcaggaccgtgtgggtgtgggcgtggctgggaagagccgggggacccttaggcgtaggacgacgtcagggggcggggccaggcagggcggggcttttgaagagagg

SEQ ID NO: 82890 - DNA, 336 bp, Homo sapiens; identical to SEQ ID NO: 4606
  chr19:19651512-19651848
  hyper

SEQ ID NO: 82891 - DNA, 173 bp, Homo sapiens
  chr19:19651990-19652163
  hyper
cgctggggatgcgtgtcccgggcgtcctctggaggcgcagaagtgcgtgcggcctcggtgtccaggtaggaggggcggggtctggaggctgggacctgtacagaggggaggaaggggaggttaggggctgagcctgggagagagggtggagttagaggcggtgcctggatgta

SEQ ID NO: 82892 - DNA, 30 bp, Homo sapiens
  chr19:19652530-19652560
  hypo
gcccacacagacacccgctcacagcctggc

SEQ ID NO: 82893 - DNA, 62 bp, Homo sapiens
  chr19:19680975-19681037
  hypo
actgcatctggatggcgctgaacttgccgtgaatggcgccgaccatgcgctcaatctcctta

SEQ ID NO: 82894 - DNA, 195 bp, Homo sapiens
  chr19:1969911-1970106
  hypo
cgtcggcaagaagatcggctgcggcaacttcggggagctccgcctaggtgaggccctgctcggtggtaggtggggtcgggaggctgctggcagggccgccccgagtcaccggagcctctggtggggccgcccggggtcactggagcctctggcggggccgccccatgtcactggcaggtgcgttgaatcatcagt

SEQ ID NO: 82895 - DNA, 345 bp, Homo sapiens
  chr19:1970425-1970770
  hypo
caccatgtaaaaggccgcacctggcccacctggctccgtcccttctgctcacaccaacctctcccgggtcggggtctgattgcccgggcaggcgtgaggagcagggccgaggactgagcctctcattggccaggggtgccttccctggggtgggggtgcctgaagatgaccatcaggcctgggggagctctgagcacctttggggccgttcccagtctgtgattagctgggccagggagctgaatcatccccggaaatgtggttaaatttattgctggtgctgccggagctcctgcgggagggcatttggcgtctgttgctggggttgtccggggaacccaggtg

SEQ ID NO: 82896 - DNA, 84 bp, Homo sapiens
  chr19:19737618-19737702
  hypo
gggcagccacccacacgcccacaatgagcatgaccacgcggccacggggcaggcggctgtgcagctgcacggccatcacactgc

SEQ ID NO: 82897 - DNA, 46 bp, Homo sapiens
  chr19:19738622-19738668
  hyper
gccccagaagttagtcggcgggatttgggcgcgagtgcttcccaag

SEQ ID NO: 82898 - DNA, 763 bp, Homo sapiens
  chr19:1978255-1979018
  hypo
gctaggtgggccctgcgctggcggtgctgatggtctctgtccccgcaggaaagaatctctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctggtgcgcggcgggcggggcggggcggggctcggagggaagagggtggccctggaggggagcgcgtgggacggggaggggcccggccgacaccgccgtgcccccctgcagatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagca

SEQ ID NO: 82899 - DNA, 30 bp, Homo sapiens
  chr19:19843300-19843330
  hyper
tgatgagggcaggggcgtttgaacagccac

SEQ ID NO: 82900 - DNA, 453 bp, Homo sapiens
  chr19:19843591-19844044
  hyper
tggggctcccggctgcgggtccagctcccacagagaggaccgagggccgaactgcgcccgcggtggcccccgggtctgcaaaccccggagttgactgcaaggaggtccccggcctcggccacagacggttccaaccagaaacctcccctcggacactggccccgcacactcaccatttcccagcgtccgggaagtcacggtgtcctccctacggatctgtcagtacctgcaggtcacggcgcgacaaaggatgcgctagagccaccttcggccttcaggagcaggtgaaacgcaatcttcccatgggccaggaatggcgacgtccgcactgcgcaggcccagcgtggcgccgctcacatcttttcagctgaggtcctgattggacagatccaatggccccgcctctttatcactgagtgacagcggagcaggaaggggcgtggttgagctggc

SEQ ID NO: 82901 - DNA, 18 bp, Homo sapiens
  chr19:19882729-19882747
  hypo
ttagaaaaggctggtcgg

SEQ ID NO: 82902 - DNA, 441 bp, Homo sapiens
  chr19:1992845-1993286
  hypo
caggcgtgagcaaccacgcccggcccaaaacacattttactaccaggcaggagcctgctgcctcccgggcccgcccccggccccgcctccgcctccagcctcggtccgccccaccccggccccgcctccagccaggcctggccccgcccccgcctcgtaccggccccgcccacctgcgtgagcagcatgaaggcgttgtcggctcgcaggttcttcttcaggaactccacgcaatgggcctcgagcgctggcaccgcgtacttcttggcggtgtatagcgtggtcatcaccgtctccgggccaatctgcacctcgtccgagtagagaaacctgcagaagcaacgcgggtggccgtgaggtgggaccgccatgcccgcccccaggggagagcgtcaggggaccactcagaccgttagactcggccaccggcccttgagctgg

SEQ ID NO: 82903 - DNA, 205 bp, Homo sapiens
  chr19:19932180-19932385
  hyper
agggcacagtcactgcgcagggaaaagacaggacaccccggggacccgctgtcaacgcagccgccatgttatggctggggcggagctgggcaatgagaacttggagcgcagattgtggagctgactgccgggaggcctgagttctgccactgccacagccacagccacttcctccccagttccaaccagcccctctccctctctc

SEQ ID NO: 82904 - DNA, 204 bp, Homo sapiens
  chr19:19932505-19932709
  hyper
cggcacagagcagtgaagacgatagctggatctctggcgtcagcgagagacaatgggcccgccaaagccggaagccggaaaccgtcctgttcgctacagctgcgtggctgattggacggtttccagcccagcgtccctgattggataatgcttgaggccccgccccctcaggtcctgagttacagaagacgtgatccgatgctg

SEQ ID NO: 82905 - DNA, 45 bp, Homo sapiens
  chr19:19977249-19977294
  hyper
aagaagagtgctgctcgcgtccgacctgatcgcaagagcacacag

SEQ ID NO: 82906 - DNA, 30 bp, Homo sapiens
  chr19:19977542-19977572
  hyper
ttgatccgcccgcctcggcctcccagtttg

SEQ ID NO: 82907 - DNA, 300 bp, Homo sapiens
  chr19:20011907-20012207
  hyper
tgccggtccgacatcccaagcgacggggaggggctggttggaaccggtggaaagtgacggtggcgggactcaggtatccccttagtcagctccacaatctgcgccggagttcttgcccagctcggcctcggttcccttcagccataagatggcggctgcgcttatagcgcagcccccaggcgtcctgtctcttcactgtgcggtgactgtgccctggcttggagccctcgctgggcagctgcgcacccgcagagccgcttctctcccagattgtgcagagaccacgggagagtcgtcagg

SEQ ID NO: 82908 - DNA, 874 bp, Homo sapiens
  chr19:20149645-20150519
  hyper
ttccttcaagctcttcggctggacccccaaccacaaaccgtggctgggtgctctctgagcataaatcactgttaacttcaataagttttcaacattttaaaggtgactcccatagtttttaaacaggagaaggaaaagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagctctggatctcacagcatctgcaagtcagagggcaacagaggctgcgacagtcaccgggaactactagagcagaggatactaagcaatgaagatggaccctgagctctggctggagcgagacaaaggccccgccagctccaggacaccgccccctctaccttggctgcgcacctgattggacagttcccactctagcgcccatgattggatacagttccatgccccgccccctcaggtcatgagtgacaggaggcgtgatctgagaatgtgttgaataaggcaagagttacaggtttttcctgaacccttttctggcgcgcttccttcctgaa

SEQ ID NO: 82909 - DNA, 251 bp, Homo sapiens; identical to SEQ ID NO: 37341
  chr19:20162654-20162905
  hyper

SEQ ID NO: 82910 - DNA, 658 bp, Homo sapiens
  chr19:20162906-20163564
  hyper
cgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagagtgaatacagctagggacgtgaagggtaggtctgggctgggcattgaggagggtattaggctaggaagtatacctcacctttgtccaaatcgggtggttcggcctcctctcattggccctatgcagctgggttgcctctctcacccgcacccaagggtctttccagagtgttgcgtcatttccagcccagggagctgccttctttcctaaactgcaatggaaactgtcctgatgtctgagacaatgtccgttgtgccgcagccctctgcct

SEQ ID NO: 82911 - DNA, 23 bp, Homo sapiens
  chr19:20188602-20188625
  hyper
ctcaaggaggaagcccggcctga

SEQ ID NO: 82912 - DNA, 120 bp, Homo sapiens
  chr19:20188745-20188865
  hyper
tggaaaccgtccaatcatgcaggcagctggagcgaagaggaaggctttcgggtttggcgcggccatttgtctcttgctgcagctggtgctccaaatctggtcttagctgcttcgtgtctt

SEQ ID NO: 82913 - DNA, 180 bp, Homo sapiens
  chr19:20189405-20189585
  hyper
aaagggttgttagtacaacgtagttcttcttcaaagacgcaacttcctggtcataagttggaaaagttgtaaatcacccctaccccttcttctcccttctccttttctcacaaatcgcgcattacccgatttggaaaaagcttgagtgtaagccaaccgggatcagcttagattgtgcgg

SEQ ID NO: 82914 - DNA, 30 bp, Homo sapiens
  chr19:2097733-2097763
  hypo
gtttgctccatctcacgctgggggtcaacc

SEQ ID NO: 82915 - DNA, 33 bp, Homo sapiens
  chr19:2098275-2098308
  hypo
tgtcccacaggtcctcggcgcagtggaagtcag

SEQ ID NO: 82916 - DNA, 20 bp, Homo sapiens
  chr19:21265857-21265877
  hypo
tttaagatggagtttcgctc

SEQ ID NO: 82917 - DNA, 30 bp, Homo sapiens
  chr19:2154551-2154581
  hypo
agtcgtgagccaccacgccccatcctattt

SEQ ID NO: 82918 - DNA, 30 bp, Homo sapiens
  chr19:21578373-21578403
  hypo
tatctgttccaccctcggaacagcacagag

SEQ ID NO: 82919 - DNA, 30 bp, Homo sapiens
  chr19:21589791-21589821
  hypo
taacattttttgcctcgggttaaatttgtt

SEQ ID NO: 82920 - DNA, 202 bp, Homo sapiens
  chr19:21646235-21646437
  hyper
ggggaccccacagaccgcagctccttccacgcaggagacccgcacaaccagtcggagtctttccctgatgacctcacaacctggggaagatgacgggctgcgggcgcagagctgcgcaaagagggctacaggctggggctaaagccgctgtgctgaaacggtaaaggacgccccggggtccctgcaccggaggagagtgagg

SEQ ID NO: 82921 - DNA, 16 bp, Homo sapiens
  chr19:21647196-21647212
  hypo
tcacgcctgtaattcc

SEQ ID NO: 82922 - DNA, 36 bp, Homo sapiens
  chr19:21657554-21657590
  hyper
ttatccaatcagtggcgctggcgcgggaaccgccca

SEQ ID NO: 82923 - DNA, 87 bp, Homo sapiens
  chr19:21659146-21659233
  hypo
gtgttgccactacttcgtttatgacatactctttccatggttttcaatgattattctgtctaggtgagtagtcgggaaaataatcct

SEQ ID NO: 82924 - DNA, 17 bp, Homo sapiens
  chr19:21726603-21726620
  hypo
agcactttgggaggccg

SEQ ID NO: 82925 - DNA, 30 bp, Homo sapiens; identical to SEQ ID NO: 45793
  chr19:21727297-21727327
  hypo

SEQ ID NO: 82926 - DNA, 30 bp, Homo sapiens
  chr19:21750501-21750531
  hypo
tctttaatctttttgcggtgactccataaa

SEQ ID NO: 82927 - DNA, 86 bp, Homo sapiens; identical to SEQ ID NO: 37346
  chr19:21769289-21769375
  hyper

SEQ ID NO: 82928 - DNA, 21 bp, Homo sapiens
  chr19:21769579-21769600
  hyper
cgcctgcgtgggactccaggg

SEQ ID NO: 82929 - DNA, 100 bp, Homo sapiens
  chr19:2191591-2191691
  hypo
cccgggccccacccacggctgcagcctgccgcagtccttccctgggcacacctgctccctccacagcggctggaaaggtcccccgcggaggaagacccca

SEQ ID NO: 82930 - DNA, 75 bp, Homo sapiens
  chr19:22005601-22005676
  hypo
gtctcagaaaaaaaaaaaataaagaattgtgttccctatgccactgggttatttcctgttcggtttttcctaagc

SEQ ID NO: 82931 - DNA, 35 bp, Homo sapiens
  chr19:22016818-22016853
  hypo
aactccatcttaaggcggggcgggggaaaaaaaag

SEQ ID NO: 82932 - DNA, 41 bp, Homo sapiens
  chr19:22017749-22017790
  hypo
aaaaaaaaaatagcccggctcggtggctatttttaagtgct

SEQ ID NO: 82933 - DNA, 300 bp, Homo sapiens
  chr19:22018428-22018728
  hyper
ttaaaggcgtgacccaccgcgcccggccgactctcctgtttctaatagaccaaaagagggactagaaatgccacggaccaaagctcttcctattcatgaaactgcatcacgagtcaggattctctcctgacgaccctcctgtggcccctgcacaatttgggagagacgccgcgttgcggctgcagagctgcccacagagggctgcaggccgggacacagtcactgcgcagagaagagacaggacgcccggggctgcctcccagagcagccgccatcttatggctgaaggggattgaggcc

SEQ ID NO: 82934 - DNA, 50 bp, Homo sapiens
  chr19:22018908-22018958
  hyper
cagaggctggacctctagcagcagaggacacagaagaacgaagacgagac

SEQ ID NO: 82935 - DNA, 69 bp, Homo sapiens
  chr19:22018959-22019028
  hyper
cagagctccaactgcagccagagacaaaggccccgccacatcccggaagccgccctgtcctctcctgcc

SEQ ID NO: 82936 - DNA, 89 bp, Homo sapiens
  chr19:22019088-22019177
  hyper
gcccccgcaaaccctgaatgaaagatgtgatcagacgctgggctgaaagaagaaagaatgacagcctaggctgccgccttttcaggcag

SEQ ID NO: 82937 - DNA, 101 bp, Homo sapiens
  chr19:22030099-22030200
  hypo
ctgagcattatgtcacgatacacaaatatgaagggcctaagaaaaataagagtcacatcaccttgatgttaggtctctgtgagcagagaccaggcaggaga

SEQ ID NO: 82938 - DNA, 30 bp, Homo sapiens
  chr19:22031956-22031986
  hypo
acactctctgtaccacgagagatttatata

SEQ ID NO: 82939 - DNA, 17 bp, Homo sapiens
  chr19:22034401-22034418
  hyper
cctcctgcgcacacacc

SEQ ID NO: 82940 - DNA, 3 bp, Homo sapiens
  chr19:22034419-22034422
  hyper
agt

SEQ ID NO: 82941 - DNA, 592 bp, Homo sapiens; identical to SEQ ID NO: 4614
  chr19:22034446-22035038
  hyper

SEQ ID NO: 82942 - DNA, 20 bp, Homo sapiens
  chr19:22037958-22037978
  hypo
gccaccgcacctggccccct

SEQ ID NO: 82943 - DNA, 30 bp, Homo sapiens
  chr19:2213530-2213560
  hypo
cctacaggagaagaacgcccagctcctggg

SEQ ID NO: 82944 - DNA, 63 bp, Homo sapiens
  chr19:2214092-2214155
  hypo
gggtttgttcccagacgaattgcgccacctgtgaaagcttgtcgagcgcgtcacagcaggcag

SEQ ID NO: 82945 - DNA, 26 bp, Homo sapiens
  chr19:22238973-22238999
  hypo
gggggagcactgtctcgtgcctgtaa

SEQ ID NO: 82946 - DNA, 56 bp, Homo sapiens; identical to SEQ ID NO: 45588
  chr19:2243515-2243571
  hypo

SEQ ID NO: 82947 - DNA, 30 bp, Homo sapiens
  chr19:2244206-2244236
  hypo
gacggctccctgcctcgggagtgaccggcg

SEQ ID NO: 82948 - DNA, 31 bp, Homo sapiens
  chr19:2250675-2250706
  hyper
gctacctggtgttagcggtggaccgccctgc

SEQ ID NO: 82949 - DNA, 147 bp, Homo sapiens
  chr19:2251088-2251235
  hyper
gggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggc

SEQ ID NO: 82950 - DNA, 340 bp, Homo sapiens
  chr19:2251610-2251950
  hyper
gggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgc

SEQ ID NO: 82951 - DNA, 1148 bp, Homo sapiens
  chr19:2252588-2253736
  hyper
cggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcgg

SEQ ID NO: 82952 - DNA, 72 bp, Homo sapiens
  chr19:2253780-2253852
  hyper
cgctccgagggcctgcgggggcaagtgcgcgctgcgctgtggtcactggctctgtgccgcccccttccccgg

SEQ ID NO: 82953 - DNA, 120 bp, Homo sapiens
  chr19:22606117-22606237
  hypo
cgcgcccaactaacctgaggtttttaaaaggacacaatccttctaagtaaaatgtgagccacatgtgaattttaaatttcctactagccaaactttaaaaacaaggaacacacggggcac

SEQ ID NO: 82954 - DNA, 215 bp, Homo sapiens
  chr19:22610486-22610701
  hyper
tgtctgtgcttccctcgcccaatctgagagtggcctgttccagggggcgggcttcctctttgtttggcagccaggagtctggagcgcaggtgccgggcaggcagcactgggagcgctcggcgacttggctggaggccgaaggtgccgcccctggggaaccagagcgcctttgcaaggtgggctcggcgtacactcccctatccttctgtggcccc

SEQ ID NO: 82955 - DNA, 30 bp, Homo sapiens
  chr19:22610975-22611005
  hyper
ggccgggacagtggacgcccctgggccggg

SEQ ID NO: 82956 - DNA, 30 bp, Homo sapiens
  chr19:22611307-22611337
  hyper
gcaaatttcccagagcgggaagcctgcccc

SEQ ID NO: 82957 - DNA, 21 bp, Homo sapiens
  chr19:2268114-2268135
  hypo
cgaaagacaggcaggcgcggt

SEQ ID NO: 82958 - DNA, 878 bp, Homo sapiens
  chr19:22715140-22716018
  hyper
ctttttctttgcagccgccaatttgctctgtagggtttcttcagacattgcagggcaggaaggaatgtggggttggggccacgtcagctagattgcggcttaccactggggaacaattcctgtcggccaccgcgcaactgtgcgactgaccagaggaggcgtaaccagggcctactacagcgcagaatagggggcgtggccgccatcctccaagtccattggtcgatgagaaagatgacagagaaaggaggcgaggccaggcagcagcgcgtccaggtgggtgtgaggcgtcacaaggaaagctgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagagttcctttacaggcggacctgagaggcaactcaccgactcctgccctggaccctcctgcgccactgaaccccctgacctgggagcctcggaacctagggctcaggaggtgggtgaggaacggactccacagtttctttcctgactcctcacagccctgccccagaccttcccttcccagaaatcacctccaaggacccctaatcaatgttccagacgcctacctctcggaacgccccattcctagagggtccctaccctgattccgggagcacatttgcccccctttccagctggatccagtcccgggctctcctgcttcccagctcctcctcccgcacccaacagcacccctttcctctcagagcggccgtgggtcccatcaggctttcccctcggatcctctgcaga

SEQ ID NO: 82959 - DNA, 39 bp, Homo sapiens
  chr19:2273981-2274020
  hyper
agattgtagacttggcgagcgggccggggggatattcag

SEQ ID NO: 82960 - DNA, 92 bp, Homo sapiens
  chr19:2274600-2274692
  hypo
gctcctgagagtgggcggagaacgcagggtaaggagctagcgatggcccagagtgggcacctttatttgtttagagaaagtgaaactgtagc

SEQ ID NO: 82961 - DNA, 262 bp, Homo sapiens
  chr19:2275678-2275940
  hypo
tcagtcccacagcagcgccagggcctggcccatcgaggactcggtggcctcggccaggtattcgcaacacagccagtcctcgaggctgggagcttccccacctgcggcccgctctgctaggcgcaggaccagcagcccgcggcgcacccgcagccagggcccgagcgctcggagccagggaccaagcggtgctccgcggccgcgcagctcaggcccgggcccccagagcagcgcctgcagcgcgccccgcgtccgggacgcc

SEQ ID NO: 82962 - DNA, 153 bp, Homo sapiens
  chr19:2276337-2276490
  hypo
ctgccagcgccactgcgcctctccagggcgccccgggcagtgtgccttcaggcaccaggccacacagcccctgcagattgaagtgtggagacagggaggcctgcagctccaggccccacgggtggggcacgtccgccccgggcttgggcacct

SEQ ID NO: 82963 - DNA, 56 bp, Homo sapiens; identical to SEQ ID NO: 37357
  chr19:22806000-22806056
  hyper

SEQ ID NO: 82964 - DNA, 109 bp, Homo sapiens
  chr19:22806297-22806406
  hyper
cgcggggagcccagcccaggggcgtccacagtccaggccccagaccccaggtcctggctagattcgccaaagtcagaggctggaatctggagggcggatgtgagggtgc

SEQ ID NO: 82965 - DNA, 30 bp, Homo sapiens
  chr19:22815493-22815523
  hypo
ctgaatgagaccatacgtctttttatttta

SEQ ID NO: 82966 - DNA, 84 bp, Homo sapiens
  chr19:22817001-22817085
  hyper
ctcagggcctgagggcggggggggggggggtcttaaacgttatccattcagcgacgctggcctgggaactgtccaatcaggcac

SEQ ID NO: 82967 - DNA, 120 bp, Homo sapiens
  chr19:22817385-22817505
  hyper
cgccccaagttcgccttgcccagcccagcctcagtccccttcagccatcagattggcggctgcgctggcagccggacccccgggcgtcctgtctcttccctgcgcagtgacggtgccctg

SEQ ID NO: 82968 - DNA, 579 bp, Homo sapiens
  chr19:2289693-2290272
  hyper
ccccgggttggtagacgggagcccatccccccatccttgcagcccgcacccccaccccccagctcagccaccatagcagggacaggaagacgggttgaaatctttagaaaacgcttgagaaactgcaaaaaagacgcatgctgatgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggc

SEQ ID NO: 82969 - DNA, 238 bp, Homo sapiens; identical to SEQ ID NO: 4574
  chr19:2290630-2290868
  hyper

SEQ ID NO: 82970 - DNA, 392 bp, Homo sapiens; identical to SEQ ID NO: 37129
  chr19:2302559-2302951
  hyper

SEQ ID NO: 82971 - DNA, 109 bp, Homo sapiens
  chr19:23077136-23077245
  hypo
gtgatcctcccatctcggcctcccaagtacctgggactacagggatcttcttcctctgttttttgttttttgttaatttgcttgttttttttgacggtttccatttcat

SEQ ID NO: 82972 - DNA, 36 bp, Homo sapiens
  chr19:2308140-2308176
  hyper
agccgccgccgccgccgccgccgccgccgccgcctc

SEQ ID NO: 82973 - DNA, 36 bp, Homo sapiens
  chr19:23083160-23083196
  hypo
ttcctttggccttcacgttttcgggagcttctctca

SEQ ID NO: 82974 - DNA, 32 bp, Homo sapiens
  chr19:23185625-23185657
  hyper
aaaagacaggacgcccggggaccgggtgtcag

SEQ ID NO: 82975 - DNA, 30 bp, Homo sapiens
  chr19:2324322-2324352
  hypo
gctcccgggagtggccgatgacagccgcct

SEQ ID NO: 82976 - DNA, 107 bp, Homo sapiens; identical to SEQ ID NO: 37360
  chr19:23253781-23253888
  hyper

SEQ ID NO: 82977 - DNA, 300 bp, Homo sapiens
  chr19:23254114-23254414
  hyper
cgactcacaagggacgcgccagagctctggtcccattgagacagttcagctgaaggctgcgggccttcccgagctccgcccagctcacagcggggacggtccctccctcggcagctgccgctggagctccggaggacaagagaacttagagaggtggcctcagtggagcccgacaaccagcgcgaacgtcaacaagacagatcgagatggcaagggcagctcgtgggcgaaatggatccacccgaccccagaaatgatccccgatacgtggctctgcatagaccacgacagagtccagtc

SEQ ID NO: 82978 - DNA, 256 bp, Homo sapiens; identical to SEQ ID NO: 1364
  chr19:23257752-23258008
  hyper

SEQ ID NO: 82979 - DNA, 287 bp, Homo sapiens; identical to SEQ ID NO: 1365
  chr19:23258305-23258592
  hyper

SEQ ID NO: 82980 - DNA, 79 bp, Homo sapiens; identical to SEQ ID NO: 1366
  chr19:23258652-23258731
  hyper

SEQ ID NO: 82981 - DNA, 20 bp, Homo sapiens
  chr19:23295513-23295533
  hypo
gacttcgtctcaaaaaaata

SEQ ID NO: 82982 - DNA, 151 bp, Homo sapiens; identical to SEQ ID NO: 37365
  chr19:23299633-23299784
  hyper

SEQ ID NO: 82983 - DNA, 30 bp, Homo sapiens; identical to SEQ ID NO: 37366
  chr19:23300324-23300354
  hyper

SEQ ID NO: 82984 - DNA, 27 bp, Homo sapiens
  chr19:2330114-2330141
  hypo
tttttttttttgagacggagtctcgct

SEQ ID NO: 82985 - DNA, 26 bp, Homo sapiens
  chr19:2330381-2330407
  hypo
gggatgacaggcgtgagccaccgtgc

SEQ ID NO: 82986 - DNA, 170 bp, Homo sapiens; identical to SEQ ID NO: 45591
  chr19:2331273-2331443
  hypo

SEQ ID NO: 82987 - DNA, 131 bp, Homo sapiens
  chr19:2331903-2332034
  hypo
acacagaaggtgggccggactgtggattcttggcctctgccgtgacccataacatccctcctggaggaggggttctggggggctgtgttggaaggggcaccctccgggctcggcaccggggccagactaag

SEQ ID NO: 82988 - DNA, 74 bp, Homo sapiens
  chr19:2337296-2337370
  hypo
tctgcctaggtgggccgaggccgtgcggggctttaggtgagggctgggatctaactcagcgcaggcttcaggtg

SEQ ID NO: 82989 - DNA, 81 bp, Homo sapiens
  chr19:23386702-23386783
  hyper
aggccggagtctgcccggcccagcccctcctcactcccttggactcttcacggtgtctccgggcccctgcacaatcctgag

SEQ ID NO: 82990 - DNA, 99 bp, Homo sapiens
  chr19:2339493-2339592
  hypo
ctcttcctgctgagccgcctgggtctggggaggccccatgtccagggctctttatgcagatccaagctgcggttgctgcccacacgccagcctctggcc

SEQ ID NO: 82991 - DNA, 40 bp, Homo sapiens
  chr19:23433143-23433183
  hyper
acaaagcagggaagacgagaccaagcgctccagctgcagc

SEQ ID NO: 82992 - DNA, 97 bp, Homo sapiens
  chr19:23577749-23577846
  hyper
gccctgggaaccccacggactaaagtgcttcctattcatgagccagcacctccagtcaggattctcccctgacgaccctcccgtgatccctgcacaa

SEQ ID NO: 82993 - DNA, 157 bp, Homo sapiens
  chr19:23577966-23578123
  hyper
tcttatcgctgaaggggactgaggccgagctgggcaaggagaacccgggcacggattgtggagctgactgaaggaaggcctgaggctcgccacagccgcatcccaccggtttcaacgagccccgttccctctctcgggacgtcgcacctggcagtct

SEQ ID NO: 82994 - DNA, 249 bp, Homo sapiens
  chr19:2358937-2359186
  hypo
cctaagcaggaggggcggccagcgtggcagcgggtggcgcgtcaaaactgaggccacccagtctgaccatgagggagaaaagcaccagacaaacccacttgaggcgtgtcctgcaaaacacctgacctgccttccccaggagcgggcagggtgtcagaaataggaatgtctgggaaactgcgacagcccagagagatccgaggaggcgtgacgcctaaatgccacgtgggatctcgggtggggccctga

SEQ ID NO: 82995 - DNA, 511 bp, Homo sapiens
  chr19:23598357-23598868
  hyper
aaaagagactgggagccccaccggccacagctcctcctacgcacacacgagtcgggattctgccctgatgacccgcctggcatccctgaacaatctgggaaacactcggggctgcgtgcagagctgcccagggagctccagatagggcgccgcagggactgggcgggacgcgcgggtcattgctgcgggcccagccaccatcttgcggccagagggacctgggacggagctgcgccagcagggactcaggtcggcaacccaggagcggtgaggaggccagtcccgtcggtttctcagccagctctcccctctcgggatgctcaacccctcacactcaccctttcccaccttctggaatgtcctggcatcttagctgtctgtgcacgtcccaggacctgcagatcacagggcaacagcctgtcaccggctggggcgagaggggggcagaggtggaggacgttgaatagcagaaagcgatcccaagctctggctgcagcgagagacaaaagcc

SEQ ID NO: 82996 - DNA, 118 bp, Homo sapiens
  chr19:2360226-2360344
  hyper
gcttctgctccacttcggggtgggcgggatccgggcagtagcggtgcagcctcgtcgtccggagcgcggtgagtcggggtctcctgcgggctcagcctcccctcggaacagcccccac

SEQ ID NO: 82997 - DNA, 99 bp, Homo sapiens; identical to SEQ ID NO: 45594
  chr19:2360711-2360810
  hypo

SEQ ID NO: 82998 - DNA, 185 bp, Homo sapiens
  chr19:2363009-2363194
  hypo
ggatcagggtcccagcgctcaggctggcctgaccgtggggtaattgggccctgcagagcctcacgccgcctgcttgtcctgccacgcggaatgggagtccgtgtgtgccccgctgcccacagcgtgtgaacgtgagttggggaccatgtggcccactgcgcgctgggtcccgtccctaaagagca

SEQ ID NO: 82999 - DNA, 209 bp, Homo sapiens; identical to SEQ ID NO: 37369
  chr19:23654103-23654312
  hyper

SEQ ID NO: 83000 - DNA, 41 bp, Homo sapiens
  chr19:2377007-2377048
  hypo
gtggccacgggtgggcggctccctcacgctggcttctcctg

SEQ ID NO: 83001 - DNA, 71 bp, Homo sapiens
  chr19:2389713-2389784
  hypo
ttcagcctctgaccccgtgtttctgtcttgctgtgtggcatccagctcgctgtctgcgtgtctctgagcca

SEQ ID NO: 83002 - DNA, 21 bp, Homo sapiens
  chr19:24099415-24099436
  hypo
agctaccgtgcctggtgaatt

SEQ ID NO: 83003 - DNA, 30 bp, Homo sapiens
  chr19:2410895-2410925
  hypo
gcatcagattctctccgtctgtatgggaag

SEQ ID NO: 83004 - DNA, 30 bp, Homo sapiens
  chr19:2415373-2415403
  hypo
tggctttgtgggctgcgggtctgtggtggg

SEQ ID NO: 83005 - DNA, 386 bp, Homo sapiens
  chr19:24154442-24154828
  hyper
ctctcatggatgcagcgctgacgagggtcgccaggtgcccagggcgcctgccaagcggcccactggccagcgcgtttctgcgccgggccgggtccccgagctctgcagttctccgccctgcctggaaaggaagcggccccgccaggtagtgggatcggccgccgcgtcccgtcctcacccttggccccgagggggtgacatcctcgatgtgccctcggcccagaaaacgcgccgcttcccatggagggcgtcggcgacaggaaggacctcccctgctccttaacaaacgttagggtcgcagtttcctaagagacgcgactgggattgggggagggggtccaggcagagactagtgctgggggcagaggaagcgacactaggctgca

SEQ ID NO: 83006 - DNA, 62 bp, Homo sapiens
  chr19:24215463-24215525
  hypo
agcctctgctgcccccgaccccagccccattccaaatggacatcccacgatatggtcagcag

SEQ ID NO: 83007 - DNA, 163 bp, Homo sapiens
  chr19:24216917-24217080
  hyper
cctggctagttttgtatttctagtagagaagtggttttgccatggtggaagctggtctggaactcaagtgatccgcccgcctcggcctgaccgggaaatagaagcctgaactcagtgactcaagctaaggatagtttagttctgccggcggagcctctcctgc

SEQ ID NO: 83008 - DNA, 87 bp, Homo sapiens
  chr19:24305345-24305432
  hypo
ggcactttgcaaacgccagtctgttctttgtttctaagagtgtaactccttcatatatttcatacaatctgtcgttttgtggctggc

SEQ ID NO: 83009 - DNA, 30 bp, Homo sapiens
  chr19:2452047-2452077
  hypo
ccctgcacctgcccccgcccccagcactca

SEQ ID NO: 83010 - DNA, 42 bp, Homo sapiens; identical to SEQ ID NO: 45596
  chr19:2471261-2471303
  hypo

SEQ ID NO: 83011 - DNA, 23 bp, Homo sapiens
  chr19:2471700-2471723
  hypo
aaatacggtgactcacgcctgta

SEQ ID NO: 83012 - DNA, 130 bp, Homo sapiens
  chr19:2478809-2478939
  hyper
aactttttttatttccgcaaactaaaatcaacaagcagaaaaataccccaggaagtcggcctccgggccagccgggcttggcgcagtgctgcgttttgcctgtaaaccgaaactgcgagccctggccagc

SEQ ID NO: 83013 - DNA, 241 bp, Homo sapiens
  chr19:2488448-2488689
  hyper
gccaagaccctcttgcgcatgtgacgagagcgcacgagtgtgggagcttcggcctgcgctcacaggcgtgtgcgtggggaagtgtttgggccgccgtgtacacagcaggcacgccataaacgcttcttggatggctccatgcgagggaagggagggagggcagagttcaggccctacagggaggaaaagggaggggcggaggcctggctttaggtttgaatctccgcggcttactagctcc

SEQ ID NO: 83014 - DNA, 30 bp, Homo sapiens
  chr19:2512801-2512831
  hypo
aagggtggaggcaggcgggctctccctgcc

SEQ ID NO: 83015 - DNA, 427 bp, Homo sapiens
  chr19:2513079-2513506
  hypo
cctgtgggagctgcccgaggttgaggagtggaggtcactcccccgacacctgcacacacacccggagccctctagccttggcgaggtgggaaccctggcagtcaccagctcaggaagtgagccaagcagggatccccgcctcacgggcctgcacggaggacctgggcggccgtccaggaaccctctcggcacgggttcttagacgcctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgcagtcatctttca

SEQ ID NO: 83016 - DNA, 95 bp, Homo sapiens
  chr19:2518480-2518575
  hypo
ctactggttggatcccggccagcagcagcgtgatggggtctgggagggctcagagctgcgctggagggagactcaccggccgatcagaaccacct

SEQ ID NO: 83017 - DNA, 196 bp, Homo sapiens
  chr19:2524739-2524935
  hypo
gcacgtgtgtggacacggcactgcatgtgcgtgtgcgcacacgtgtgtgggcatgcatgtcactatgggtgtgtgcatgcgtgttggcgtgtgtgtacgtcactgtaggtgcgtggatatgtgcgtgcgtgggtgtgtacatgtgtctgcatgtgtacatgcgtgtgcgtgtgtgtgcgcacgggagtgcatgtgg

SEQ ID NO: 83018 - DNA, 49 bp, Homo sapiens
  chr19:2573995-2574044
  hypo
ggagttctgccgcctcggggaggcctgggtatcccgagaccagagatgc

SEQ ID NO: 83019 - DNA, 70 bp, Homo sapiens
  chr19:2665387-2665457
  hypo
gtgctggacagtcctcgccacaccccacctcttggaactggaatgtctggtgagacgggcaacaaggatt

SEQ ID NO: 83020 - DNA, 59 bp, Homo sapiens
  chr19:2671304-2671363
  hypo
cagttgcaggaaggccgaggaccaccccggatccccctggacaccggtggctctgagcc

SEQ ID NO: 83021 - DNA, 32 bp, Homo sapiens
  chr19:267205-267237
  hyper
cgcagatccggaggccacgctgcgctgcgctg

SEQ ID NO: 83022 - DNA, 90 bp, Homo sapiens
  chr19:267567-267657
  hyper
gtctctgaaaatcagcgttcggatgactgcaggccgtgatttcggaaatgtcaactgaaatcgaggccaccatcccgtgccttgatcgga

SEQ ID NO: 83023 - DNA, 30 bp, Homo sapiens
  chr19:2683414-2683444
  hypo
aaagactattttccccggaatacctgctag

SEQ ID NO: 83024 - DNA, 155 bp, Homo sapiens
  chr19:2683891-2684046
  hypo
gctggtggacagcatcggccagaggagctcaaatccgccctcagccccagggggccgagctgcaaaagcgacgtcaaatggacaaaaatcccaccgggcacagaagtgcgaccagcaagtctatgggtttaaaaataaatgatggggccgggcgc

SEQ ID NO: 83025 - DNA, 36 bp, Homo sapiens
  chr19:2702517-2702553
  hyper
gcccccctcctcagccgactccgacccccaactcgg

SEQ ID NO: 83026 - DNA, 42 bp, Homo sapiens
  chr19:2703070-2703112
  hyper
ttataggctccctctcgtgggaccctccgcataaggccagaa

SEQ ID NO: 83027 - DNA, 30 bp, Homo sapiens
  chr19:2716528-2716558
  hypo
cccgggggtgggattcggggctggcagggg

SEQ ID NO: 83028 - DNA, 30 bp, Homo sapiens
  chr19:2721203-2721233
  hyper
ccgggaggctggggccgggacaaaggaggg

SEQ ID NO: 83029 - DNA, 30 bp, Homo sapiens
  chr19:2721705-2721735
  hyper
gctttggcagaaatgcggataaagggggtg

SEQ ID NO: 83030 - DNA, 78 bp, Homo sapiens
  chr19:28342286-28342364
  hypo
gtgagaagggaagcccggcggaccgagtgcaacacgggctgcagcggggagctgggttcgggacgggtcagagtcctg

SEQ ID NO: 83031 - DNA, 174 bp, Homo sapiens
  chr19:28402175-28402349
  hypo
caagtgcggaaccaccgccgggagccagggactgtgctgtccgcagccctcacccccggggccccagtttctgcaaagagaggctgcactttggagggtgggtgggtgtgagtccgtcagctgaaacctggccccttatcccaagtggccagcataacacggtgacacaactta

SEQ ID NO: 83032 - DNA, 100 bp, Homo sapiens
  chr19:2867431-2867531
  hypo
gggcaggagccgagccggagccggagccctgggaggggagggttggaagcggccagaacacgctgaaactcccgggggagccgcccggaacccccatgca

SEQ ID NO: 83033 - DNA, 71 bp, Homo sapiens
  chr19:28715584-28715655
  hypo
aagcttttgtttcatcgtggagaagaaaatggcccccacttacttttaagatttggcgtatgcgtgaagat

SEQ ID NO: 83034 - DNA, 30 bp, Homo sapiens
  chr19:28918665-28918695
  hypo
gtacacccacagccacgttctccagggcag

SEQ ID NO: 83035 - DNA, 16 bp, Homo sapiens
  chr19:2895805-2895821
  hypo
acgttgacatgggaaa

SEQ ID NO: 83036 - DNA, 22 bp, Homo sapiens
  chr19:2899962-2899984
  hypo
caggaggctgggaaacgtttgg

SEQ ID NO: 83037 - DNA, 24 bp, Homo sapiens
  chr19:29024540-29024564
  hypo
gtgagactccgtttcaaaaaaaaa

SEQ ID NO: 83038 - DNA, 87 bp, Homo sapiens
  chr19:290965-291052
  hyper
ggggcgggatggaggcgcgcgcgcggcccctccgcacagacttcctgctgccggggcgggggatgctggccccggctccccgggcct

SEQ ID NO: 83039 - DNA, 231 bp, Homo sapiens
  chr19:29145837-29146068
  hypo
cccagctagacttgacggtgcagtcatcatccctgcccccgagcccatgcagtgctctacaatccagggagcaggcatagcacagaggggaggatgccccagaactaggggagccagtgtacatgctgagcagagacctagagctgaccacctcacatctgccgccaccaacaacccctccaggggcggaggtgctgcacatgtgtgcacatcctccgggaactaaagtgc

SEQ ID NO: 83040 - DNA, 231 bp, Homo sapiens
  chr19:292054-292285
  hypo
tactcaaaatcctggcgcgtccttggacccctggcacgttagaagctcgagttcctcggcacccaccttgcgacggcgtagggtgtccaggcgcagccctgtgcccaggcaccgttcctatcagcgcacttgctgtcccatttcacagaagagcacgggggcgccaggagctgggaaccccatgaaatggcgccggggtctgtgcccccaccaggtcgtggggagccctga

SEQ ID NO: 83041 - DNA, 75 bp, Homo sapiens
  chr19:29284242-29284317
  hyper
agggaggaaggtttccggcctcccggaggccaaggcagaggcgctgggggaaggagcaagaagggaccagccgcc

SEQ ID NO: 83042 - DNA, 247 bp, Homo sapiens
  chr19:29284329-29284576
  hyper
cgctgccaggcaggctcccgggacgggcagagctccgaggctgcctccgggcagtcacgtccaacgtacctgagcccggccagccgctgtcgctgtcgccgccgcactcgcctgtccggacgcaccttcctcctcctccgcggcccccgagaagctgggcgcgcaggcaagggaggcgcggcggcccctgcggctggtcagttcaccaggtgcctgctcccgagcgagttgccaccgaccccgccgc

SEQ ID NO: 83043 - DNA, 86 bp, Homo sapiens
  chr19:29302897-29302983
  hypo
gatggtgaggagctgcgggactgaccttggactgtttttgagtgggtttattgtgttaaaccactgaaattacagaagcttttctt

SEQ ID NO: 83044 - DNA, 104 bp, Homo sapiens
  chr19:29425113-29425217
  hypo
caccgaagacacagacgatgctctcaccaggtccccactgggcttgattgctttattttactcttagaaacagtgtttcctttaaaatgcccaaattgggccag

SEQ ID NO: 83045 - DNA, 43 bp, Homo sapiens
  chr19:29425457-29425500
  hypo
actccacctaggcgagagtgtaagactccgtctcaataaaaaa

SEQ ID NO: 83046 - DNA, 34 bp, Homo sapiens
  chr19:29505183-29505217
  hypo
cccagaggatgaacacgcacgtctttcgttcaca

SEQ ID NO: 83047 - DNA, 33 bp, Homo sapiens
  chr19:295054-295087
  hyper
ctctggtgaggccaccgccgtcctgcatctctt

SEQ ID NO: 83048 - DNA, 30 bp, Homo sapiens
  chr19:2961218-2961248
  hypo
cttgctaggaatgcacgttttcaggcccca

SEQ ID NO: 83049 - DNA, 30 bp, Homo sapiens
  chr19:29680159-29680189
  hypo
gtggaaattcgctgccgctaaggcaaccca

SEQ ID NO: 83050 - DNA, 82 bp, Homo sapiens
  chr19:29716608-29716690
  hypo
ccagtggaggctgtgcgcaaaatcaggcccagagccatggtttctttggcctgtaaagtgttaaaaaatgagattggtgggg

SEQ ID NO: 83051 - DNA, 30 bp, Homo sapiens; identical to SEQ ID NO: 45800
  chr19:29920756-29920786
  hypo

SEQ ID NO: 83052 - DNA, 79 bp, Homo sapiens
  chr19:29930911-29930990
  hypo
gtgaggagggagaggcgcaggtgggaagtgcgggaactggggctgcgcggctctcgggggccagcgtgagttccaggtg

SEQ ID NO: 83053 - DNA, 30 bp, Homo sapiens
  chr19:29933086-29933116
  hypo
tgggggcaagaattccggccacccgaggtt

SEQ ID NO: 83054 - DNA, 30 bp, Homo sapiens
  chr19:29969803-29969833
  hyper
tctacaatgggaagacgggagccgcccttc

SEQ ID NO: 83055 - DNA, 391 bp, Homo sapiens; identical to SEQ ID NO: 1367
  chr19:30015572-30015963
  hyper

SEQ ID NO: 83056 - DNA, 905 bp, Homo sapiens; identical to SEQ ID NO: 37373
  chr19:30016024-30016929
  hyper

SEQ ID NO: 83057 - DNA, 59 bp, Homo sapiens; identical to SEQ ID NO: 1369
  chr19:30017451-30017510
  hyper

SEQ ID NO: 83058 - DNA, 145 bp, Homo sapiens; identical to SEQ ID NO: 1370
  chr19:30017577-30017722
  hyper

SEQ ID NO: 83059 - DNA, 982 bp, Homo sapiens
  chr19:30017765-30018747
  hyper
cgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccag

SEQ ID NO: 83060 - DNA, 416 bp, Homo sapiens; identical to SEQ ID NO: 1372
  chr19:30019113-30019529
  hyper

SEQ ID NO: 83061 - DNA, 81 bp, Homo sapiens; identical to SEQ ID NO: 1373
  chr19:30019530-30019611
  hyper

SEQ ID NO: 83062 - DNA, 271 bp, Homo sapiens; identical to SEQ ID NO: 37379
  chr19:30019660-30019931
  hyper

SEQ ID NO: 83063 - DNA, 1046 bp, Homo sapiens
  chr19:30019993-30021039
  hyper
cggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcc

SEQ ID NO: 83064 - DNA, 128 bp, Homo sapiens
  chr19:30021252-30021380
  hyper
cgccgggacgccccggggggctccggacccaggacccgccccctgggcgcatttgcatatgcatactccttcctagttaggtcgggagcgccccccccagggccttcttcccgcggtttctctgtctt

SEQ ID NO: 83065 - DNA, 74 bp, Homo sapiens
  chr19:30056243-30056317
  hypo
acaggattgctagtgcgacgccctccaaagcacttgtcctctaacgtgacgactcgcagcgttcacatcagcaa

SEQ ID NO: 83066 - DNA, 30 bp, Homo sapiens
  chr19:30174182-30174212
  hypo
tgcggaagaacccagcggcttccagggctt

SEQ ID NO: 83067 - DNA, 93 bp, Homo sapiens
  chr19:30188529-30188622
  hypo
ggacacccagacacccggacactcagacacctcaccacccagacaccgagaaacctgacacccagaaacctggacacccggacacccagacac

SEQ ID NO: 83068 - DNA, 30 bp, Homo sapiens
  chr19:30211721-30211751
  hypo
cctgccacctcccttcggtcttgggagagc

SEQ ID NO: 83069 - DNA, 465 bp, Homo sapiens
  chr19:30215009-30215474
  hyper
tctggtctaaatccccgccgtaggattttatttttcggtgctgaggtgctttgctggaggagctgccagggggagctgcgcggggcaggcccggggtaccagaggcccttgctttagcggcggccctgcgtgtgccagaggcttgcagagtgatctgagcacgccaagagattgctgtcaagtaagctcctccacaaatctgcagaaacctcaaagattacagcgctcgcacggcaggagcgcagcggcttcccatacgccggcagacaatggggcggaggaaggaaggggacggtggcctggggacccccgcgcccgcagcacgtgcaccgagcctggagcgcccgctttacagatcttgtcgctccacccctaaaacaaaggccccggggccccatctgtgccgggcgcgggggagggcgccgcacttgctgcccgccgcgtgcaaagcgagccagacaaagg

SEQ ID NO: 83070 - DNA, 39 bp, Homo sapiens
  chr19:30244714-30244753
  hypo
ggctgagcgtgggagcgaggaccccgctttgttcaaggc

SEQ ID NO: 83071 - DNA, 159 bp, Homo sapiens
  chr19:30252171-30252330
  hypo
tcctcctgtaagatgcggcactgggactgcctctcaggagagtcccgcagagcagtctggggaggtgcttggcatggctgccggcacctgctcaccgtcatcacacggggacttagtcttaagaaaaggggactggaggtcgggcacggtggctcacac

SEQ ID NO: 83072 - DNA, 30 bp, Homo sapiens
  chr19:30252886-30252916
  hypo
cacgttaatctttaacgtgttagcaaaaca

SEQ ID NO: 83073 - DNA, 30 bp, Homo sapiens
  chr19:30259225-30259255
  hypo
gatgctctgggaaaacgcctggggccaagg

SEQ ID NO: 83074 - DNA, 135 bp, Homo sapiens
  chr19:30272553-30272688
  hypo
cgcgggcagcacacacgcagccgcagccccctcattggcatggctctagtgggggcctctgcaggtgccgggctacagagatggaagcggggagagtggaatcacagttggcacctgtgccgagcttgcctgagg

SEQ ID NO: 83075 - DNA, 27 bp, Homo sapiens
  chr19:30329268-30329295
  hypo
cacatcagtaatctacgttgaatgagc

SEQ ID NO: 83076 - DNA, 30 bp, Homo sapiens; identical to SEQ ID NO: 37384
  chr19:30334621-30334651
  hyper

SEQ ID NO: 83077 - DNA, 183 bp, Homo sapiens
  chr19:3039729-3039912
  hypo
ggtcacccagcatgacggacgcgatgccaggtcccctgctaacctgcccagcgctaacacaacctgtaggggtcagctgagatcgcagagatcacactacctccagaggctgtgagacccagtgtcactgatgtgcaagcctgggttcaaaccccacctccgccactgcgtcactgtgatcct

SEQ ID NO: 83078 - DNA, 30 bp, Homo sapiens
  chr19:30410677-30410707
  hypo
agtggtggatcttttcgatttctgtataaa

SEQ ID NO: 83079 - DNA, 30 bp, Homo sapiens
  chr19:3041560-3041590
  hypo
tgggccaagcagccccgtctctctctgtca

SEQ ID NO: 83080 - DNA, 30 bp, Homo sapiens
  chr19:30416554-30416584
  hypo
gaaacaggatggcttcgtgggcgtgtgtga

SEQ ID NO: 83081 - DNA, 22 bp, Homo sapiens
  chr19:3050735-3050757
  hypo
gggcgcggtggctcacgcctgt

SEQ ID NO: 83082 - DNA, 388 bp, Homo sapiens; identical to SEQ ID NO: 45804
  chr19:30555329-30555717
  hypo

SEQ ID NO: 83083 - DNA, 30 bp, Homo sapiens; identical to SEQ ID NO: 45805
  chr19:30562726-30562756
  hypo

SEQ ID NO: 83084 - DNA, 30 bp, Homo sapiens
  chr19:30565672-30565702
  hypo
tcatgatcaaggtgacggggggaagacagc

SEQ ID NO: 83085 - DNA, 184 bp, Homo sapiens; identical to SEQ ID NO: 45806
  chr19:30579049-30579233
  hypo

SEQ ID NO: 83086 - DNA, 30 bp, Homo sapiens
  chr19:30580294-30580324
  hypo
gccctgaattagccacgtgtcatgctacac

SEQ ID NO: 83087 - DNA, 204 bp, Homo sapiens
  chr19:30588597-30588801
  hypo
ccatttccccaaaaccgacacaacaatgcagcataccaacactgtttttgttcttttcaacacctcattttgacgcaagagcttctcacacaccttggaaggggcttcagcccagatgaggggttttcattagcgttggagaggttgggggcctcagacaaatccatcctccaaggcagtgtattctgacgccgcagctgggct

SEQ ID NO: 83088 - DNA, 30 bp, Homo sapiens
  chr19:30614219-30614249
  hypo
gtttctgcaggcccacgggaagctcgctga

SEQ ID NO: 83089 - DNA, 33 bp, Homo sapiens; identical to SEQ ID NO: 45807
  chr19:30636005-30636038
  hypo

SEQ ID NO: 83090 - DNA, 76 bp, Homo sapiens
  chr19:30637494-30637570
  hypo
tgcacgggcattcagcgagactcgatgcgaaggcaaggcaagcacgtgacatccagtactacgtgaggtgctgaca

SEQ ID NO: 83091 - DNA, 30 bp, Homo sapiens
  chr19:30646730-30646760
  hypo
tgaccaggattgcttcgtcttgagtcctga

SEQ ID NO: 83092 - DNA, 163 bp, Homo sapiens
  chr19:30699747-30699910
  hypo
acgcgccaggcagtgcggggtgtagctggaccaggtctagctcatgaagagaggagaaactgtgggtcttgccatcgcctcaagccccagaagacacagctgagcttcttcctccctagaagccctcctcccctcctcgtacagtgctcggcattcagcaggc

SEQ ID NO: 83093 - DNA, 195 bp, Homo sapiens
  chr19:30713398-30713593
  hyper
caacaagggccgcgccgggaggtctccccggggacccccactcagcttgctcaggtcctggaggcatgcagagggcgtcggcgccgacagggggagccggagagccccctgcccggccgtctgcggggctcaggcggggcttggcctccgatgagcgcgctgtctctgcccggtgggtcccaccccgcccggcca

SEQ ID NO: 83094 - DNA, 390 bp, Homo sapiens
  chr19:30713685-30714075
  hyper
cgaggccgcagaagccttgggcctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccatatggtcacttcctttcgacctgctcggccctgctcgcctctttgtccgctctgtcacttataaagaatcacttgacttacaataacaggttcaaaagacgacggagtataatcagttgatccacgaagaattggaataaagaacaccccaccgctcaggctatcat

SEQ ID NO: 83095 - DNA, 321 bp, Homo sapiens
  chr19:30714424-30714745
  hyper
gttctcagggcagggtccgaggatgctggcagcggcaaggcccggtgcccgccgacggcgcgcctggggagaggaccaccggcggtgagggcccaggcccagcgcccagggcagctgcgacgcgtccgtctccaacgccggcacgctaacccagcgctcctcccagcgcaaagttttctgtgtctctcccctcactcttggactggttgcttgccaccgaatgactccttcagctggagaggggtggtgatggggaggctgtggcatgccttttctgtatctttgcttttgatgtcttgtgatgcccgggtttaaaacccg

SEQ ID NO: 83096 - DNA, 603 bp, Homo sapiens
  chr19:30715266-30715869
  hyper
gcttatattatttaccgaaacgtttgcccagaggacccgccttgcaaagttgccttaaaaaagttattttgtttgataattaagtcctggagcccatcgcatgatgattattctacacccataaggcagagaacctgcgtgacgtttttctcgaagtttaattaccgtatgctaatttccttgcctactacgtgattaattaaaatcatattttcataatcatttggcactagtattgttttagaattatcatgatctcctaaatagtgtctgtaaataaagtcgcctctaatggcaggcgcgggaggcgaggctgaggacctctccgcgtttgtatcgcggcgattggcaacataactgccttatttacattaaatacgccacaaggttacagcgcggatcaacgtcatttgatcgctgatgactcccttaaacgcccgggctgtgactgattcttcgcgtcccgctgtccaccgagattcacccgggagtttttttttttttttttttttttcctcccagaaaagaaacagactttaaatagtttcaggagcaggtaagaattacgctttttcctcgccccttctccgtctctctctcctc

SEQ ID NO: 83097 - DNA, 567 bp, Homo sapiens
  chr19:30716203-30716770
  hyper
tgaattatgccagggcgacaatggagagcgtttttaatggtacaatgcatttcacctaccagatagggggaggccgagccggggatggggatgtctgctggggctgggtgatgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 83098 - DNA, 1982 bp, Homo sapiens
  chr19:30716952-30718934
  hyper
cgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtgcaatctggggggacgcctcccgtccccccagcgcagatgcatgactggggtaggaatgatctttgctgataagcctttttctgtttgcttcaagacattatttttcgaagatgaattgaggaaaacagtcgtaggcgagactcggggtgtattttaggcaaaaaaaaaaaagttagggttgggggagagctttcctttgatgagtaggaaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaacttgg

SEQ ID NO: 83099 - DNA, 155 bp, Homo sapiens
  chr19:30718994-30719149
  hyper
gagactgggaacgcgctgttttctttcccagtttgatactagcaactggatttttactttaagaccggctttgctctctgctggggttgggagggggggcgatcttttcccatcactcacatctttgttcattgttcactgagtggaaggcaggc

SEQ ID NO: 83100 - DNA, 895 bp, Homo sapiens
  chr19:30719150-30720045
  hyper
acttaaagagacgaaagagaggaaaaaggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgtatgtgt

SEQ ID NO: 83101 - DNA, 30 bp, Homo sapiens
  chr19:307368-307398
  hypo
ggtatgaggctgggtcggccagggctgggg

SEQ ID NO: 83102 - DNA, 30 bp, Homo sapiens
  chr19:30769986-30770016
  hypo
tgtaccgccgttgcccgcattctcgcaggg

SEQ ID NO: 83103 - DNA, 566 bp, Homo sapiens; identical to SEQ ID NO: 37394
  chr19:30865459-30866025
  hyper

SEQ ID NO: 83104 - DNA, 51 bp, Homo sapiens; identical to SEQ ID NO: 37395
  chr19:30866452-30866503
  hyper

SEQ ID NO: 83105 - DNA, 32 bp, Homo sapiens
  chr19:30901662-30901694
  hypo
gcgtgagccaccgcgcccggccaagtgaaggt

SEQ ID NO: 83106 - DNA, 95 bp, Homo sapiens
  chr19:30931166-30931261
  hypo
cagaggtggctttctcttggtggtttctgaaccttcagcttctcagtggtagccagggacccttccaactctgtccgattcggatcgtaggtgct

SEQ ID NO: 83107 - DNA, 182 bp, Homo sapiens
  chr19:30934382-30934564
  hypo
tggaaattccctgcccgccaatgctgttgattcatggcgccacagccgcacctggcacggatctgaactctgcctctcttttcagggatggaagaagcgagcctgtgccttggagtgtcttcggcggagccggaagctgagccccacctgagtggccccgtcctcaacggccagtatgccat

SEQ ID NO: 83108 - DNA, 354 bp, Homo sapiens
  chr19:30935523-30935877
  hypo
aggtgttcagccaggcgtggttcctcaagggtcacatgcgcaagcacaaagactcctttgagcactgctgccagatctgcggccggcgcttcaaggagccctggttcctcaagaaccacatgaaggtccacctcaacaagctgtcggtgaagaacaagtcccccagcgaccccgaggtgcctgtgcccatgggcggcatgtcccaggaggcccacgccaacctgtactccaggtacctctcctgcctgcagagtggcttcatgaccccggacaaagccggcctgagcgagcccagccagctctatggcaagggcgagctgcccatgaaggagaaggaagcgctggggaagctgc

SEQ ID NO: 83109 - DNA, 223 bp, Homo sapiens
  chr19:30954451-30954674
  hypo
tgtgttttcttcagccgtctttccatcatgcttccctgcacggggcatagagcacagcagatgtcagggaatgtggtcaacttatacagaatgaaatgaaatgccttctctcagcacaaaaggcactttgcccagcagccaactgggatttagtccttcccaccgctcttcctgtaagaacctaaatttacagcacagggcctgccaccgtagacttttggtg

SEQ ID NO: 83110 - DNA, 142 bp, Homo sapiens
  chr19:31017204-31017346
  hypo
cttggcaagatgtggcggtctgcggatgacaggggatgttgtcacagcagcatcacatggtgccagagggcagagaccccatgggtggcctaatccccagcagggagtttcacagactccaccaacaattaagaacaggttc

SEQ ID NO: 83111 - DNA, 53 bp, Homo sapiens
  chr19:31038908-31038961
  hypo
aaataccacttagagcgacaccatcgggagcggcagaacggggctgggccgct

SEQ ID NO: 83112 - DNA, 30 bp, Homo sapiens
  chr19:31057923-31057953
  hypo
ctctccgggtagtggcggttcctgggagtg

SEQ ID NO: 83113 - DNA, 55 bp, Homo sapiens
  chr19:31117725-31117780
  hypo
cggcagcctgctccccgcacggcccccaccccggccacctcggtgttgcatttgg

SEQ ID NO: 83114 - DNA, 247 bp, Homo sapiens
  chr19:31210572-31210819
  hyper
gcgcctggagaggtgcgcccgggccaggagcagagcagggcgcggcgccaggcgggggcgcccggggcctgcgtgtcgtcgcgggtgggggcgggtgtcctcgggcgcgcacccgctgcggcctccggctctggaccagcccggtggctccaagggatcaaagcgaaaaacagctttggccgcaaagggagaacgccctgagccagctcgtccctaaggactcgtcttttggcgaggaaggggacgc

SEQ ID NO: 83115 - DNA, 87 bp, Homo sapiens
  chr19:31213098-31213185
  hypo
agagctccttctgcagtcttcagaaaagtgacccccaacaaagagtaatattgactagactccacagcagaccggcagtgttttgga

SEQ ID NO: 83116 - DNA, 79 bp, Homo sapiens
  chr19:31217835-31217914
  hypo
agacctgggccaggacggtggagtctctctgtgcgagagttctctgcgggaatattctaaactccgcagtggagccggc

SEQ ID NO: 83117 - DNA, 30 bp, Homo sapiens
  chr19:3131559-3131589
  hypo
tagcagtaatttacacgaatctctacagct

SEQ ID NO: 83118 - DNA, 134 bp, Homo sapiens
  chr19:31567889-31568023
  hypo
cttaaaagctgccttcgcctaacgctgaatatggtttttttatctgtgactgtagagaagccatttctttgttggctctaaatggcccccattccttcgttgtgcaaattgctcacacgcgccaatgtgccatt

SEQ ID NO: 83119 - DNA, 205 bp, Homo sapiens; identical to SEQ ID NO: 45810
  chr19:31587355-31587560
  hypo

SEQ ID NO: 83120 - DNA, 30 bp, Homo sapiens
  chr19:3170304-3170334
  hypo
tcaatatagaaagcacgaatagggcttaaa

SEQ ID NO: 83121 - DNA, 30 bp, Homo sapiens
  chr19:31768075-31768105
  hypo
caatgtcagacttctcggagatgctggaag

SEQ ID NO: 83122 - DNA, 30 bp, Homo sapiens
  chr19:31770460-31770490
  hypo
cactgatgtgtgactcgctgtccatttcat

SEQ ID NO: 83123 - DNA, 172 bp, Homo sapiens
  chr19:31780548-31780720
  hypo
cccaggggtggggttcggagccagatgccctgcagcacggttctggctggggcggcacctcagacactggctctcagattggctgccactgtccctgtagcccctagcccccaagctgggccgcgttctcctccaggctgagcccagaccccatgtccgctgggcttctgcc

SEQ ID NO: 83124 - DNA, 243 bp, Homo sapiens
  chr19:31804724-31804967
  hypo
gaagtggggtattatcgagaagggtatggcactgagagtccgggtacctgcatcctggcaccgacactcacttaccaggctgcaacctgcagcacacaattggaagtctttgcgccacagaatttcacttgtaaatcaggtaataccttcatctcgggtaatgacggtgagcctttctctctgcctgcttcccaggtccacatttgggaaaggcaggtcagaccccctcgtgcctgcctctcg

SEQ ID NO: 83125 - DNA, 91 bp, Homo sapiens; identical to SEQ ID NO: 13318
  chr19:31839837-31839928
  hyper

SEQ ID NO: 83126 - DNA, 1236 bp, Homo sapiens; identical to SEQ ID NO: 37397
  chr19:31839941-31841177
  hyper

SEQ ID NO: 83127 - DNA, 173 bp, Homo sapiens
  chr19:31841410-31841583
  hyper
cccctgcccatcccccgccaggggctccccccgagagcctagggggccgccgcgccgtgtcccgcgcccggcctgccggggctgctggactagagggattgattattgattggtgatcggggtcgctgaggctccgggccggcccggccgactggccgcggcaagaaggagct

SEQ ID NO: 83128 - DNA, 88 bp, Homo sapiens
  chr19:31841908-31841996
  hyper
cgctctcgcaggccccgaggccgacagtcccggcgagggcgggcgccccgcgctccagcaccggctgcctgagcgctcctggagcagc

SEQ ID NO: 83129 - DNA, 281 bp, Homo sapiens
  chr19:31842200-31842481
  hyper
aagatcaaaagtctccgctcgcccagcctgcgggcttgggctgggtccagacgtctcccaggatgcagatgcgccgccgctggcctccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggc

SEQ ID NO: 83130 - DNA, 41 bp, Homo sapiens
  chr19:31842828-31842869
  hyper
cgcgtagccggccgccgccgctgggtcgctgcctggccctc

SEQ ID NO: 83131 - DNA, 30 bp, Homo sapiens
  chr19:3187545-3187575
  hypo
tttgccccagagttacgatttttttactta

SEQ ID NO: 83132 - DNA, 30 bp, Homo sapiens
  chr19:3187952-3187982
  hypo
gccacaggaggctgccgagcccccaaagcg

SEQ ID NO: 83133 - DNA, 30 bp, Homo sapiens
  chr19:31956583-31956613
  hypo
aaagggagctgtctgcgttcttccctgctt

SEQ ID NO: 83134 - DNA, 30 bp, Homo sapiens
  chr19:31993710-31993740
  hypo
ttgggggcacccacccgcagatcaccctct

SEQ ID NO: 83135 - DNA, 30 bp, Homo sapiens; identical to SEQ ID NO: 45812
  chr19:32026024-32026054
  hypo

SEQ ID NO: 83136 - DNA, 76 bp, Homo sapiens
  chr19:32078937-32079013
  hypo
gaggcaagtttagagaaggagtgaaagtttattaaaaacttctcccctgattcttcccttgcggtgggctgtgccc

SEQ ID NO: 83137 - DNA, 160 bp, Homo sapiens
  chr19:32083599-32083759
  hypo
acccctgaagattcgcgaacatgcaggattgagctgtgcgaggcatagcattccccacatggtagacgaaggcggatgtgggtctgatggctctactgccgtccacccgggaggatggacgtgtgttccgggatatcagagcttgcggctgaccagccca

SEQ ID NO: 83138 - DNA, 85 bp, Homo sapiens
  chr19:3218818-3218903
  hypo
aaagtgattcacggtcgtcgtgggaagacgagaaaaattcaaaagaagaagaaagaaagaccgggcgcggcggctcacgcctgta

SEQ ID NO: 83139 - DNA, 100 bp, Homo sapiens
  chr19:3219554-3219654
  hypo
ttacttcctcagtaacatccatggcacgggcatcctgcagtgaccgatgcccaccagactgcatccgctaacaagacagggagaccggcctgtggtaccc

SEQ ID NO: 83140 - DNA, 32 bp, Homo sapiens; identical to SEQ ID NO: 45814
  chr19:32232273-32232305
  hypo

SEQ ID NO: 83141 - DNA, 84 bp, Homo sapiens
  chr19:3223661-3223745
  hypo
agccaccacggccagcacgtattattatttttattaatattattgatgagtttcatacgtaaaggatcacgggcactttagagc

SEQ ID NO: 83142 - DNA, 59 bp, Homo sapiens
  chr19:3225545-3225604
  hyper
ttcacaaagccaggccggcggggcaggtccggccgcgggggacacggatgcccaggacc

SEQ ID NO: 83143 - DNA, 30 bp, Homo sapiens
  chr19:32268791-32268821
  hypo
gagaacatgtgtgtgcgcacatgaggggct

SEQ ID NO: 83144 - DNA, 504 bp, Homo sapiens
  chr19:32364179-32364683
  hypo
gtgtgtgaaagtgcacgtggtactatgattttttgtaccccgtagtgccttctttatgcctctccgattctgttttgaggaaacagaagctctgagaaggcaaggggcttgcccgagttcacaagaatagcaacttccagacctgggacttgaacctaggtctctagattgcatgccacggttgacgcagccctatggccccgggcatgcgcttctcttcttcctacatgaaagccctccttacaagccttccttgtaccctatggctccaggatctggccccttcacctccccagagtcagagttaccacggtgcagtggcgcaccagtgggcctccggcaatgctgctcccgcttcccaccttccagtggcacttaccagagacacccagtggtaagaattaactggggaatggccctgcccctgctcaggccagctaaacagaagcatttagagcagcaaaaagggcgctttcgttctgaagaccccgcaggcccttccaa

SEQ ID NO: 83145 - DNA, 30 bp, Homo sapiens
  chr19:32366594-32366624
  hypo
ctgctcacagagaggcgaggctggctcagg

SEQ ID NO: 83146 - DNA, 18 bp, Homo sapiens
  chr19:3241370-3241388
  hypo
gcccggcctaaagatcag

SEQ ID NO: 83147 - DNA, 30 bp, Homo sapiens; identical to SEQ ID NO: 37133
  chr19:3244155-3244185
  hyper

SEQ ID NO: 83148 - DNA, 35 bp, Homo sapiens
  chr19:32454989-32455024
  hypo
caaggccaagcaaaccgtgtcgatgtaaaacagca

SEQ ID NO: 83149 - DNA, 32 bp, Homo sapiens
  chr19:32471100-32471132
  hypo
gaacatccacagctccgcggcccagtgacaaa

SEQ ID NO: 83150 - DNA, 58 bp, Homo sapiens
  chr19:32516346-32516404
  hypo
tggtaaactcccctgcggcccgtccctgcctcaccgcatggcccggctttgcagtgca

SEQ ID NO: 83151 - DNA, 84 bp, Homo sapiens
  chr19:32532918-32533002
  hyper
agcgccacccaaaggcgggaggagtgtaacggcattcagggaggatcgtttttgttaatttcagcaatccgaatgtaaaaaatg

SEQ ID NO: 83152 - DNA, 30 bp, Homo sapiens
  chr19:32570308-32570338
  hypo
gtcatgacacgcaaacgactaaaatacagg

SEQ ID NO: 83153 - DNA, 30 bp, Homo sapiens
  chr19:32630194-32630224
  hypo
tgtgttcatcagactcgcttgacaaagaac

SEQ ID NO: 83154 - DNA, 89 bp, Homo sapiens; identical to SEQ ID NO: 45817
  chr19:32672320-32672409
  hypo

SEQ ID NO: 83155 - DNA, 249 bp, Homo sapiens
  chr19:3270483-3270732
  hyper
tggcacgcctcctcccggctcgggcgggcagcgcgggcagggcccgcctgggcgtcgggcgcagggcgcgcggcgcggggcccgagcgtgcagtgcggcgggtgcgcgcctgtgcgcccggggcggccgggcgggcgggcggcggcacgtggatgccagcctggcgcgcgtctccaggccggtgggtaaggcgggcgccgggccgcggggtggggacggccgggccgcggagctcggctttagagtgga

SEQ ID NO: 83156 - DNA, 515 bp, Homo sapiens
  chr19:32715442-32715957
  hyper
cgaggatgcagaaggcaaccgagtccccgggcggcggcggggcaactgcggaaatcacgcagccagatgaagctcataaatttcccctatgaacaattgttttcatttccctcccatgccactagatattataagtggaaagcaaaacacaagtaaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccggctctcccgcccgctcgctgcccgccaatgttcgctttgcgcccttcgctcaatgtgcgtgcaaattacagggacattcgaaaggacagagagctcccatatttaaaataatcatttttgttcatcataacctctcttccagagataaccgctcttattaacgttttcgtacaattatctccagtctttatgtgcattctacgatgtcttctgtgt

SEQ ID NO: 83157 - DNA, 93 bp, Homo sapiens
  chr19:32718922-32719015
  hypo
ctgcagcagggaggccgattcaggaggtcactgcacgagctgtgcctggcctggagtggcctggtgcggggaacctggcggcactggcggttc

SEQ ID NO: 83158 - DNA, 30 bp, Homo sapiens
  chr19:32753918-32753948
  hypo
attgtcccatggccacggaaaattgggact

SEQ ID NO: 83159 - DNA, 30 bp, Homo sapiens
  chr19:32832651-32832681
  hypo
caccttaaagaaatacgggccacacgtctc

SEQ ID NO: 83160 - DNA, 30 bp, Homo sapiens
  chr19:32834773-32834803
  hypo
cacaggaacttcaaacgaagatacactttc

SEQ ID NO: 83161 - DNA, 145 bp, Homo sapiens
  chr19:32835111-32835256
  hypo
tctcttaccttttatcgaaaaaaaaattactcaacattttattttttcacagctatttggtctaattggcaaaggattctgtggaatagcagaattctaactttgcagccgggcgcggtggctcacgccggtaaccccagcactt

SEQ ID NO: 83162 - DNA, 30 bp, Homo sapiens
  chr19:32835942-32835972
  hypo
acaccatcgtgccctcggagggctgagctt

SEQ ID NO: 83163 - DNA, 23 bp, Homo sapiens
  chr19:32853027-32853050
  hypo
caagtgtccgcccaccttggcct

SEQ ID NO: 83164 - DNA, 41 bp, Homo sapiens
  chr19:3286043-3286084
  hyper
cctgggcgccagccccgccctctgcccgccctgtccacctg

SEQ ID NO: 83165 - DNA, 42 bp, Homo sapiens
  chr19:32898448-32898490
  hypo
acaactgtgtagttacgtgacgcattgcgtggtaactgctat

SEQ ID NO: 83166 - DNA, 167 bp, Homo sapiens
  chr19:3296598-3296765
  hypo
catgccaatctgcctcgagggggcctcacccgtgtccgcggcgcccgccgaggcccccgagggcctgcttgggagtgtgtgccggtgtgcagttgtacgtgtctttctggtccatgtttactggctgtaaataccatttttatactccacatcgcagacctgcgtga

SEQ ID NO: 83167 - DNA, 87 bp, Homo sapiens
  chr19:3308060-3308147
  hypo
ctggagccgaatatcaacgctatcctggatcttttgtttcttgctcaactccaatctatcagcaggtcctgtcgcccctgccctcac

SEQ ID NO: 83168 - DNA, 141 bp, Homo sapiens
  chr19:33143094-33143235
  hypo
agttcagagttactgcgttgaccagaaggtggggacccagaaatttcaaggcttaaccaaaaaatggtttattctagcccctttagaaagaattttttaaatcacagtaattaaagaaaggccatgtgtggtggctcacgc

SEQ ID NO: 83169 - DNA, 20 bp, Homo sapiens
  chr19:33143475-33143495
  hypo
catcccgggggtagggtgtg

SEQ ID NO: 83170 - DNA, 51 bp, Homo sapiens
  chr19:33166918-33166969
  hyper
cctggggaggatggacgagggagcgggggaccgctaacggggctccctctg

SEQ ID NO: 83171 - DNA, 500 bp, Homo sapiens
  chr19:33166988-33167488
  hyper
cgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacg

SEQ ID NO: 83172 - DNA, 27 bp, Homo sapiens
  chr19:33167496-33167523
  hyper
cggccgctggtgcgcacaggtgtggct

SEQ ID NO: 83173 - DNA, 64 bp, Homo sapiens
  chr19:33167843-33167907
  hyper
ggccctagccgtgtgcgtggcgaagctgagctgacggacacccgacggccgcctgctgctgccg

SEQ ID NO: 83174 - DNA, 156 bp, Homo sapiens; identical to SEQ ID NO: 45822
  chr19:33415273-33415429
  hypo

SEQ ID NO: 83175 - DNA, 72 bp, Homo sapiens
  chr19:33425338-33425410
  hypo
cggggagatgtgctccgaaaggtcacaggaggtgaggctcccatgggccctggccagcgcacctcccagggg

SEQ ID NO: 83176 - DNA, 145 bp, Homo sapiens
  chr19:3344915-3345060
  hypo
gatgtggaggaacagcgaggaggcccgtgtggctgcagcggagggaggagagggagagagggaggaggcgagggcagggagggacagggtgggtcaggcagggctttgtagccctcggggaggactctgtcgcctggagggcagt

SEQ ID NO: 83177 - DNA, 50 bp, Homo sapiens
  chr19:33468018-33468068
  hypo
ggcttgaatggagcccgtgggtcgtcctgccttagcgtctgagttcagct

SEQ ID NO: 83178 - DNA, 26 bp, Homo sapiens
  chr19:33557330-33557356
  hypo
ttaaccacctccgttttctaggctgc

SEQ ID NO: 83179 - DNA, 23 bp, Homo sapiens
  chr19:33557746-33557769
  hypo
aaaaaaaaaaaagtccgggcgcg

SEQ ID NO: 83180 - DNA, 422 bp, Homo sapiens
  chr19:3360952-3361374
  hyper
tctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagc

SEQ ID NO: 83181 - DNA, 123 bp, Homo sapiens
  chr19:3361375-3361498
  hyper
taggggcaccgggactggtcccgcagtcccgcctccagcacttgcccccaatggaccagaggccgtgggcacagagagctgttttgtcacctccagggaaatccccgccgctctccaccccca

SEQ ID NO: 83182 - DNA, 92 bp, Homo sapiens
  chr19:33685144-33685236
  hyper
agcgccactgcggctcggcgggcgcgtcacgtggctggcgcagcgcggcctccaggctccgggcgcgggcgaggggccgggcgggaggactg

SEQ ID NO: 83183 - DNA, 83 bp, Homo sapiens
  chr19:33685570-33685653
  hyper
gcccgagccctagcccgagcccgagcccgagccgcagccagagccagagccggagccgcagccggaaccggagccggagccgc

SEQ ID NO: 83184 - DNA, 118 bp, Homo sapiens
  chr19:33685902-33686020
  hyper
ccagcaccgcttgcccgcctggccccgggcctgggagggcgactctggtggcgcagccccggctcccgccccgctcggagtagcgcccggagcccgggctgagcgctggcaggaggcc

SEQ ID NO: 83185 - DNA, 354 bp, Homo sapiens
  chr19:33716410-33716764
  hyper
ccctcattcggcctccgcccggcgcccgcccgcctgggtcccgctcaccgatgatgatggtgcaggcgctcagcagcccgatctccttcttgagcgccacccgctccgaggcgccggggacggtccctgggactggggagggcgagggcgcaggcctggggttcccgcgcccgctcggctgctgcgtgtggccggccatgtcgctgtcccgccgcgtccccgctccctgcgctgccccgtctgtccggccggccgcccgtcggtccgtcggtccgtgagctcacggccctcgcagccgggacagcgcccacaggcgggcgcatgcgctggctccgggcccgggactgggggccc

SEQ ID NO: 83186 - DNA, 363 bp, Homo sapiens
  chr19:33717533-33717896
  hyper
ggtgcaggtcccgcgcgatccagcccggctcaagaaggccaggcgacctggaatgcccgggagacacggagaaggaggctgtggtcgcgggagagggtcgggagtgcggggatccgagggaggctgcctcctcccggaagccgtccggactgtgcagccgaggccggcggaaaagatccaggggggccgcgtcggggccaccggggcggcgggcggggcgagcctggcactgtgcggccggcggcggaacagcctttgtttcttcctggcggccgccgcgacgcgccgtcccctgcatgtggatgaggcctcgccgggcgccccgtccttccccccagtggcggcctccgggtttgctggggc

SEQ ID NO: 83187 - DNA, 30 bp, Homo sapiens
  chr19:33781895-33781925
  hypo
tggctcctgggtgagcggctgggaccctga

SEQ ID NO: 83188 - DNA, 138 bp, Homo sapiens
  chr19:33792492-33792630
  hyper
cttcttggccttgcccgcgccgctgccgccactcgcgcggaggtcggggtgcgcggcgcccagccccttgagcgcgctgccagggcccggcaggccggcggcaccgagcgcgggcgcggggtgcgggctgggcacggg

SEQ ID NO: 83189 - DNA, 84 bp, Homo sapiens
  chr19:33793876-33793960
  hyper
ggcctgtcccggacccgcgtcccggggaggctgcagcgcagagcagcggggctggggccggtggggggccgtttgggacgcgcg

SEQ ID NO: 83190 - DNA, 345 bp, Homo sapiens
  chr19:33794400-33794745
  hyper
caccgcttcctcccccgcctccccattcaggtgggcgccaacggcgggagcgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcc

SEQ ID NO: 83191 - DNA, 18 bp, Homo sapiens
  chr19:33794779-33794797
  hyper
cgccgcctgcgtcccggc

SEQ ID NO: 83192 - DNA, 204 bp, Homo sapiens
  chr19:33907896-33908100
  hypo
cccacaaatccagcccgtggagcgctcccgggcacacggcccagctcctgccctcagaagtttatcacctaacatgaagacgagtcacagtcctataaaaatgctgcagctgcccagacagcggtagaagggctgcctggcagcaagtgtcggccaagctatgtgcctcgagcatgggtggggtagcgccgaagaggttagtga

SEQ ID NO: 83193 - DNA, 41 bp, Homo sapiens
  chr19:33950319-33950360
  hypo
ggtaatggatccggccgccagccccacgccagctggctaca

SEQ ID NO: 83194 - DNA, 30 bp, Homo sapiens
  chr19:33996127-33996157
  hypo
caaacaatgctgcctcgccgactctcactc

SEQ ID NO: 83195 - DNA, 30 bp, Homo sapiens
  chr19:34048983-34049013
  hypo
gataatgcaaactttcgattccatcatcta

SEQ ID NO: 83196 - DNA, 74 bp, Homo sapiens
  chr19:34112213-34112287
  hyper
aagggagcacctgttcgcagggcactttcagcagaatctagagccccagggatttgaggatggatgcggacacc

SEQ ID NO: 83197 - DNA, 404 bp, Homo sapiens; identical to SEQ ID NO: 37413
  chr19:34112326-34112730
  hyper

SEQ ID NO: 83198 - DNA, 158 bp, Homo sapiens
  chr19:34113145-34113303
  hyper
ggagaaccgctcccggactggaggcgcccgcggcctcgggtgcgtccgctgcgccaggtaagtggctgcgcccctgccccacccctgttcccgccctgcgcaggctcctggcctgcagagacgccaggaaggggtcccgagcgggccccggactgcac

SEQ ID NO: 83199 - DNA, 32 bp, Homo sapiens; identical to SEQ ID NO: 37415
  chr19:34113366-34113398
  hyper

SEQ ID NO: 83200 - DNA, 651 bp, Homo sapiens; identical to SEQ ID NO: 37416
  chr19:34113399-34114050
  hyper

SEQ ID NO: 83201 - DNA, 17 bp, Homo sapiens
  chr19:34114286-34114303
  hyper
cgcgtcccggcccctct

SEQ ID NO: 83202 - DNA, 130 bp, Homo sapiens
  chr19:34175192-34175322
  hyper
cttgtaacagggcagcggacagcaggtaaattgccttccccgggagtagcgtgccgcccggcaggggcctgggtgtgccaaggcccggctctggggatttcaggacccaggccagcgctccccagcagca

SEQ ID NO: 83203 - DNA, 75 bp, Homo sapiens; identical to SEQ ID NO: 37419
  chr19:34175542-34175617
  hyper

SEQ ID NO: 83204 - DNA, 189 bp, Homo sapiens
  chr19:34263083-34263272
  hypo
gacgcgcccttcatccggccgggacccgggacgctggatggccgctgggtcagcctgcaccggagccagcaggagcgcaagcgggtgatgcaggaggcctgcgccaagtaccgggcgagcagcagccgccgggccgtcacgccccgccacgtgtcccgtatcttcgtggaggaccgccaccgcgtgctc

SEQ ID NO: 83205 - DNA, 56 bp, Homo sapiens
  chr19:34263838-34263894
  hypo
gaccacagcgaggatcgcccaccagtacttcgcccaactctcggccctgcaaaggc

SEQ ID NO: 83206 - DNA, 30 bp, Homo sapiens
  chr19:34268680-34268710
  hypo
agcaacttcctgtcacgggcctgggcgacc

SEQ ID NO: 83207 - DNA, 179 bp, Homo sapiens
  chr19:34272529-34272708
  hypo
tcatttttcaaggttcggctctctgtagatctgcaggcaggattgctggcctaacagtcagtggagagtgacccaaggctctggagagtgaccaaggaacacggctgagggtggggggccctggcctggacccccgctgagtgcccgaagactgatggagcatgcgacctcctagcgct

SEQ ID NO: 83208 - DNA, 588 bp, Homo sapiens
  chr19:34288087-34288675
  hyper
tgggctggtcctggccgcgggtggaccctccccacgcgggcggtctcggagcttcctgccgcgcggtgtgtgtgtgtgtgtgtgtgtgtgtgtgtgtgtgtgcgcgcgcgcgcgcgcgcgcttgtggaggtccccgcactctggcccctgttctgggccgagcgccctgcagagctggcgagtttccggggtcagaaacgggctcacgcaactggggcttcgggatgcacaagtcccggcttggcgcccaaaatcagagaaagtctccagtgggacagatgtgcgtcctctgacgcccaccccacgagtccgaaacctggcaggaggggctgtcgcgctggtggtggtcccgggcgcgcagggtttggggctgggagaggggccgcgatgggagggatcgccgcctgcagatccggttccccgctgcccgcccgcaccccctgacctggacgcgcgcacccggcacacactcgcaaacacacccgggggcggacccccgcctctgcagcgcctttctgtcttccggcggcccccacccgcgactgcagaaagataagcttcaagttttcgctccgtatctcaaatgtg

SEQ ID NO: 83209 - DNA, 32 bp, Homo sapiens; identical to SEQ ID NO: 37421
  chr19:34311466-34311498
  hyper

SEQ ID NO: 83210 - DNA, 108 bp, Homo sapiens
  chr19:34396791-34396899
  hyper
aagcttttccagcatcgcctgccagggtgtccctggggacccaccggatcggagagggggtcgggggcgaaaagcgccaggaggctggcagcccgggctggaacccgg

SEQ ID NO: 83211 - DNA, 32 bp, Homo sapiens
  chr19:34397391-34397423
  hyper
ctggccatcagcagccgcggtgcagctgcctc

SEQ ID NO: 83212 - DNA, 16 bp, Homo sapiens
  chr19:34436559-34436575
  hypo
gcgcccagccatcagc

SEQ ID NO: 83213 - DNA, 30 bp, Homo sapiens
  chr19:3455766-3455796
  hypo
ccactcagggctcaacgggattatgcccag

SEQ ID NO: 83214 - DNA, 39 bp, Homo sapiens
  chr19:34558335-34558374
  hypo
attacaggcatgagtcactgcgcccggcatcctttttat

SEQ ID NO: 83215 - DNA, 34 bp, Homo sapiens
  chr19:3456167-3456201
  hypo
ataattcatgcaccccgcgcggaggcagccctca

SEQ ID NO: 83216 - DNA, 140 bp, Homo sapiens
  chr19:3456440-3456580
  hypo
ggcccggctgtgtgacgcctggcggtggccaccctctctggggccagggccgccccggctcccacaacccctcgctaacgggctctcggtctctctcctccctgcagcctactctccgcccgacacgtcccctgcaaacc

SEQ ID NO: 83217 - DNA, 30 bp, Homo sapiens
  chr19:347146-347176
  hypo
aatgccacaatggggcgtggtggcgggtgc

SEQ ID NO: 83218 - DNA, 23 bp, Homo sapiens
  chr19:34896337-34896360
  hypo
accgcgcccggcctttcttaagg

SEQ ID NO: 83219 - DNA, 120 bp, Homo sapiens
  chr19:349135-349255
  hypo
aaaacttagtctattcgtgctgctgtaataaagcaccacggatgaggtagtttatatatacatattttaagaacacatttatttatcacagttctggaggctggaaagccttgatcaagg

SEQ ID NO: 83220 - DNA, 181 bp, Homo sapiens
  chr19:34972183-34972364
  hyper
gtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatgg

SEQ ID NO: 83221 - DNA, 126 bp, Homo sapiens; identical to SEQ ID NO: 37424
  chr19:34972522-34972648
  hyper

SEQ ID NO: 83222 - DNA, 449 bp, Homo sapiens; identical to SEQ ID NO: 37425
  chr19:34972675-34973124
  hyper

SEQ ID NO: 83223 - DNA, 215 bp, Homo sapiens; identical to SEQ ID NO: 37426
  chr19:34973242-34973457
  hyper

SEQ ID NO: 83224 - DNA, 91 bp, Homo sapiens; identical to SEQ ID NO: 37427
  chr19:34973553-34973644
  hyper

SEQ ID NO: 83225 - DNA, 121 bp, Homo sapiens; identical to SEQ ID NO: 37428
  chr19:34973645-34973766
  hyper

SEQ ID NO: 83226 - DNA, 279 bp, Homo sapiens
  chr19:35068601-35068880
  hyper
cgtgtcctgggggcgggcccgggtggcgtggcttggctggacagggagggtaggggcggtagtggggtttgtggcactccagcgtagcaggttgcatctgcgggtccccgcccctgccccgcccccagcccctcccatggtgctggatccaggcagctgatgtgcaggcggggacccctggctgggcgcggtcctgggcgcgtccctgcgcggttcaggcttccatgcgcgctgagactccgctggctctgtggcctgccccgtcgtgtgtgcgtcacg

SEQ ID NO: 83227 - DNA, 30 bp, Homo sapiens
  chr19:3516425-3516455
  hypo
gactcccaattttcccggtgttgaattcca

SEQ ID NO: 83228 - DNA, 85 bp, Homo sapiens
  chr19:35168907-35168992
  hyper
tgagagcgaagtgggcgcgagagcagacgccagctacagttttttttgggttatgtcgtcatgaagccggcgctttcagttgtgc

SEQ ID NO: 83229 - DNA, 412 bp, Homo sapiens
  chr19:35263586-35263998
  hyper
cacctcaccctctcccgggatctccataacctagggcatcaaaagggagaagcacagagtcccggcatccgccgtattacagcggatgggtgcatgcgggcggtgacccgagctcgcgcgggctgcggaaccctccactcaccaacgccggcgccgccatgggcccagggggctgggtgaggccgtgagagtcggcgaggaagccggtcctgcgggctcggccgaccccgggctccggctctgggctgcgagggacctcagtccccgccgtcgtgtaaaatgcacacaaggttcgcggcgccgcctctgcgcgccgtgaggacacagggctgtcgccaaggccccaggaagggttttgcagacgcttgtgggggtgggatcgcggctgacataaaagcgtgtaagtgggtcc

SEQ ID NO: 83230 - DNA, 30 bp, Homo sapiens
  chr19:35316742-35316772
  hypo
tgtttcgaacatcctcggtataaatgcctc

SEQ ID NO: 83231 - DNA, 139 bp, Homo sapiens
  chr19:35323440-35323579
  hypo
ctgaaaagaagaggccgagggttctttgtcctatgtctctccgaatcttaatacctgccctgcagcagactccctggctgccagggcacaccggtcaccccggtagacggtgccgccccgccctcgccaaccccttatc

SEQ ID NO: 83232 - DNA, 41 bp, Homo sapiens
  chr19:35343555-35343596
  hypo
aaggagcgcagatgtcgctcagatagcgacaggaagagaag

SEQ ID NO: 83233 - DNA, 21 bp, Homo sapiens
  chr19:35368034-35368055
  hypo
accaaataggccgggcgcggc

SEQ ID NO: 83234 - DNA, 26 bp, Homo sapiens
  chr19:35395923-35395949
  hyper
cccagctgcaagggccggcgcaccca

SEQ ID NO: 83235 - DNA, 239 bp, Homo sapiens
  chr19:35396250-35396489
  hyper
cgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgcttctctctcggatccatcctcaa

SEQ ID NO: 83236 - DNA, 36 bp, Homo sapiens
  chr19:3544842-3544878
  hypo
agagacacagggcagcggccacgcccacgccgcccg

SEQ ID NO: 83237 - DNA, 111 bp, Homo sapiens
  chr19:35454422-35454533
  hyper
aggaaatgggaaaggcgaaaagtcctagaacaaagccatcttttgcgtctcaacaccgagaacagaagcgtggggggccgacagcgaagggcctaacgtccaagcactcac

SEQ ID NO: 83238 - DNA, 16 bp, Homo sapiens
  chr19:35497210-35497226
  hypo
gcgactctttgtctcc

SEQ ID NO: 83239 - DNA, 165 bp, Homo sapiens
  chr19:35503957-35504122
  hyper
agtttgagtcctgggcgcaggccctggaggggctgtagcaggggattccccgcttgctgaggccaggtctggtgcgggagatcgtggctgcctccttgtggaagccaggggaactgcggaggccgagggctggtggggaatctggcgggccgggctctggctggg

SEQ ID NO: 83240 - DNA, 97 bp, Homo sapiens
  chr19:35524526-35524623
  hypo
tcacctacaaccactcgggcgactacgagtgccacgtctaccgcctgctcttcttcgaaaactacgagcacaacaccagcgtcgtcaagaagatcca

SEQ ID NO: 83241 - DNA, 139 bp, Homo sapiens
  chr19:35531737-35531876
  hyper
tggaggaaatgggtgcggtggaggtgggtttggctgggcacagcgggcacgtgtgggtaagcgggtggggccggttgtgcgggtggcctatctggggcaagcagccgaggccgactgtgtccggcgtgtggttgagcac

SEQ ID NO: 83242 - DNA, 30 bp, Homo sapiens
  chr19:35559263-35559293
  hypo
cccagcgtcactccccgatccccacacccc

SEQ ID NO: 83243 - DNA, 30 bp, Homo sapiens
  chr19:35581749-35581779
  hyper
gagattttaagcactcggtcagggagttgg

SEQ ID NO: 83244 - DNA, 79 bp, Homo sapiens
  chr19:35589938-35590017
  hypo
cgcccccagctccaacgatggcctccccacttggctagctaggatgcctccttcgccggtggatcggaagccctcatcc

SEQ ID NO: 83245 - DNA, 30 bp, Homo sapiens
  chr19:35590789-35590819
  hypo
ctaccccatgcactacgggacactgtggct

SEQ ID NO: 83246 - DNA, 30 bp, Homo sapiens
  chr19:35599404-35599434
  hypo
cagcagtgggtggaacggtcaagatctctc

SEQ ID NO: 83247 - DNA, 224 bp, Homo sapiens
  chr19:35607205-35607429
  hypo
ctccgcctggcagcccgatttctcccggaacctctgctcagcctggtgaaccacacaggtgagcagctggggccccttcctccaagccctccttgtctctgcccctaaattaggaagtatctacctgccccctgaccctgccccatagaagcttttatgttaaagcgcctaaaatcttgtgaaatgcttttctggagccaggagataaacggaagtcccttccc

SEQ ID NO: 83248 - DNA, 30 bp, Homo sapiens; identical to SEQ ID NO: 45834
  chr19:35608942-35608972
  hypo

SEQ ID NO: 83249 - DNA, 551 bp, Homo sapiens
  chr19:35615955-35616506
  hypo
ggcttaaggcctagacgtgtggctgatgaacgtggcccacggtcagcagctcacaggcgggccatcaccccaagtagggccaggagccagccaaggggccgtccaggggccccagccatgcccagagtcccgttggtggtctcaggcactgaggtcgatctcgtgatgctggtagatctgtgtggggcccttaaagcaagcagcaaagaggaagcgtctgccggccatagtgatgtgggcaaaggcacggggggccaccagggccggaggccccagctcctgcagtggctccaggagccccttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtgggggtgtggccagtgagggcctggggtcccgggggtctctgggggccgtggaacagcttggaagcagaagcctgtcggtcccaaaactcc

SEQ ID NO: 83250 - DNA, 87 bp, Homo sapiens
  chr19:35621761-35621848
  hypo
ccatcctgcccagatcgtcctgggctgtcctgtctgggcctgcattcctctggactttgaactctttgagggcgagacccagggctg

SEQ ID NO: 83251 - DNA, 45 bp, Homo sapiens
  chr19:35622243-35622288
  hypo
ttcccccagatctcccgcctcccaccccatcgggaaagcccccca

SEQ ID NO: 83252 - DNA, 360 bp, Homo sapiens; identical to SEQ ID NO: 45610
  chr19:3562248-3562608
  hypo

SEQ ID NO: 83253 - DNA, 30 bp, Homo sapiens
  chr19:3565540-3565570
  hypo
tgttgtgttttgagacggagagtcgctctg

SEQ ID NO: 83254 - DNA, 32 bp, Homo sapiens; identical to SEQ ID NO: 45611
  chr19:3570187-3570219
  hypo

SEQ ID NO: 83255 - DNA, 28 bp, Homo sapiens
  chr19:3571493-3571521
  hypo
acgcttgtgtacacgcttttgtttgaac

SEQ ID NO: 83256 - DNA, 128 bp, Homo sapiens
  chr19:3576034-3576162
  hypo
ggcagggcctccctccgtggggcacagtcccgtgggttgggcgggggaaagatacatagccagacaggagtgaagggggctcactcggtacagcgatgggggatgcccagacgcggggcactcaagtg

SEQ ID NO: 83257 - DNA, 106 bp, Homo sapiens
  chr19:3577705-3577811
  hypo
ccacctccccgacctcgttccctccgtccgtgactgtcctcagcggaccctggacgcccgccgctctagccccgcgtccccaccctgtccccgtcctcgccatcct

SEQ ID NO: 83258 - DNA, 274 bp, Homo sapiens
  chr19:35781236-35781510
  hypo
caattccggtttttaagccacccagtttgtgaaactttgttgtaacagccctggaaaactgatacacctgctctctcgtaaaagatcagctgatacggcagcaccggccactggatctgcgggtcagttgtccccttagacagggcacctgcccgccagtcacaggtcctgtcacccagccccttcctctcatgggctccagccgcctcgctcccacaggtctcctggagacccgagttgctgatgtcagcgactattgcgagtgctcctgtgg

SEQ ID NO: 83259 - DNA, 99 bp, Homo sapiens
  chr19:3578124-3578223
  hypo
gaggcggggcggggccggggttcaaggcccggatgtgcccgccctggggttccccaggtccgcgagggctgctgggtgggactccgcagcttactagag

SEQ ID NO: 83260 - DNA, 69 bp, Homo sapiens
  chr19:35784054-35784123
  hypo
caggtgcaagggcagcgtcggccaggtgtccatcggcgcgtgtctgagtggacgcgtctatagccatcc

SEQ ID NO: 83261 - DNA, 364 bp, Homo sapiens
  chr19:35797873-35798237
  hypo
tcccataacagtttccgcagcttcacaggttgtctgaaaagatactaagcacgtgcaccggcagggtgtcggcgttccgccgacatccaggtcgaacactttgtcaccagagcaccagtggggctgtcttgagtggaagtgctttgaaaaagttttatgtctgtcggttcaggttcgctgttattaatgtactccgtggcgtgttagctggttaacgctatagcaagcatattgcagctctgcccgaacaggactttttattcagtagacttagagatgtttgcacagaggttcccattcctgccgtgaatccgtgtgcccgtgtgactcccaggtccaccaccgttaccggcacattcttttt

SEQ ID NO: 83262 - DNA, 156 bp, Homo sapiens; identical to SEQ ID NO: 45839
  chr19:35827208-35827364
  hypo

SEQ ID NO: 83263 - DNA, 30 bp, Homo sapiens
  chr19:35827795-35827825
  hypo
ggaaaaaaataaggccgagagaggggagtg

SEQ ID NO: 83264 - DNA, 40 bp, Homo sapiens
  chr19:35842975-35843015
  hypo
ggacccggcctctgccggcccggcccgcttcagcctctct

SEQ ID NO: 83265 - DNA, 310 bp, Homo sapiens
  chr19:3585697-3586007
  hyper
ccgcgcctcgtcttccgcacgcagctggcgcacgggagccccacgggcaagatcgagggcttcaccaacgtccgcgagctgtacgccaagatcgccgaagccttcgggatcgcgcccaccgaggtaaggagcccggacaccggcgcccaagaccacccgcctgatggggtgaggggtagggagcttggaccctggacgggagaccccagatccccggatcccagacgtcggggtggccgcctaatcgccggatctcagagacccagccctcagatcccggggtgccacactcccaggggccccctttgca

SEQ ID NO: 83266 - DNA, 224 bp, Homo sapiens
  chr19:35920847-35921071
  hypo
agaaagcaggaggaacgcagccttgctccaggttcgtactcccatacctgaaacgcctcctccttctcccgcctacccaggctgaacacctggagaggggcagggtaggaatgccccctaggtgaccagagtggagaggaggacactgaaggggtctaaggatcacgagaccgcgtgtggcttgacttattcgccaagtggagattcctcgatcatcctcagag

SEQ ID NO: 83267 - DNA, 195 bp, Homo sapiens; identical to SEQ ID NO: 45842
  chr19:35940942-35941137
  hypo

SEQ ID NO: 83268 - DNA, 333 bp, Homo sapiens
  chr19:36024742-36025075
  hyper
tagaaagagcagaaacgagggccatcggaggctgcagcctgaaagtggcgggaagtgggcgggcttaggaggggcttagggagaacccaggggtgctgggcttccatgtaaaagtgatgttcatggcgcttcgcgtgaggtgagctttgccctccctgtgatgcacaaaacaaggacacttggaaccttgccggggacgtgctgaccacttcgcaggcgagagctcagggaagcctcaccaccacctgagaaggccagagtgtgcccgcagtttacagagcggccaacagaggttaagagagggcaaactacttccttagtctctcaacaagg

SEQ ID NO: 83269 - DNA, 815 bp, Homo sapiens
  chr19:36048553-36049368
  hyper
caccgagcacgcgttcgcccaggcctcccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttgggaagcggtcccggtagcccatggcgttgcccagcgtcagctccgagaacttgagcagcgc

SEQ ID NO: 83270 - DNA, 24 bp, Homo sapiens
  chr19:36049396-36049420
  hyper
cgctgggagcggggaccggtgtca

SEQ ID NO: 83271 - DNA, 86 bp, Homo sapiens
  chr19:36138505-36138591
  hypo
ttgtgttttgtgcagcgtgctttctcaacccgtaaagtgcctgatggctggatacggtgggtcacgccggtaatcctaacgctttg

SEQ ID NO: 83272 - DNA, 65 bp, Homo sapiens
  chr19:36166552-36166617
  hypo
aaatattgtctgcaccgtgctcacacacacagacacccaccggacacactcgcttggaggcccag

SEQ ID NO: 83273 - DNA, 81 bp, Homo sapiens
  chr19:36183048-36183129
  hypo
cccaaactcagaggccggctcctgtgggtaagaggggagcaaagaggtcagggctatgtcagggcccggaccccttgaggg

SEQ ID NO: 83274 - DNA, 30 bp, Homo sapiens; identical to SEQ ID NO: 45843
  chr19:36199677-36199707
  hypo

SEQ ID NO: 83275 - DNA, 63 bp, Homo sapiens
  chr19:36220088-36220151
  hypo
gaacgagtggacacacgtcaactgtgccatctggtcggcggaagtcttcgaggagaacgacgg

SEQ ID NO: 83276 - DNA, 558 bp, Homo sapiens
  chr19:36221431-36221989
  hypo
accacaggttccatccgcattgactccctgggtactctgtctgatctctcggactgcgagggacggctcttccccattggctaccagtgagcggtcggggtgatccatggggccaggggactccatagctggatcccatttcccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgccttgtgtgccaggggctgtgcccggcttttcatgggaagtgaggtggggagagcggcacgctgcctacttgag

SEQ ID NO: 83277 - DNA, 131 bp, Homo sapiens
  chr19:36222351-36222482
  hypo
agggtacacccatcccgtctggaaaccagggagttttgggtggaggagggagatcagtttgcagaggttgggtggagccaggtaatggagagcctccgggccggggcgggcgggagcgtctgatgtggctt

SEQ ID NO: 83278 - DNA, 277 bp, Homo sapiens; identical to SEQ ID NO: 45846
  chr19:36249972-36250249
  hypo

SEQ ID NO: 83279 - DNA, 34 bp, Homo sapiens
  chr19:36267492-36267526
  hypo
acccagtccctgctgcgcgcgactgggctggcac

SEQ ID NO: 83280 - DNA, 83 bp, Homo sapiens
  chr19:36280047-36280130
  hypo
tcccatccaaggcctcgggtctcacttctgcaggctggagaagagacctcctctagtcagctcagtaccgggtgcctgcagga

SEQ ID NO: 83281 - DNA, 482 bp, Homo sapiens
  chr19:36334909-36335391
  hyper
ctatccctgggtgggcggagctcccacaatgaggagactccacaatgggcaaggttccttgggtgggtgtggtttccatggtgggcggggctcacagtgcacgtccagccgcagccgcgcttccgcggtgccctcagagttctggcagtgcagctgatagaggccgtcgtccgcgcgggtcacattccacagatgcagagccccgctggacaggatgcgatgccgggggccgcccgctggggaaggccagaataagggacctggcaggacctcccatccccgggacccctccccatgaccacttccctcacctggactgaggcgatagccgcggaaggtccagttgaaggcctcgggggcggggttagcggacacggacacgggcagcaacgcctcgccctgctccaccgcggtcaccaccagcacctgctcccccaggaactctggacggtcttcagagggggcgccgcagggagtcaaga

SEQ ID NO: 83282 - DNA, 359 bp, Homo sapiens
  chr19:36336410-36336769
  hyper
ctctccggggtggggcggccacgccctccagcctgtggaaccggggtcaagccagggctgcgagcggagccagaggctggagaggcactaggcgggggcgggacatgcgtggagggggcgaggccagaccagagaggggagggatccctcgcactcccacctctccccttccttgtcccaggacaagttgaccggcggattgctgctgacgctgacgcatgtcaagtttaaggcgtctcccgggcgcagtgcggatgcgttggccaggatcgtcacgttagttgggggaactgggagacggggttggaggagcgagactcagaggttaggggcggcctggtctgcgtccaccccgcctg

SEQ ID NO: 83283 - DNA, 147 bp, Homo sapiens
  chr19:36336989-36337136
  hyper
accagcaccagctctcgggagaaggtgctcccagatttctccacgctgccgagatgcacgcgccgcgactcctgcggcagccgcgactcggtcacggtgcgcgagtcctacgggccgggagtgactggggttcgcaggcagccctgc

SEQ ID NO: 83284 - DNA, 146 bp, Homo sapiens
  chr19:36342250-36342396
  hyper
tgaggtcacaggcctcgatgtgcaggtggaattcacctgcagggggagccggaagtcagggccgcagcttccgctggtggctgagggtctcaggctctgatcccttacctctagcagggtccccttccaggcggtacctcgggaag

SEQ ID NO: 83285 - DNA, 256 bp, Homo sapiens
  chr19:36347809-36348065
  hyper
cccagagacccaggccgcggaactggcaggcgtttcagagcgtcagaggctgcggatgagcagacttggaggactccaggccagagactaggctgggcgaagagtcgagcgtgaagggggctccgggccagggtgacaggaggcgtgcttgagaggaagaagttgacgggaaggccagtgcgacggcaaatctcgtgaaccttgggggacgaatgctcaggatgcgggtccccgccctcctcgtcctcctcttctg

SEQ ID NO: 83286 - DNA, 580 bp, Homo sapiens
  chr19:36351788-36352368
  hyper
acccctagtctctttcgtccagttgggccgattctgcaggcaaagccggagcccgtgtccgtggacgtgggggaagacgcttccttcagctgcgcctggcgcgggaacccgcttccacgggtaacctggacccgccgcggtggcgcgcaggtacagccctaaatctgaggcggtggctggagggggaccaggcttccttacaaatccggcttctgacgccccttccctgtcgcaggtgctgggctctggagccacactgcgtcttccgtcggtggggcccgaggacgcaggcgactatgtgtgcagagctgaggctgggctatcgggcctgcggggcggcgccgcggaggctcggctgactgtgaacggtgagaaggcggggcttcctaggggacctggcccgtcctgggatagggagcggacagagggggcaagggctaatgcagtgggagtggcctggaaggagctttacacccagcgggggctggagaccggacctattgaaggcgaggcttttaggagaatcggagtttggaggcggcgtggcctgattgattgaggttagcggagagtgcgctgg

SEQ ID NO: 83287 - DNA, 83 bp, Homo sapiens
  chr19:36353747-36353830
  hypo
agtcctctctcttcccgcttattggtctgcacacattgtgaccccgcccatcgcttaactccaccggtcgctgtttgtcagcc

SEQ ID NO: 83288 - DNA, 56 bp, Homo sapiens
  chr19:36360563-36360619
  hyper
tccaggccccggggtcggcccaggtggctggactatgcgggcgcctaacccttcac

SEQ ID NO: 83289 - DNA, 230 bp, Homo sapiens
  chr19:36361080-36361310
  hyper
aagacaaatttataacgggaagggagagttttggagaggcggaatagaggaaaaggcggggcctaaaggagggtgagacctttggggagacgaatctgactgcggggaggggtgaccagagaggtgggcttagagggaccttcagaaagaaacagcacaggaaaagagatagggcttaaagatgacgggacttttaagggaaaactgctagtgggcgtggccaatgagca

SEQ ID NO: 83290 - DNA, 30 bp, Homo sapiens
  chr19:36442475-36442505
  hypo
gttcagtgtggctggcgcaccatgggagaa

SEQ ID NO: 83291 - DNA, 440 bp, Homo sapiens
  chr19:36449856-36450296
  hyper
tggttccctcaagcccgacggacgtctgtgttttatgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgcagggctcgcggcaggcggcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtgg

SEQ ID NO: 83292 - DNA, 45 bp, Homo sapiens
  chr19:36450544-36450589
  hyper
cgccccagggtcgctggagtggtctccacacggtgccccactttg

SEQ ID NO: 83293 - DNA, 154 bp, Homo sapiens
  chr19:36478149-36478303
  hyper
ctacctggccacatgcgcgggtgacagccctgccgggagcgctgagtatgcggccagggcttcccgctgagcggcgcctctgagtgcccgcagccgaatgcggctgcttccttgcaggcggacacccaccgctgggcaccgtctggtaccctgc

SEQ ID NO: 83294 - DNA, 118 bp, Homo sapiens
  chr19:3649925-3650043
  hypo
actgggacccagacccgctgggctggcgccctgcacgctctgctcacgccacaggctggtacgctcacctgctcccccgccaggccagcgaagaccctacaaacgccaggatggtctg

SEQ ID NO: 83295 - DNA, 654 bp, Homo sapiens
  chr19:36523267-36523921
  hyper
gtggccctcggggggcgggtgcagagttgggggcagccttcaggcaaatcctggaggcagaggtcagctggagagggtgcccggcaggctccagggtccaagcccctaggagcttccagggccccgggtggcctccgcgcaactggatcttgggcaaccatagggacccccgttacccatagagggccccggtgtgtgcgcccagcgcctgccacctcccccaggcccagccccccattcttctcctcccgcgtcaggcccctcagtcgcggctgccccctccccgggtttgtttatctcgggattcaggatgcttcgcccctccccttctccgcgggccgccccctccccatcttacctcgggcagacagcgctggggaccaaagtggagactggggagactgtgggagcaatggggtgtcggtgtcaggggacgtgatgggggaggcaagggagacagagagaaggggacgaggcccagacgccgacagggggtgggggcggagagggaggggcgcgactgcgcatgcgcctgctgcccccctaccggcggcgggggaggagggaccaggaggagggaccgggaggcgctcgcattgatggaggggccagaggcggcgactgaaaggggagagcctccgggcactgggagag

SEQ ID NO: 83296 - DNA, 21 bp, Homo sapiens
  chr19:36546792-36546813
  hypo
gggcgcggtagctcacgtctg

SEQ ID NO: 83297 - DNA, 187 bp, Homo sapiens
  chr19:36547420-36547607
  hypo
tctcagcctgaatgtcgctatcttgaaaggccttctcgaaccccattctaaagcaaacagccaccttcatctgtcacccagcaccctatacttcatagcctttatcttatatgttcctgaaagtgccctttgagctattaaactacatataacaatagcaaattcagagaggcgttatagcaaagtg

SEQ ID NO: 83298 - DNA, 454 bp, Homo sapiens
  chr19:36604324-36604778
  hypo
cagccctcccctctgcgcccatctgtgcagggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaa

SEQ ID NO: 83299 - DNA, 165 bp, Homo sapiens
  chr19:36640992-36641157
  hypo
tgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccaga

SEQ ID NO: 83300 - DNA, 196 bp, Homo sapiens; identical to SEQ ID NO: 45849
  chr19:36704661-36704857
  hypo

SEQ ID NO: 83301 - DNA, 280 bp, Homo sapiens
  chr19:36736016-36736296
  hyper
agacccggcgagcctcgctgcccttgcgagagccatggattcgcatttgcgcagagtcggggtctgttgctacgggtcccctgggctcctttgaatcgctttggcagctccctcggtttagagctacagggttttctccctcccctgagactctaacgcgtgcaccaactcgcgcctagagggcgtgtatgaccccagctcagttctaagccgaggggctgctgccggacattctagggtctgatctggcgggctcgaagggaggacagtcactgcgacc

SEQ ID NO: 83302 - DNA, 285 bp, Homo sapiens
  chr19:36736314-36736599
  hyper
cgacgcccacccagaaaatccggatcacatttcccgtggtccaccgcgcatctaggaggttacctgcgtccaggcggtgacttgcgagggaccacctttcccagggtccacggcgcatttaggtggtggcttgctctggactacatttcccagggtccaccgcggatctaggaggaggcttgagatgcagcctcccagcttcgaggctaccacctgcccgaattggtgctttggcagagtctctggtgcccgggtgaatgggttcagggtctcttaaggaccctc

SEQ ID NO: 83303 - DNA, 4 bp, Homo sapiens
  chr19:36736765-36736769
  hyper
cggg

SEQ ID NO: 83304 - DNA, 100 bp, Homo sapiens
  chr19:36747764-36747864
  hypo
tttgtggaaagctctcggcccctctggcaggcatctctgaatgtggcttggattcgggcgcaggccctgtctcgcaggttttcaggtgcgcttggctttt

SEQ ID NO: 83305 - DNA, 225 bp, Homo sapiens; identical to SEQ ID NO: 4642
  chr19:36822242-36822467
  hyper

SEQ ID NO: 83306 - DNA, 335 bp, Homo sapiens; identical to SEQ ID NO: 37450
  chr19:36822557-36822892
  hyper

SEQ ID NO: 83307 - DNA, 105 bp, Homo sapiens
  chr19:36881579-36881684
  hypo
ccattgctatcaccacgaaaatccatgattttgtaaaattaaagagcgtagttttcaaattctatcattcatttgatctttgttttgttttgttttttgtttttt

SEQ ID NO: 83308 - DNA, 30 bp, Homo sapiens
  chr19:36904317-36904347
  hypo
aaaaagaataatttacgacaacctgaaatc

SEQ ID NO: 83309 - DNA, 281 bp, Homo sapiens; identical to SEQ ID NO: 37451
  chr19:36909068-36909349
  hyper

SEQ ID NO: 83310 - DNA, 312 bp, Homo sapiens; identical to SEQ ID NO: 37452
  chr19:36909623-36909935
  hyper

SEQ ID NO: 83311 - DNA, 41 bp, Homo sapiens
  chr19:36912309-36912350
  hyper
ggactgctcagccaccggccgctcccggcaccaggggacgc

SEQ ID NO: 83312 - DNA, 113 bp, Homo sapiens
  chr19:36912480-36912593
  hyper
cgagacaagccggtgcgcatcaccatgcgcggcctggcttcggagccgctggacacgctgcgcgcgcgtccctgcgcgacgagaaggctgggctcttccgctactgcgccgac

SEQ ID NO: 83313 - DNA, 32 bp, Homo sapiens
  chr19:36912845-36912877
  hyper
cgcgcgggccgggtgcgcgccacgctcttcct

SEQ ID NO: 83314 - DNA, 38 bp, Homo sapiens
  chr19:36993076-36993114
  hypo
tgttgtactcttcagcgctaatatttcttttctttttt

SEQ ID NO: 83315 - DNA, 271 bp, Homo sapiens
  chr19:37064089-37064360
  hyper
cacgtggaccgacctcgcccggcagcgcggggccacctcaccgcgagctcctcccgcagcccggcccgggtcacctcgactcgccaggcttaactcaataaccacaacaccggaaaaggaagcaaaggtcgaagttcatccgcggccctgaggcctgtgggaaacgtagtccaacaacgaaagagccctgaagctcaagcggagcccgctggccgcaggggccgcaccacgccccagaccctggagtttccgggtgcgcagacccttgcca

SEQ ID NO: 83316 - DNA, 127 bp, Homo sapiens
  chr19:37064635-37064762
  hyper
caggctgagggaggccgaagaaggaactggagggccgggctgggaaggcctgaagcgggtacagcctttaggctggggagggtcgaggggagaactcggagcctgagtcgggcgaggttttgctcca

SEQ ID NO: 83317 - DNA, 25 bp, Homo sapiens
  chr19:37093816-37093841
  hypo
agtgaaactccgtctcaaaagaaaa

SEQ ID NO: 83318 - DNA, 148 bp, Homo sapiens; identical to SEQ ID NO: 37455
  chr19:37095665-37095813
  hyper

SEQ ID NO: 83319 - DNA, 107 bp, Homo sapiens
  chr19:37096487-37096594
  hyper
gcgaagggggattttgcccgttctgatcccgcggaagcgccatcgctggcggcgggtccccgcgcggagcgggcgctgtgtgttcgcgcgcgcgggcgcgcgctgaa

SEQ ID NO: 83320 - DNA, 135 bp, Homo sapiens
  chr19:37108753-37108888
  hypo
acttgacagaattctcgctaaaactgggcccttcggtggacatgcccaaggactgggcctaattggttaaagttttatggtattgtcctgagtcctgggatgcagtctttactcctaaaacgtggcccttctgga

SEQ ID NO: 83321 - DNA, 30 bp, Homo sapiens; identical to SEQ ID NO: 45851
  chr19:37110908-37110938
  hypo

SEQ ID NO: 83322 - DNA, 880 bp, Homo sapiens
  chr19:37157302-37158182
  hyper
gtgctttttctttcacgtaaataaatgagatttacacaaatagccattcacaatcatggtcacagtcacctacaaaccccatttacacaaatgatcaggcacacaatcacactgtcactaaagcacacccacgcaccaggtcgctgtcccaacagtaacacacagcccaaagagaaaccctacttcctcacgcattcaaaacacacccacctaagggctgatcccgcactcagaggcctaaaactatagacattcccttccgcggcactggtgagccaggatttcttaccttcagcattctcagggaaggctctggtccaagctctgattcggattccaagcgaagccacacgcccagctcttccttctccaccggcccgggacatccttacctgcctctacccggagaccattcctgcgaggctcctaccggaagtagctgtggacagcagtgtcctctgggaaatgcagtccgaggggagagcgcctggggtggagcgggtgtgttccgccgggctccgggatgcacttgcgcagtttcacccgaggctggagtgacgccaacctgttaatgttcgttttcggattctggacttcgggttccgctgaggacggatttcggaataggcacagtggctgccccgaacccctcaaggcggcctccgcgggctgtggctgaagataattttcggcgggcgcggactaacccggcttccctttgtggagttgtggtgagaaaggtgttttgttgtgcgcgtgtccgaaggtgactccggaggagaaggtggatatgaactgacggtgagggtgtagcgcgtgagatttgtatgtgaaacgatttaaaaaaaaattttttttttggccgggcgcggtggctcac

SEQ ID NO: 83323 - DNA, 87 bp, Homo sapiens
  chr19:37159081-37159168
  hypo
tcaagcgatcctcccgtctcagtggccaaagtattggatgacaggtgtgagccaccgcgctgggtggtgaaacggttttgaggcttt

SEQ ID NO: 83324 - DNA, 93 bp, Homo sapiens
  chr19:3716365-3716458
  hypo
cggcctggtattgaacaccaaaatgtctcaagacgttgccaagggtccccctctggtgagaggcactggcttggagttcgaggtgcaggggca

SEQ ID NO: 83325 - DNA, 38 bp, Homo sapiens
  chr19:37179419-37179457
  hypo
cccatgcgggccgggcgcggtggctcacgcctgtaatc

SEQ ID NO: 83326 - DNA, 28 bp, Homo sapiens
  chr19:37260522-37260550
  hypo
aataaaaattcagcgatggagttgatgg

SEQ ID NO: 83327 - DNA, 1072 bp, Homo sapiens
  chr19:37263321-37264393
  hyper
cagacctgcaactcacgcacacaaggtactgcacagacacgcaaagtcacacacccaccccgggacacgcagtccaaccacacagtcaccggttcttcacatccgcacgcacaacgagggtcgtccaggacacacacacccactccgggcgcgcacagtcacaagcgcccacctgatcacccagagtcagcaccacacagccacagtcacagaccacggagacccacggcagccatcgcgatcacacacgcaaactcctctcctcagccctccacacacaaaaggaccggagccggattcctcaccctcagcattctctggttccgctcggggccagcctagccaagttcctcaggactccaaggcgcggcggcagctaaatcggcacagcaaacggtcccgccacctggctaagaggaagccaaaatctcgcgagacgtggcgtcggcctgcgggatcctctgggaaatgtagtccagagcccgactgcgggcttccctatgcctctcatttccaagcctggcttgtttccttttaccgctcctctccaacgaggatcgcagagccctcatgccgagcggctcgctatggggccggctcgcccgctagagtggtcaggcctgattatccctggcagctctgttatctggggtaagacacaggaaaacgtgcttccggttctcggcggaagtagccccgaacggtagaaccgatgggaaatgtagtccagggcagaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagggctcagtctgcattgcgcggaaaatgaaggtgaaggtggaggtgggacctgatggtctcgtcccggatagggttgaagaagtgggagaaaaggaatcaaaatcgtggatgggataagattgtgcgcgaatgctctctgggagcggatcgtggccgacgagggcccgaagat

SEQ ID NO: 83328 - DNA, 30 bp, Homo sapiens
  chr19:37286524-37286554
  hypo
ttatttatttaaagacggagtttcccttac

SEQ ID NO: 83329 - DNA, 32 bp, Homo sapiens; identical to SEQ ID NO: 37459
  chr19:37287904-37287936
  hyper

SEQ ID NO: 83330 - DNA, 189 bp, Homo sapiens; identical to SEQ ID NO: 37460
  chr19:37288236-37288425
  hyper

SEQ ID NO: 83331 - DNA, 99 bp, Homo sapiens; identical to SEQ ID NO: 1383
  chr19:37288606-37288705
  hyper

SEQ ID NO: 83332 - DNA, 101 bp, Homo sapiens; identical to SEQ ID NO: 37462
  chr19:37288706-37288807
  hyper

SEQ ID NO: 83333 - DNA, 17 bp, Homo sapiens
  chr19:37292008-37292025
  hypo
ggcgcttggccaagggg

SEQ ID NO: 83334 - DNA, 30 bp, Homo sapiens
  chr19:37295038-37295068
  hypo
gtgaagcactgcacccggccttcatagatt

SEQ ID NO: 83335 - DNA, 210 bp, Homo sapiens
  chr19:37328802-37329012
  hyper
ctccccacacattcacgaaggactatgcctgtcactcaacgcaaagctcaattctttgtttttggccccatagcggctgctatcaccacctttacgaacgtggtcacgcacaacgcgacgcagtcataatcacgtacatacagtcacatttaaatagtccattagggtcacacacagcgcctgtcaacgtcgtgtgcgcgtgcgcgcaca

SEQ ID NO: 83336 - DNA, 317 bp, Homo sapiens
  chr19:37329072-37329389
  hyper
tgcatcaatttcactctcgcatccactgctcccatcgcgatcgctcgcccccacgctccctcgccggcaaagccaccaactccaaagacattagcacctcactcccctcagccccggcctcgggccctccggagtcattcggcttctgtgtctcggaatcactcacccggccctgcggtcccttgatggtggaaggttccgcgatctttctattaaccctaaagggacagagggctgacaggaagttgcccggggaacggtgcactctgggaaatgtagtccggagcctgggccgtctttaactgccccggacaccg

SEQ ID NO: 83337 - DNA, 15 bp, Homo sapiens
  chr19:37329447-37329462
  hyper
cgcccacacaccgct

SEQ ID NO: 83338 - DNA, 379 bp, Homo sapiens
  chr19:37340723-37341102
  hyper
aatatgacctccccacgcccaaagctgcacacatcttgacctcacttctctcacacacacaccaatctgacccgcacgcggtttctttcactcaactacccagacacccctcatcccaccagcacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcctcaagagcgtctgcgtgcttccagcgttaagtggaattccaagcagcctccggggcacagttagtctggtcactg

SEQ ID NO: 83339 - DNA, 93 bp, Homo sapiens
  chr19:37341165-37341258
  hyper
cggcgaggcttggactacgtttcccaggagaccctgcggtccagtatgtctcccgaggaggggcggaagcccgggagccgccctctgaggctg

SEQ ID NO: 83340 - DNA, 720 bp, Homo sapiens
  chr19:37341469-37342189
  hyper
tgctgaagtgctgttcgcaggctatggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtatgtccccttggggtgtgtgtgtgtgtgtttactaccatttgccgaactgtgtgtagt

SEQ ID NO: 83341 - DNA, 30 bp, Homo sapiens
  chr19:37406378-37406408
  hypo
aatcacacatcaccacgggaacacacagcc

SEQ ID NO: 83342 - DNA, 387 bp, Homo sapiens; identical to SEQ ID NO: 37468
  chr19:37406765-37407152
  hyper

SEQ ID NO: 83343 - DNA, 221 bp, Homo sapiens; identical to SEQ ID NO: 1386
  chr19:37407153-37407374
  hyper

SEQ ID NO: 83344 - DNA, 215 bp, Homo sapiens; identical to SEQ ID NO: 37470
  chr19:37407375-37407590
  hyper

SEQ ID NO: 83345 - DNA, 575 bp, Homo sapiens
  chr19:37463993-37464568
  hyper
ccagtgaccgtggtgcggtccaggccccgggtggcgcacccacctctggactacatttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccag

SEQ ID NO: 83346 - DNA, 99 bp, Homo sapiens
  chr19:37464666-37464765
  hyper
cgtgtgccgggtcatcgaccccatctttgggaggcctgggagggggcgggacaccctcgctgtacattctggggatacgctgggcggggtctgccctgt

SEQ ID NO: 83347 - DNA, 128 bp, Homo sapiens
  chr19:3747892-3748020
  hypo
gacggacggcgagggcggcgcgtacacggatggcgagggctacacagacggcgagggggggccctacacggatgtggatgatgagcccccggctccagccctggcccggtcctcggagcccgtgcagg

SEQ ID NO: 83348 - DNA, 89 bp, Homo sapiens
  chr19:37500805-37500894
  hypo
agtccggccctagggcgcccgcagcccccactccctcgccgccccctacttgatcccggattcagccaccaccgcgctgcagcaggagc

SEQ ID NO: 83349 - DNA, 134 bp, Homo sapiens
  chr19:37502995-37503129
  hypo
tgagaccctagcaggcgccctgaagctcctcctccaccggtagaagtcggcacaaggaggtcttgaggacaggactcctggtggtccagccctggggcgcccgcagtcgcctctctcaacgaagcccgctcctc

SEQ ID NO: 83350 - DNA, 30 bp, Homo sapiens
  chr19:37504196-37504226
  hypo
gagccaggcgcctgtcggccttgccaatgt

SEQ ID NO: 83351 - DNA, 18 bp, Homo sapiens
  chr19:37551294-37551312
  hypo
ctcctcccctcagcccgt

SEQ ID NO: 83352 - DNA, 41 bp, Homo sapiens
  chr19:37557046-37557087
  hypo
agaacatttataactcggccaggcgcggcggctcacgcctg

SEQ ID NO: 83353 - DNA, 30 bp, Homo sapiens
  chr19:37569468-37569498
  hyper
caaggtaggagtgtccgggatgccggagcg

SEQ ID NO: 83354 - DNA, 84 bp, Homo sapiens
  chr19:3760214-3760298
  hypo
catggctggaggccccgaaggggatcgggaaattgtggggaagtccatgcctggactccaggcttaggccggcatcttcaggca

SEQ ID NO: 83355 - DNA, 310 bp, Homo sapiens
  chr19:37663494-37663804
  hyper
cacagaaaccccaatcgtgatcaaccaaaatcacctcaaagatttatcggtattggaatatgaaaatactcctgacaccagcggcaaaaaagccttggaagaccacttccacttccggtccgacttctagcacctcccctttgtaggctgttgatatggcgcatgctctgaataaacttggaagccagtttcctcgaacagtcaacagggcgcagacacagcgcacaggttccgtaatgtggcgctgtccggcagagaacatggccgcgcccttatggtgtttattcgcgtgggccgccattttgaaagc

SEQ ID NO: 83356 - DNA, 15 bp, Homo sapiens
  chr19:37693192-37693207
  hypo
cggcacccggcctca

SEQ ID NO: 83357 - DNA, 84 bp, Homo sapiens
  chr19:37702085-37702169
  hypo
caccgcctccggctgttatatttacaatacctaagttaccccttggttacggcacactgcagaaaacaacgatttactaggaga

SEQ ID NO: 83358 - DNA, 20 bp, Homo sapiens
  chr19:3773897-3773917
  hypo
ccagtcgggttgctatgtta

SEQ ID NO: 83359 - DNA, 343 bp, Homo sapiens
  chr19:3778074-3778417
  hypo
ggaggatgacttgcccgcctggaccctccttgggcctggtcagtgcccccacgccgcactctccactctctcggtcctctggggccaagggccccaccgggtggggtcagggctcctggcttcggggcgaggtggagccgtcggcgtcctgccctgagacggaggctggggcacctgcactgcgtagctcccgggccagcttctcggccagtttgcggaagggtggccggcgggcgggctctgcctcccagcagctgctcatgaggacgtgcacggggcctggacagccctcggggggttccatgcggtaccccttctccacggcctccgacacctctttcag

SEQ ID NO: 83360 - DNA, 496 bp, Homo sapiens
  chr19:3778991-3779487
  hypo
cgtgtttgagagcctcgggcgccgtccacttgacgggcagccggcttgagtctagccccttccgctcggctttggccaggccaaagtcgctgaccttggccaccaggtcctctgagaccaggatgttgcgggcggccaggtcgcggtgcacaagcttcttgctctccaggtactccatgccctcggccacgtgcctgggggtagtagggggcagtgggggctcaggtgccaggatgcccacattcagggctcagaaagctcggggtgcctggggccacaagctcacaaagcctccctgccccgtgcctcagtttccccttgatggatcttggaatctgcgccccgacgaccccagtgccgcagcaccctgagagtcccacttacagagaaaactgcaggagctgagcggtgttcacgagggctcgaccccgggtccgcagaaagttcaccaggttgccctgttgggggtgggagatggccgcgggatgttggggct

SEQ ID NO: 83361 - DNA, 30 bp, Homo sapiens
  chr19:37795994-37796024
  hypo
aaaagcctagcacaccggaaaacctgcgag

SEQ ID NO: 83362 - DNA, 30 bp, Homo sapiens
  chr19:37803863-37803893
  hyper
ttagttgtttcttcccgcccacctgcccct

SEQ ID NO: 83363 - DNA, 279 bp, Homo sapiens
  chr19:3785557-3785836
  hyper
ggcccctccaagatgcgcctcccatgaaatcctccagtcccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccact

SEQ ID NO: 83364 - DNA, 357 bp, Homo sapiens; identical to SEQ ID NO: 1351
  chr19:3785864-3786221
  hyper

SEQ ID NO: 83365 - DNA, 103 bp, Homo sapiens; identical to SEQ ID NO: 37139
  chr19:3786583-3786686
  hyper

SEQ ID NO: 83366 - DNA, 30 bp, Homo sapiens
  chr19:37933859-37933889
  hypo
ttcactgagtgtgtgcgctgtgttacacag

SEQ ID NO: 83367 - DNA, 73 bp, Homo sapiens
  chr19:37940221-37940294
  hypo
ctcacatttgaacaccgaaaaaattgacattcaatacatgaatgttggttgataatgccgttttggagtcttc

SEQ ID NO: 83368 - DNA, 30 bp, Homo sapiens
  chr19:37947570-37947600
  hypo
ttacttttaaaaactcgaggccaggcacag

SEQ ID NO: 83369 - DNA, 935 bp, Homo sapiens
  chr19:37957671-37958606
  hyper
tcccactgtcatgcacgtttgcacgcaggttcatactgaaagataaaagggaaagcgcctccacgaaatccgcttacggacacgatcccggggccacactcagccagacgaatgtctggcaaatgacagtcacttcacgccagactctcacagtccttcacacgccactcccactgcctcagggaaccacaagcacaggcatcgccccgcccggcgtcctcctccaaagattggggcaccaggaccgcgggcccccactcccacccagcacaaagagtccggcgctcagagctagcggtttcccgaggactcaccaccaagcccgcggacacaggccccgattccacacttaacgctgccaaagtggcagagccggcgcgggctgggacagaggcggcactgaggccggcgctgtcggtggctgagagcgccacaagtctcggtccgttacaccaggggcgacgcttcccagaggcccccgcggctcacccgggcgggactggcttcactgtttgcgcgtcctgagaagcagaccacggtgttccagggctcacagctccgcgcaggggagctcagcctaggttttgcacgagcggcctcccgcgagcccagctctgagagattgggagcgcaacttggtgctgagaagaatcgaatcgttccgctgcttcctgcgccgaactacatttcccagaggccttcgcggccctacttccccgaccccacctgcaaaaaggcacttccttcttacagtcggctggagctgcaggttcgcaaggtccgtgaaggaagcccggctcagtgtgtttagttccgtctttttgggtctctacctgaggctagaatacagcggggtgaaggtggtgagagctccagggccagtgaaggccgggtcagctggagccttaaggtcctgacagcggctagaagaggga

SEQ ID NO: 83370 - DNA, 15 bp, Homo sapiens
  chr19:37959786-37959801
  hyper
cctcccaattttttt

SEQ ID NO: 83371 - DNA, 956 bp, Homo sapiens
  chr19:37959873-37960829
  hyper
cgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcggcttctttgtgactgggttgtgagattgtcgcttgtgatagataccctggtggctgagccttgccggtatgggaaagggtgcccgtgtgaggcagtccatacccatggcctctgactgtggcgtgggtaagacggtggttggcactgtagtttttcagactctgattatgtgggggattgagtgagagactgtgtgccacggagaggcttttaa

SEQ ID NO: 83372 - DNA, 99 bp, Homo sapiens
  chr19:37995676-37995775
  hypo
ctttaatttttccatcgcaaggaagaagaggaaactggtaataatctcctctgacagaataatctcgcaactttaggaactttatttaaagaattcaga

SEQ ID NO: 83373 - DNA, 398 bp, Homo sapiens
  chr19:37997089-37997487
  hyper
tatgcactgtatattcgttcccatcgctcccgtctcacttctccatcccccacctaccaaataaactgcttgcactcattctttcctcaggtcggcttctcgggcaagcctccttaggtaaaaaccttgctttcaacatttcctttccattatgcgctaagaactctgatctcttcccgctgcggcagccccgccctttccttgcggctccgccctttccgtgaagtcacgcccgtccttaggctgtctctgtctccctaagagcgagtctcttcgctgctctctaactcctagagctggctcagaaagagtttcacattgccataggggagctcctaggagaggctgcacccattgcacgtaagaagcggtaaaaatgtacgcggccatcttaccag

SEQ ID NO: 83374 - DNA, 304 bp, Homo sapiens; identical to SEQ ID NO: 37478
  chr19:37997687-37997991
  hyper

SEQ ID NO: 83375 - DNA, 131 bp, Homo sapiens; identical to SEQ ID NO: 37479
  chr19:37997992-37998123
  hyper

SEQ ID NO: 83376 - DNA, 95 bp, Homo sapiens
  chr19:3801434-3801529
  hyper
gacagcctgcccttccgtttttgtctttccagtcccgcctgccggattgggttccagccctgcccacacgcccggtacatcccgcctacactcac

SEQ ID NO: 83377 - DNA, 126 bp, Homo sapiens
  chr19:3801582-3801708
  hyper
cgctccagttctctggcggggagggagaggggtgttgcttctccagccccctgcagcctggtgtcttcctgccacccgccggcctgctccgggaaccgcggcctggtgggacgagggttgcggagg

SEQ ID NO: 83378 - DNA, 503 bp, Homo sapiens
  chr19:38042365-38042868
  hyper
tggccccctcctctccgggggatcgtcgccttggtcccccgaccctaggagtcgggcagggcagaaccaggctaaagaaacgtccagcgtagcttcaaggatgcaccgcgtgatccctatcggatctccccgacgcgtcaggcctgcctagacggtgctgggagcgcgtctccttgaacgttgtcccgcctgggattgcgaggtaggtaccgcctgcctgtgtgtaccggggctgctgtctccggggaggggcttctggcggacaggagaaccaagcagcctcaggagctgcctgggtgtgtgtgtttctgtgcgagtgttgcatatctctgtgtgtgtttctgtgcaagtgttgcatgtctgtgtgtgtggggggggtggtgtctggtgaaaagaatgtgtctcgtgcggtggagcgccgtttctctgtagtccgcgggctctcttatgcgccctcttgtggtcccaagtgtgcttttcttgtttttcgctttcttgggggt

SEQ ID NO: 83379 - DNA, 437 bp, Homo sapiens
  chr19:38085240-38085677
  hyper
caggtgagcccaccccgcggccgcacaagcgcacacgcacacgtccagggcggaggaacactactagtaacacccgcctccttctagcctccctatcccaaagttatggtgccgattttgtccgcggcaggggctccaggggcacactcataaattcggtgcggaggaacacaactagcagcaccacacccccgccactgccagaaccaaagtgacggtgccgacacccctccgcaagcgcaaggccgacttccataagtaattagccagagcaccgtcccgttcctgtcagcaccgagccccagccaggacaccggtattcccagcaccatacaagaactactttttcgatgaagcaacccaaaagctgcgagcggttcccggtgaggccgcccactcacctggccggcgcagacaagctccgtgcgtcaagacat

SEQ ID NO: 83380 - DNA, 111 bp, Homo sapiens
  chr19:38086051-38086162
  hyper
cgggttgctgctcaacggggttcggaagtgtgacgcattctttgcggccatgtgtgtgtgtgtgcgtgtgtgtgtgggtctgtgcgcgcgcgtgtccgagtgtcctctgtg

SEQ ID NO: 83381 - DNA, 21 bp, Homo sapiens
  chr19:38088612-38088633
  hypo
ccactgcgcccagccagcaaa

SEQ ID NO: 83382 - DNA, 83 bp, Homo sapiens
  chr19:38107062-38107145
  hypo
cagttataagtgtcacgaatttaaaaaggacattaccagagatatcgatgtcatcccagctactcgggaggctgaggcaggag

SEQ ID NO: 83383 - DNA, 22 bp, Homo sapiens
  chr19:38107205-38107227
  hypo
gcctgggcgacatagcgagagt

SEQ ID NO: 83384 - DNA, 30 bp, Homo sapiens
  chr19:38145556-38145586
  hyper
taaacggaaggaactcgaatgcatttcaca

SEQ ID NO: 83385 - DNA, 1313 bp, Homo sapiens
  chr19:38146010-38147323
  hyper
cctcttgggccttttcgctacggccgagcctaagtggctgaagcgcggacgaggatgcgcggggcctcggtctccaactgcaccacaggccgcacccacgaacctggtccggcacagttactaccgcccgggcctccaggcctcagggctgcagaagctcagtcccgggaaaaaaagcacaccggcctgaggctccacaggaaccttttctccaccttggcccggcctgcaaaacctggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgtggggccgggtctcggcggggatagtcgggccggggagacggagccagaggggccgcagtgtccctcgcctcaggcctctacctgtaatggccgccccgtgactgaccagtgccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcggatctgtgactgtggctctgcctcatccagcgttatttccagaatccttctgatagggcagcgcttctggttctggttttccatggagacggtttgtgggtccc

SEQ ID NO: 83386 - DNA, 30 bp, Homo sapiens
  chr19:3817232-3817262
  hypo
tctgctcttgcttcacgggggttaagaaaa

SEQ ID NO: 83387 - DNA, 203 bp, Homo sapiens
  chr19:38182757-38182960
  hyper
tcaccattttacagtcgaagaagggaagataagaggcggtgaatccgagactttcattcaggtgacgatccctcgcgggcactcactctcgctcacactacaatcagatcctccatgcggctttcatatactctgtcacactcgcagccagaatcccctcggatggactcttgcaaacctccagccccatcccgggatccgtg

SEQ ID NO: 83388 - DNA, 148 bp, Homo sapiens; identical to SEQ ID NO: 37484
  chr19:38183111-38183259
  hyper

SEQ ID NO: 83389 - DNA, 2 bp, Homo sapiens
  chr19:38183260-38183262
  hyper
ac

SEQ ID NO: 83390 - DNA, 211 bp, Homo sapiens; identical to SEQ ID NO: 37486
  chr19:38183263-38183474
  hyper

SEQ ID NO: 83391 - DNA, 141 bp, Homo sapiens; identical to SEQ ID NO: 37487
  chr19:38210017-38210158
  hyper

SEQ ID NO: 83392 - DNA, 250 bp, Homo sapiens
  chr19:3821004-3821254
  hypo
gggacacagggacaccgggggtcgggggacacaggtcacaaggcacctctgcagccgtgtggtccagcgagttggccggcagtgtccctgcgtctacggaggccctggagcccacgtgtcaggtccgcacgccactgtgcccttgcccgtctgctctggaaccctctcacgctcccacaccaggacgtgcccactgcccgggcacccgtctccccccactgctcgagagctcacacggaggagctccgta

SEQ ID NO: 83393 - DNA, 425 bp, Homo sapiens
  chr19:38210326-38210751
  hyper
cgcctgggggcctccgcgctctgagcgcctcctgcagccccactctcaccgccacgcagggtaccacgcgggcggcgggctggggctgcagaggctcccgcagtgacctgcgccgccttcttcaggtggaaccaaaaggtcccggaaccggagccaggggtccaagttttctccgttgcctttgtaatatgtagtccaagccagaacagtcaggaccgcaggtaccggtgagaaatggagtccagaatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccag

SEQ ID NO: 83394 - DNA, 139 bp, Homo sapiens; identical to SEQ ID NO: 37140
  chr19:3821971-3822110
  hyper

SEQ ID NO: 83395 - DNA, 157 bp, Homo sapiens; identical to SEQ ID NO: 37141
  chr19:3822134-3822291
  hyper

SEQ ID NO: 83396 - DNA, 103 bp, Homo sapiens
  chr19:38228266-38228369
  hypo
agtttgaagggtagagtttcaagaatttgaggacatatttttaaaacaccacgactggcattctgagtacaaattgcttatatttctacgtcatgcaaaatat

SEQ ID NO: 83397 - DNA, 47 bp, Homo sapiens
  chr19:3827483-3827530
  hypo
tccccggatgtgggccgcgtaggcgtccgccccggtgcaggacacgg

SEQ ID NO: 83398 - DNA, 46 bp, Homo sapiens
  chr19:38287099-38287145
  hypo
tcctggtcctaactccgccactcatggcatccggagaccatcccat

SEQ ID NO: 83399 - DNA, 216 bp, Homo sapiens
  chr19:38308121-38308337
  hyper
ttggtcctttggctccgcgctgcgcgtgacctgcagtcacctgagcaagagggcggcgtgggtcgctgcgggagcccctacagccccagcccgcagcccacgtggcaccctacagggctgtgagagtggggctgctggaggcgttcagagcgcggaggccccaggcgcgggccgggctctctcccgcctcctcaggcccgggggtgctggagctgc

SEQ ID NO: 83400 - DNA, 145 bp, Homo sapiens; identical to SEQ ID NO: 37490
  chr19:38308394-38308539
  hyper

SEQ ID NO: 83401 - DNA, 26 bp, Homo sapiens
  chr19:38309113-38309139
  hypo
tagaataaagtaattcggccgggcgt

SEQ ID NO: 83402 - DNA, 64 bp, Homo sapiens
  chr19:38481038-38481102
  hypo
agccagtgagacaggcggggtcgtggggtgaatacctgtggaactttggcggaagccaggtccg

SEQ ID NO: 83403 - DNA, 297 bp, Homo sapiens
  chr19:3855407-3855704
  hypo
aagtgaaagcagtcccgggcgatccggcggcagattcattgagtcattggataaatacttcctgggtgctagtggggaccagctgctgtcatgggcgctgtcacagcagcggggaataaccagaccaaagtcccgtcctccaggagggtgctgcgcgatagtccagggagacacggggtcagcaaaataattcaacgcgatctgatggttctcatgccgccgggaaggacgcggcaagggggtgtgagcagggggttgcactttctcacgggctggtcatggcgggcctggtgggtg

SEQ ID NO: 83404 - DNA, 30 bp, Homo sapiens
  chr19:38554526-38554556
  hypo
gagcctggctggagccggggagatccctgc

SEQ ID NO: 83405 - DNA, 32 bp, Homo sapiens
  chr19:3856184-3856216
  hypo
ggcggccctgcctgccgcggggaagccagcag

SEQ ID NO: 83406 - DNA, 37 bp, Homo sapiens
  chr19:3859512-3859549
  hypo
ccagccactgacttccgtgccccgggaaccgctggag

SEQ ID NO: 83407 - DNA, 30 bp, Homo sapiens
  chr19:38684394-38684424
  hypo
cggcagcggctttcccgagaagaaatgtga

SEQ ID NO: 83408 - DNA, 30 bp, Homo sapiens
  chr19:38688124-38688154
  hypo
acggcaaccccaccccgtgtaaacactgtc

SEQ ID NO: 83409 - DNA, 210 bp, Homo sapiens; identical to SEQ ID NO: 37142
  chr19:3868851-3869061
  hyper

SEQ ID NO: 83410 - DNA, 85 bp, Homo sapiens; identical to SEQ ID NO: 37143
  chr19:3869118-3869203
  hyper

SEQ ID NO: 83411 - DNA, 30 bp, Homo sapiens
  chr19:38700527-38700557
  hyper
cccggcccttcccttcgtgtcccagtttcc

SEQ ID NO: 83412 - DNA, 146 bp, Homo sapiens
  chr19:38701109-38701255
  hyper
ctcccgccccccacccgtcgcccacatctcagtctctctcccagtgcccgtgtctagataccctcctgccctcccttagcgcctctctttccaccttatcgccaccgctgatttgccccacatccaggacacggagccccctggag

SEQ ID NO: 83413 - DNA, 662 bp, Homo sapiens
  chr19:38701550-38702212
  hyper
taggggctggctggtcgcctcacccccaacaaggcccgtcgacccccggtcctccttcttggtgatgccccaaaccagacgggagaacgaggcagtcgtgggcagaggggtcaggcccagtttaatacacagaacaagttaattcacagcagaggcaggcaatagaggagactcggtgacaagtgagggggcactcctggattaggggacatccccccaaaacccaccacctcccccacctgcagtctcagtttcccttttttaaaacccgaacaacaaacacacacaaccacaagaaacaaccacgccccctcactcccccaaaatggccagcgaggggggcgggggccgccaggcctggcggggcgggaggagggagagaaaaggagtccgtggcggagtctgtgcttctcattccagcaggcgctgggcgggggcccacccggccccaccaccgccacccaccagccacggcaggcacggggcgggcacaggctggggcggtcggggaggggcaggaacagagttcaaaaccaaggttcacatcatgcagtatccaccgtgggcaccaggaggggcgggtggacaccacgcccaccgccctgggcacaagaggggaaggcgcccaccttgggtggggcgcgggacggctgcagctccag

SEQ ID NO: 83414 - DNA, 92 bp, Homo sapiens; identical to SEQ ID NO: 37493
  chr19:38718791-38718883
  hyper

SEQ ID NO: 83415 - DNA, 33 bp, Homo sapiens
  chr19:38719684-38719717
  hyper
ggaactggggacccccgacgtctcagctcccac

SEQ ID NO: 83416 - DNA, 37 bp, Homo sapiens
  chr19:38719919-38719956
  hyper
ctctgggtggggaaacggcctccgccacccccagccc

SEQ ID NO: 83417 - DNA, 220 bp, Homo sapiens
  chr19:38720219-38720439
  hyper
gcggtggccatggcccgctcggctgggccgcctccggcccggggcgccgctgccgccgcgcgcgggcccagcccggcctgcgccgcccgctctgccgcccagcgcgctacgatttcattcattcttggggctgcggcgcgagcggagcggggcgggccgggggcggggctcagccaatccccgcgcctcccagcgcacgacgggacgtggagtctagggg

SEQ ID NO: 83418 - DNA, 310 bp, Homo sapiens; identical to SEQ ID NO: 37494
  chr19:38746768-38747078
  hyper

SEQ ID NO: 83419 - DNA, 95 bp, Homo sapiens; identical to SEQ ID NO: 13384
  chr19:38747106-38747201
  hyper

SEQ ID NO: 83420 - DNA, 206 bp, Homo sapiens; identical to SEQ ID NO: 37496
  chr19:38747202-38747408
  hyper

SEQ ID NO: 83421 - DNA, 32 bp, Homo sapiens
  chr19:38755286-38755318
  hyper
cgcaggcggcgagggcgcgagtgaggagcaga

SEQ ID NO: 83422 - DNA, 135 bp, Homo sapiens
  chr19:38782535-38782670
  hypo
atggtctacctgatccgggtggcacggaggaaccaggagcgtgccctgcgcaccgtctggagctccggagatgacaaggagcagctggtgaagaacacatatgtcctgtgaccgccctgtcgccaagaggactgg

SEQ ID NO: 83423 - DNA, 86 bp, Homo sapiens
  chr19:38789299-38789385
  hypo
gtccatctgggtccccggctctgcctctacagcccaggggaatcccacacatggtggcgtctgtgctgcttcgtgcgagcaggaaa

SEQ ID NO: 83424 - DNA, 404 bp, Homo sapiens
  chr19:3880457-3880861
  hyper
atttatttatttgtccgttgttttgtttttaaatctctgatgcgccatcagaaaattatttctgcctctgcccctggcgtggctttcggagatgcttgtctgtcagccaatggggaggatcggattctggcagggggctgtgcttttccgtcaggccgccaccccccaccccctcctccctgcacacaaaagcagcataaattaaccgtcttcgggaagccgagcctctgccagccctgagctgggaagaagcagctacctcggaggcagggcgcgcaggcgggcggcgatgagagggggcgcagccgcagccccgcgctggggagcccaccgctaaccctgcaccccacccacccctgcacaaaagagctggcgggcgctggccacgtcgccctgggtgacct

SEQ ID NO: 83425 - DNA, 512 bp, Homo sapiens
  chr19:3881335-3881847
  hyper
atttcctatttataacgctaggaaggccaccagccgacgatttcgggaaaaaaaaaaaaaaaaaatctaagtgtgtcgataaaggctgtcctgtggggtggggaggaagggggtggtttatggtttaagacacagatgcctcctccttattggaactcgtatgtgatttgttaataatcagacatcagggctcaaatgagcgcttcactcccgttccttgatgtcactgtcttcttttggccgtccccaaatgcgaagccaggatctgagtgcaggagtgtccggggcccactgaggacccaccccaccccatccttagaagactgtggagtcaacgcctgtggctgcagctggcagggggtgggggtcgggggcggggctggtgggagtgttcctgggggctgaggtcacacccagctcagtataaggaagggagaggcgaagaccccttcctccggagagcaaatgcgtttctactgccgaggagaacttaccctcgcgggaagggcctg

SEQ ID NO: 83426 - DNA, 217 bp, Homo sapiens
  chr19:38828116-38828333
  hypo
ggtggactcacccatcgacccgagcgaggtgaggggaccagggtcaagtgaaccagagggattttgaacccgcactccactcatttctggacgtgtggcctaacctctctttgcagaaatacctgggcttcccttactacctgaagatcaactactcctgcgaggaaaaggtgagtgggtgcagcacggataggctcattctatgagccttggtttt

SEQ ID NO: 83427 - DNA, 60 bp, Homo sapiens
  chr19:38852327-38852387
  hyper
tcggtgatgcgcctgcggagcctgcccagtccgcagagatacacgcgccaggagcgctac

SEQ ID NO: 83428 - DNA, 226 bp, Homo sapiens
  chr19:38852967-38853193
  hyper
gtgccccacccccggcgctgactctgccccgcgcatccggtaccccaggattactacttcttcttggcgagcaattggcgaagcgcgggcggcgtgtccatagaaatggacagctacgaaaagatctacaacctcgagtccgcgtacgagctgccggagcgcattttcctggacaagggcactgagtacagcttcgccatcttcctgtcggcgcagggccactcgt

SEQ ID NO: 83429 - DNA, 230 bp, Homo sapiens; identical to SEQ ID NO: 45857
  chr19:38873935-38874165
  hypo

SEQ ID NO: 83430 - DNA, 359 bp, Homo sapiens
  chr19:38877688-38878047
  hyper
cgagggtgaggcctggggctcccggggtaccatgagtcccgggggtgtggcgctgccagggaaccagacacccagcccacgagtcaggcgcatggcctgggaggtcatctcgggctccaccagggacgtccggcgggagtcgggggcgcggtccgagggctgcacttttcgggagcccccgcccgcggatggctccgactgcaagttccccatttctgacggagctcggagactagtcagaaaaatttactccagtcagcctgccagggccgtggggaccctacgaggctggctgtacttgatctaatgcgtccgcaccggccccgcccctgttctccaagatccgatcaggcccaagt

SEQ ID NO: 83431 - DNA, 32 bp, Homo sapiens
  chr19:38879580-38879612
  hyper
ggaccccccaaactgcgcggcagccattcagg

SEQ ID NO: 83432 - DNA, 35 bp, Homo sapiens; identical to SEQ ID NO: 37499
  chr19:38879840-38879875
  hyper

SEQ ID NO: 83433 - DNA, 30 bp, Homo sapiens
  chr19:38880189-38880219
  hyper
ccccctggcttccctcggctggggcctggg

SEQ ID NO: 83434 - DNA, 30 bp, Homo sapiens
  chr19:38901928-38901958
  hypo
cattcttccagcctgcgggccaaggcttcc

SEQ ID NO: 83435 - DNA, 231 bp, Homo sapiens
  chr19:38905501-38905732
  hypo
gcagatcctcattggcgctgcagggtggatgctgcccttggagggccaccagctcctgcagccgcaggtagaggttgttcagcttgggtaggtgcaggcggccgtcaggcaacctgtcgggctgtgcctcatgcagggacaccaggtccttgaggtgcacgcccagtacaggcagccggaaacccgcgcagccagcccaggtgcggcggtagcgggcgtagttgttgtggg

SEQ ID NO: 83436 - DNA, 212 bp, Homo sapiens
  chr19:38924224-38924436
  hyper
atgtgggcagggctccggcgaaggggagtggccggggagtcctggtccaatggggcccgggggcggggacttcctcccatctctgtccagcatgcgtgtactcctcgcagttccatctacctcgcgggtgcctctggtgtctccagaggtctccgaccccagcccgcccccagccctcccgcccagcccgcagccccctccctctgttcccc

SEQ ID NO: 83437 - DNA, 198 bp, Homo sapiens
  chr19:38924437-38924635
  hyper
acctcagaccctgggcttccgacctcgacatcatgggtgacgcagaaggcgaagacgaggtccagttcctgcggacggtgcgtatctctgggttaggggcctgtggggctatctcttggggctctctgagggtctctctgtctctgaatgtccctgtccggcttgctggtggtctctgagactcgaggtctcttccta

SEQ ID NO: 83438 - DNA, 30 bp, Homo sapiens
  chr19:38931911-38931941
  hypo
gggggtagggagggacgaggcaaaggacct

SEQ ID NO: 83439 - DNA, 112 bp, Homo sapiens; identical to SEQ ID NO: 45859
  chr19:38934459-38934571
  hypo

SEQ ID NO: 83440 - DNA, 35 bp, Homo sapiens
  chr19:38954122-38954157
  hypo
ctctgggcgctaacccgcatcgagcagggctggac

SEQ ID NO: 83441 - DNA, 418 bp, Homo sapiens
  chr19:38956612-38957030
  hypo
atcaaaggtcagaaacgccgaagctgggacaagggtcagcagtcagggatcccatatagtgcagagcccggaagtggaggtgagggccttgtcccatggagccctaccatgcccgcaggtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgacca

SEQ ID NO: 83442 - DNA, 140 bp, Homo sapiens
  chr19:38958263-38958403
  hypo
cagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctga

SEQ ID NO: 83443 - DNA, 38 bp, Homo sapiens
  chr19:38964007-38964045
  hypo
ccacctcaggtatcccgagtggacggcactgtggacac

SEQ ID NO: 83444 - DNA, 50 bp, Homo sapiens
  chr19:38973963-38974013
  hypo
gcgagcgcaagaacccggccccgcagtgcccaccgcggctggagatgcag

SEQ ID NO: 83445 - DNA, 80 bp, Homo sapiens
  chr19:38974232-38974312
  hypo
tcctcaacacaaccccgggattccagactacaccccaggaatctccagacctacctcaggggactcgggctcagctcaga

SEQ ID NO: 83446 - DNA, 476 bp, Homo sapiens
  chr19:38976314-38976790
  hypo
gccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcggggg

SEQ ID NO: 83447 - DNA, 271 bp, Homo sapiens
  chr19:38990481-38990752
  hypo
ctcaatagggcaacccgccctccctggcccctggctgcctccccaacccacccaccttccctgcagctttggtgaggaaccgcctgaagaaaaccgggtgcacctgggacacgccatcatgtccttctatgccgccttgatcgacctgctcggacgctgtgcaccagagatgcatgtgagaccctgagccagggcaggatgggaagggagggcaggcacagccgctttgaacgcctcatgcaggcactcggtgacacggagtgagctccca

SEQ ID NO: 83448 - DNA, 306 bp, Homo sapiens
  chr19:38991260-38991566
  hypo
aagggtgaggccctgcggatccgcgccatcctccgctcccttgtgcccttggaggaccttgtgggcatcatcagcctcccactgcagattcccaccctgggcaaaggtgcagaggggatggaacttggcgaaggagtgatgctggggagggagcggctgggtccgcagggcatccccgaacccaccctccctgcctgcagatggggctctggtgcagccaaagatgtcagcatccttcgtgccggaccacaaggcgtccatggtgctcttcctggaccgtgtgtatggcatcgagaaccaggactt

SEQ ID NO: 83449 - DNA, 38 bp, Homo sapiens
  chr19:38993187-38993225
  hypo
ctacctgtgcctggccgtgctgccgctcatcaccaagt

SEQ ID NO: 83450 - DNA, 61 bp, Homo sapiens
  chr19:38996547-38996608
  hypo
gaaaagaaaaaaacgcggaagatatcacaaagtgcccaggtgaaggcggggcctgggtgga

SEQ ID NO: 83451 - DNA, 138 bp, Homo sapiens
  chr19:38998362-38998500
  hypo
acatggaactggactcgtcttccattgaaaagcggtttgcctttggcttcctgcagcagctgctgcgctggatggacatttctcaggagttcattgcccacctgggtacggagaaataccccccgcttatgcccgccc

SEQ ID NO: 83452 - DNA, 55 bp, Homo sapiens
  chr19:39006701-39006756
  hypo
agctaaacacagccccgtcttccaggcttcggccagccctcggggagtgcctggc

SEQ ID NO: 83453 - DNA, 30 bp, Homo sapiens
  chr19:39015083-39015113
  hypo
caccccagggctctgcgaggactcagggag

SEQ ID NO: 83454 - DNA, 30 bp, Homo sapiens
  chr19:39026975-39027005
  hypo
ggaccccaccctccacgtgccccaaatgtc

SEQ ID NO: 83455 - DNA, 131 bp, Homo sapiens
  chr19:39038903-39039034
  hypo
gatggtggacatgctcgtggaatcctcatccaatgtggagatgatcctcaagttcttcgacatgttcctgaaactcaaggacattgtgggctctgaagccttccaggactacgtaacggatccccgtggcc

SEQ ID NO: 83456 - DNA, 52 bp, Homo sapiens; identical to SEQ ID NO: 45868
  chr19:39071019-39071071
  hypo

SEQ ID NO: 83457 - DNA, 230 bp, Homo sapiens
  chr19:3907717-3907947
  hypo
ccacctgcttctagacgacacccccgtggccaccgccaagaacatgcccggggacagcgcggatctatttggggacggcacgacggaggacggcagcgccgccaacgggcgcctgtggcggacagtgatcatcggggagcaagagcaccgtatagacctgcacatgatccggccttacatgaaagtggtcacccacggaggtgagacccgccccccggtgcccccttggg

SEQ ID NO: 83458 - DNA, 30 bp, Homo sapiens
  chr19:39077322-39077352
  hypo
gctgggggctgggcacggcggctcacgcct

SEQ ID NO: 83459 - DNA, 98 bp, Homo sapiens
  chr19:39090729-39090827
  hypo
gcctcctggtcattccggttcaggatgaagatgccttcctctgcccccaggagcaggtgctggtctggaggcacagacaaggacgctgggaccgactt

SEQ ID NO: 83460 - DNA, 30 bp, Homo sapiens; identical to SEQ ID NO: 45869
  chr19:39101480-39101510
  hypo

SEQ ID NO: 83461 - DNA, 20 bp, Homo sapiens
  chr19:39135434-39135454
  hypo
cagggcgagactccacctcc

SEQ ID NO: 83462 - DNA, 34 bp, Homo sapiens
  chr19:39151506-39151540
  hypo
ttgggaatggctttgcgagcgggtggtgagggga

SEQ ID NO: 83463 - DNA, 30 bp, Homo sapiens; identical to SEQ ID NO: 45871
  chr19:39151783-39151813
  hypo

SEQ ID NO: 83464 - DNA, 75 bp, Homo sapiens
  chr19:39187839-39187914
  hypo
tggccagaacccaagcggcgaggtttgttcacagcctccacagggtggggtggggccatccgcagagggtctcct

SEQ ID NO: 83465 - DNA, 74 bp, Homo sapiens
  chr19:39191735-39191809
  hypo
caagctggtctccatcggggcagaaggtgagctggaggtggggcagcgagggtcctgctcggtttctgaccttt

SEQ ID NO: 83466 - DNA, 33 bp, Homo sapiens
  chr19:39210343-39210376
  hypo
ccatggaggcctgggcgtcgccctgtggctgaa

SEQ ID NO: 83467 - DNA, 42 bp, Homo sapiens; identical to SEQ ID NO: 45873
  chr19:39222079-39222121
  hypo

SEQ ID NO: 83468 - DNA, 41 bp, Homo sapiens
  chr19:39235148-39235189
  hypo
ggctggggaaggaggcgggtttacctcggtgtctctatctc

SEQ ID NO: 83469 - DNA, 89 bp, Homo sapiens
  chr19:39266345-39266434
  hypo
tgagatatgcatcctcgatgggctcttattcattagtgttggttatgtttctcatcagttgtgaaacaatattttcttttgtttttttt

SEQ ID NO: 83470 - DNA, 94 bp, Homo sapiens
  chr19:39282944-39283038
  hyper
ccgcctgcgcaccctcggggcagacgcgatggcagcggccccggctctgcggaacagctgggaggactcgaaggacggcgtgggttttccctgg

SEQ ID NO: 83471 - DNA, 101 bp, Homo sapiens
  chr19:39283060-39283161
  hyper
cgccctccgctctccccgacggcccggaccccggtcctagccctggtcactgtgacgggaggggaagcggacgccaagtgcagccccggccccagtgtgac

SEQ ID NO: 83472 - DNA, 62 bp, Homo sapiens
  chr19:39305867-39305929
  hypo
tttgctcactccctccgccccggaattccttgtgcccctcgcctgcccgctgccagtctgaa

SEQ ID NO: 83473 - DNA, 67 bp, Homo sapiens
  chr19:39329572-39329639
  hypo
aggtgggtaatggcccggtctacagcgtagccatcagccatctccaccatggcggcccccggcttgc

SEQ ID NO: 83474 - DNA, 304 bp, Homo sapiens
  chr19:39329947-39330251
  hypo
tctgttacacacagacgtgtgtgatctatggatggctgtgtctacagtcacaaggtaaaatactccttcagctgggttacaacagagcagtgccggctctggagccaggcagtctggctctgagtcctgcttcacataaaggctatgtgaacctgggcgcgttatttaagccccgtcctccacttcccctgtccatctcattaaggattaatgtgagaaattacacaggtcactacatgtaaagcatctttaacagtgcctggtaactaacaacacttcacctgtgttacgaactactctaagt

SEQ ID NO: 83475 - DNA, 162 bp, Homo sapiens
  chr19:3933098-3933260
  hyper
ccttggccctgacctcgttggaaaacgaagctccccgcagggtcccggcctctagggctgctgtgcgggcgggggtgggtgagttcgcttccttgacgccacgagaaccagtcttaatgtcagggtcaggccataggacacagagagcgggatatttttagg

SEQ ID NO: 83476 - DNA, 318 bp, Homo sapiens
  chr19:3933461-3933779
  hyper
gctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggagggtgagcgccgggggacctggtgggcggccctgcggggcaaagccccctgtgcgcgcagagggggaggcccgggaatgaatggag

SEQ ID NO: 83477 - DNA, 182 bp, Homo sapiens
  chr19:3936566-3936748
  hypo
ccccagcatgaccaacggcggcaagaccacgctgaccaacagcctgctcagagccctgcccaactgctgcgtgatccatcaggatgacttcttcaaggtgcccgcccttgcccggggaggtggagctgagaggggatgcagggtgggcagccaggcccggccagccccgccctccactgccc

SEQ ID NO: 83478 - DNA, 19 bp, Homo sapiens
  chr19:39393000-39393019
  hypo
cgcccggcctcattttatt

SEQ ID NO: 83479 - DNA, 68 bp, Homo sapiens
  chr19:39452631-39452699
  hypo
ttttctataatttcacgtaaatggaatcatatagagtgtcggctatcaacctacgacctcattgttct

SEQ ID NO: 83480 - DNA, 426 bp, Homo sapiens
  chr19:39466136-39466562
  hyper
gaatccttcccggggcgccccagctgtgggcgagaacgggactgacgcttgggtcccgacctgggtcccctacctgtcccggcgctcacctggcgggctgctcggaggcggcagcggcgggctaagcttccctttcccactttgttctgggaggcagtcgaggggctccccgtgatcggcgtggcccagggggccccgggaccggcggtctgggcggtcggtcctctcccggggcgtggcggctgcagcccggcgccgggggcggcgactctgagatccagcgggcgggggcgggaggccgcccctcctccggctgcggggcccagcgggagcgagggcgggcgggcgggggagcttggagggctgcgtgcagcgagggggaggcccagttgccgcgaggccagcggggagcggggccagccccgc

SEQ ID NO: 83481 - DNA, 59 bp, Homo sapiens
  chr19:3946634-3946693
  hypo
accacagtgacaaaccgaggcaggccccgacccacaggccagcccgatgggcacagtga

SEQ ID NO: 83482 - DNA, 542 bp, Homo sapiens
  chr19:39522477-39523019
  hyper
ctggacttcctcttccgagatcccaccttggccgcaggggttgcgaataaggttgcgtccgatgggtctgcgcgcgcagaagcggcccagggggcaaggcctggcgttacgggcgggagactggcagctgcgggcgaggtgcagcagcgcgcggccggtggcgccgtggtcgcgggccaggatcagcagccacagggcctggccgtccaccagggctcgccagccccggcacacttggcggcagcgcccgagcagcgtgcgcggggggacgtggctcagcaccaccagaagcagctctgggggtagttggctcaggtccagcgcctcttcgggttccggctccggcgcggggacccgggcggcccggcccctggagaccgaggcgcccatggtccccccgccaggcccggctgtggctgcgggagaggaagggtcaaggcgtcagggaccagcagcctccgcggcgcgcagcctctgcctgccctgattctgccagccgcacccccgtcttcaccatccctgggccccgtccccaagtcccc

SEQ ID NO: 83483 - DNA, 30 bp, Homo sapiens; identical to SEQ ID NO: 45880
  chr19:39524876-39524906
  hypo

SEQ ID NO: 83484 - DNA, 30 bp, Homo sapiens
  chr19:39568177-39568207
  hypo
gacctgtaggtcacacgacaaggtgcttag

SEQ ID NO: 83485 - DNA, 15 bp, Homo sapiens
  chr19:39574790-39574805
  hyper
ctgggtcccccttcc

SEQ ID NO: 83486 - DNA, 167 bp, Homo sapiens
  chr19:39574877-39575044
  hyper
cggggccctggctgtctagggaggctgtcaccccgaggcgaccggctcttccggggctgggacggctgtaggcggcaagaggcctcggcacccgcgaactcataaataccggggcggcgctggtggcgggagaggcgcgtgcgggcagccggcgcccccgagggtga

SEQ ID NO: 83487 - DNA, 162 bp, Homo sapiens
  chr19:39589679-39589841
  hyper
cgtctggctgtgtttggagacctgggggctgacaacccgaaggccgtcccccggctgcgcagggacacccagcagggcatgtatgacgccgttctccatgtgggtgaggcatccgcaggggcgcgcgcagggacggtggggggcgcgcgcagggatggtggg

SEQ ID NO: 83488 - DNA, 114 bp, Homo sapiens
  chr19:39597642-39597756
  hypo
gcgtgtgaaggagtacgggtatacgcggctgcacatcctcaacgggacccacatccacatccagcaggtgtcggacgaccaggtcagtgaggggcaggccgaagtcacctgact

SEQ ID NO: 83489 - DNA, 143 bp, Homo sapiens
  chr19:39626780-39626923
  hypo
gttacccttcttcctcgtggccccctagttcaagccaccctcatctccctcctggaccattgaggcgtgctccctgctcccttctcccccactgtccccacagttgtccgcacacagccagaggtagccgtgcacacctggtc

SEQ ID NO: 83490 - DNA, 30 bp, Homo sapiens
  chr19:39645862-39645892
  hypo
tagggtgtcaactcccgtgggcaggaagtt

SEQ ID NO: 83491 - DNA, 94 bp, Homo sapiens; identical to SEQ ID NO: 45881
  chr19:39646149-39646243
  hypo

SEQ ID NO: 83492 - DNA, 75 bp, Homo sapiens
  chr19:39672388-39672463
  hypo
agctgaggcactccacgggaatgaatgactctcgacaggtgccggaggtgaggaggggcccggaggcccaggagg

SEQ ID NO: 83493 - DNA, 30 bp, Homo sapiens
  chr19:39678735-39678765
  hypo
aagaagggtgtgtgccgtatgacaaggtga

SEQ ID NO: 83494 - DNA, 65 bp, Homo sapiens
  chr19:39687582-39687647
  hyper
ccagccctgtgaaaccgggacagtcgcgcagcctcgagggatggaggaggtgcgtgagggacacg

SEQ ID NO: 83495 - DNA, 222 bp, Homo sapiens; identical to SEQ ID NO: 37508
  chr19:39687755-39687977
  hyper

SEQ ID NO: 83496 - DNA, 44 bp, Homo sapiens
  chr19:39690983-39691027
  hypo
aggttcgaggacagccggctggatgcgtgcgtctatgagctgca

SEQ ID NO: 83497 - DNA, 86 bp, Homo sapiens
  chr19:3972561-3972647
  hypo
gcctctcaaagtgctgcgattacagacgtgagccacaagccggcctttatattttttatttacattttcaacgtacaatgggttgg

SEQ ID NO: 83498 - DNA, 359 bp, Homo sapiens; identical to SEQ ID NO: 37509
  chr19:39754874-39755233
  hyper

SEQ ID NO: 83499 - DNA, 401 bp, Homo sapiens
  chr19:39755264-39755665
  hyper
cgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagtacccatccacgtccaggaatcccagactgtgcagaggttaggggccctggcgagggggcccagtcgtatgcgataagcgccgcttgtcccgcaggcggaagaggcgctgagttggaggtcgcgcaactgctccgtccgccccaggagggatcctc

SEQ ID NO: 83500 - DNA, 30 bp, Homo sapiens
  chr19:3976461-3976491
  hypo
acagtctccaggtgtcgtctgagaattcga

SEQ ID NO: 83501 - DNA, 30 bp, Homo sapiens
  chr19:3979506-3979536
  hypo
tttagctagggaccccgccagaacaagatt

SEQ ID NO: 83502 - DNA, 30 bp, Homo sapiens
  chr19:39800520-39800550
  hypo
gggggccagattgcccgggtttgagtctct

SEQ ID NO: 83503 - DNA, 140 bp, Homo sapiens
  chr19:39811228-39811368
  hyper
ccgggctcgacaccccgcgcacacccgatggccacacgggcagggcgccgcacacgccggcaccgggcacacatagggccgcgcgggcgcacgccgggcccgccgcagcgccacggacacacactcgcacgctcgcacgc

SEQ ID NO: 83504 - DNA, 30 bp, Homo sapiens; identical to SEQ ID NO: 45883
  chr19:39815860-39815890
  hypo

SEQ ID NO: 83505 - DNA, 347 bp, Homo sapiens
  chr19:39816895-39817242
  hypo
aagcaatgcccattccggccctttcaaggttaggaagtcccccaagtctagggcaccgactcaaaacttagggagcttggatctgtgggcgtttataggataggttggtggaactagaggaggcggtccccagtttgtactgcctctccagggaatctccccaaacccgaagacacgtcccattgtgctgactcctcattggatagtgcagtctgttctggcctctctgattggtccttccacaatccctagctgtactccctctgcattggactgcgcctgtgagccaccctttctgattggcccctgctttcccatgctttgctcctgatcgggcaagtccttgt

SEQ ID NO: 83506 - DNA, 44 bp, Homo sapiens
  chr19:3981879-3981923
  hypo
cggagcccacagggccgagggccaatagtcgcatcggcggggtg

SEQ ID NO: 83507 - DNA, 30 bp, Homo sapiens
  chr19:3982143-3982173
  hypo
ggtgggcttgagccacgctgtgaatagcac

SEQ ID NO: 83508 - DNA, 30 bp, Homo sapiens
  chr19:39823715-39823745
  hypo
cctgggctgtctctccggcaactccatttt

SEQ ID NO: 83509 - DNA, 362 bp, Homo sapiens
  chr19:3982733-3983095
  hypo
aactccactccccaccggctcctgcagatcccgctgcggcaagcccaccacccagctagggagggccgtaccatgatgttgcccatggggccgctctcgccctcgccgtaggtggagatgatgacgttcacgttctccacgatgcgctggaaagtctggtagagctcctcgggctccagctgcagctccagcagggcgcggtccatcttgttcatcatcagcacaggcttgatgcgctcggcaatggcctgccgcagcactgtctccgtctgcacgcacacgcctggggacacgggggacagggcggcgctgtcatcctcaagcaaggatggcccccggttccaggccgtgcctcaggggga

SEQ ID NO: 83510 - DNA, 415 bp, Homo sapiens; identical to SEQ ID NO: 37511
  chr19:39989727-39990142
  hyper

SEQ ID NO: 83511 - DNA, 25 bp, Homo sapiens
  chr19:39992813-39992838
  hypo
gagactccgtcgcaaaaaacaaaca

SEQ ID NO: 83512 - DNA, 283 bp, Homo sapiens
  chr19:39993374-39993657
  hyper
agaatgcggccggggcgctccgtatgcatccatgttcggccgggcccaccccagcacccctcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactg

SEQ ID NO: 83513 - DNA, 44 bp, Homo sapiens
  chr19:39993711-39993755
  hyper
cgaccccaccccgtcccagccggggaccccggcccctcctgagc

SEQ ID NO: 83514 - DNA, 22 bp, Homo sapiens
  chr19:39996552-39996574
  hypo
ctaaaagattaaatgcggcccg

SEQ ID NO: 83515 - DNA, 45 bp, Homo sapiens; identical to SEQ ID NO: 37513
  chr19:39997688-39997733
  hyper

SEQ ID NO: 83516 - DNA, 393 bp, Homo sapiens
  chr19:39997748-39998141
  hyper
cgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtgg

SEQ ID NO: 83517 - DNA, 510 bp, Homo sapiens
  chr19:40005651-40006161
  hyper
cgggggttaagggggcgggaattactcggcgaggtcgggaggtcgcgcggtggaacccgggggccaggtggaactcggtgtaacagagcccccagtggtcgcgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtc

SEQ ID NO: 83518 - DNA, 262 bp, Homo sapiens
  chr19:40006186-40006448
  hyper
cggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggc

SEQ ID NO: 83519 - DNA, 328 bp, Homo sapiens
  chr19:40006498-40006826
  hyper
cggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactggtgaggacctcacacatgcctctcccaacccccggggacagggccggcagtgggggctgggtctccggggacgtggaggtcagggttggggtagggcgaggggagggattcaggaagagccccagagttccagttcccagattggaaacccgctcttgtctctca

SEQ ID NO: 83520 - DNA, 118 bp, Homo sapiens; identical to SEQ ID NO: 45479
  chr19:400972-401090
  hypo

SEQ ID NO: 83521 - DNA, 200 bp, Homo sapiens
  chr19:40097695-40097895
  hypo
caaataggcacaaaacgtcatctgtaaacataagtgtatctaatacgttaacttgtataactaggaattttcttggggaatgttatttgtaccaggacagagtggagaggaggccgaaaacttgtttggtggcatgctttctttctgatgcatttttcctcttgtagataaaggtcaatggcatacgcatttacggcttt

SEQ ID NO: 83522 - DNA, 30 bp, Homo sapiens
  chr19:4010876-4010906
  hypo
tgggcagggctgggccgcctgcacgtgtgt

SEQ ID NO: 83523 - DNA, 52 bp, Homo sapiens
  chr19:401481-401533
  hypo
gcagcagggctcagccggtgaccaggactgggtgccacgggtgctgggtccg

SEQ ID NO: 83524 - DNA, 189 bp, Homo sapiens; identical to SEQ ID NO: 16507
  chr19:40218707-40218896
  hypo

SEQ ID NO: 83525 - DNA, 34 bp, Homo sapiens
  chr19:40286084-40286118
  hypo
aattaaaatgtggcccgggcgcggtggctcacgc

SEQ ID NO: 83526 - DNA, 764 bp, Homo sapiens
  chr19:40324254-40325018
  hyper
tgggcctgctgagaccggaaggcggggcccgactgagcttggcaatcggcacctgccatggcaacaactgtaccattggtcgctggtgccaagagctcagccaatcacagcctagggcagctgttgctaggcgacgaagaagcggcccgcggagctgagcccaaacaaagggcgggagtggggcccggctaccccctcccagcctccctcctgcaactgcttcctcgggcttggccggttccaggaattcaactatgaatagccaggcagggcccgcacctgcctgccacccccctcctctcctcccttggcctcgtgctaagtctcacggcgacgggagcagggcggatcccgtcctgcccacctccctgcgaccgcttgccgccccacccgtccccgcgccgttacctgaaggagcgggcaaggggactcaaactgctcggggagcccgagctcagacctgcccactggctgagggtatccggcggacgcggcaagccagggccccgattacccagtaatgcaaccagcaaaatggcgaccacaacaaaccggcccccccacgccctggactccgcccccatccctccctctccgctcccctcacgtgacccacactgacactccgcctgcgcgagatggccgcttacctgcacgcatgcgcagcgagctaccaatcccacccaagaaccgaaatccaggctgccgctgcgcaaaggcagctagaaacggagcatgcgctctgtgaccgagtgagaatttac

SEQ ID NO: 83527 - DNA, 442 bp, Homo sapiens; identical to SEQ ID NO: 45481
  chr19:403367-403809
  hypo

SEQ ID NO: 83528 - DNA, 30 bp, Homo sapiens
  chr19:40430529-40430559
  hypo
gacagcggtggactccgccacacacccggc

SEQ ID NO: 83529 - DNA, 108 bp, Homo sapiens
  chr19:4043222-4043330
  hypo
caagccccccatccccgctccccagcctcccccgaacaaaacacagagaacatcaaatgaggcgactgaggcggcagcggtcgtaacaggctgcgtttagtggttctt

SEQ ID NO: 83530 - DNA, 30 bp, Homo sapiens
  chr19:4044591-4044621
  hypo
gctctcttgcacacacgcacacacgcgtcc

SEQ ID NO: 83531 - DNA, 30 bp, Homo sapiens
  chr19:4044972-4045002
  hypo
gggctgggggggtcccggctctgggcccat

SEQ ID NO: 83532 - DNA, 30 bp, Homo sapiens
  chr19:40449764-40449794
  hypo
ctgaaggggctgatacggctctgggctagt

SEQ ID NO: 83533 - DNA, 55 bp, Homo sapiens
  chr19:40503231-40503286
  hyper
gtatgtgtgtgtgtgcgcgcgacggggcgcctgtcaggaccgggttgggcgggtg

SEQ ID NO: 83534 - DNA, 30 bp, Homo sapiens
  chr19:4050407-4050437
  hypo
ttggattgtgagccccgagaaggcaggggt

SEQ ID NO: 83535 - DNA, 206 bp, Homo sapiens; identical to SEQ ID NO: 45623
  chr19:4053834-4054040
  hypo

SEQ ID NO: 83536 - DNA, 75 bp, Homo sapiens
  chr19:4054305-4054380
  hypo
gcccgtccccgtcctcgccctcggccgctcccgacaggaagcccggagagtcgcccggctcgggggccgcctccg

SEQ ID NO: 83537 - DNA, 276 bp, Homo sapiens
  chr19:4054641-4054917
  hypo
catccaggtcatcatcggacgccccaaaggcggaccacgggaagctggcagcggcggcggcggccgcggggggcaggctgttcatggggttgctctggaagaactcgaggtactccttggcgcggaggaggttgcgctgatcaatttgatctacaaggtccagctgcccggcgtcggcgcccgcgtcggccgccaggatctgccggtccaggaggtcggcgcacacgtggctcacggcggggatctccagcaggcgggcggcgctgaggatgtcac

SEQ ID NO: 83538 - DNA, 47 bp, Homo sapiens
  chr19:40561332-40561379
  hyper
agtgtgcaacaataacgctctcatcctcctctcggtccttcttttgg

SEQ ID NO: 83539 - DNA, 708 bp, Homo sapiens
  chr19:407124-407832
  hypo
gcagctccttctccccgagcagcgtgtcccgcttgaggctgctgcccttgttcaccaccttgatcctgagggccagtttccggacgctggcgggccccaggccgtcgaagaagaaatcctcgttgaagacggggcggcggctgttcttcacgatggtgctgcgctgcttctgcagcttgcccggcaccaggcacaggcccacgcagcagttgatgctgcgggcgtcgcacaggcggtcgtagaggccctcggcggccagcaggtgcacccgcaggcgggcctggccggcctcgtactcggccagcagccgcacgctgccccgagggcccacgtggaccgtgtgctccccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcaccttggcctggctgtcctgggcgaaacctttgagcagagacacggagcgggacagcagaggggacccgaagggggaggactcggccgaggaccctgtgtcgctctccccgccactgaagtagcggccggggctcatgagggccccgccagcctccctggggcccccatcacccccgttggccttggcagctgcccggcggcgcccggcccctggggagc

SEQ ID NO: 83540 - DNA, 36 bp, Homo sapiens
  chr19:40723089-40723125
  hyper
tcacctgtgggttcccggctgcgggcctcctgcagg

SEQ ID NO: 83541 - DNA, 117 bp, Homo sapiens
  chr19:40723426-40723543
  hyper
caggcgcaactgcgccgctgctagggggcgccaaaacacggacaggcgccactgggcgatccacccagagctgtcggtgggcaagagcactaaggccccgcgcgggggcgagggccg

SEQ ID NO: 83542 - DNA, 599 bp, Homo sapiens
  chr19:40723835-40724434
  hyper
catccccccaccccccgacggcgtacccgtgagggagtcgtaacactccacctccgtgctctccaccaggcgccgctgctcctcgctgaggcgcgccggcccggggctgctggtgggcccgggggcgggggcgggcaggccgctagggcgggccccctgcgccgccttcagctgcagcagcgctcggtggtacttgccgatggcctcccggaacttcttctctcgatagcagcgctggccctctgccttgaacgccacggcggcacgcaggctgctgtcgagcgccgcgcccaggctccccgacggctctggggtaggaccgggacgagccgagccatggcgggagcccgagcctgggcccgagcccggtggggagagggcgggaggcgggcgcggcggaggctccggggcagcgctgagcatcagcaccggggacagcgcgccgcgctgcattgtgggaaactcctgccgccgccgctgcagctaccgcatcgccccccgcggggctggtccccaccctttctccgccccctcacctccggcagccgactccggctgccccctatgggtctagggaaacccctcgagacttcccccat

SEQ ID NO: 83543 - DNA, 15 bp, Homo sapiens
  chr19:40732289-40732304
  hyper
cggcgaagatgtccc

SEQ ID NO: 83544 - DNA, 81 bp, Homo sapiens; identical to SEQ ID NO: 37148
  chr19:4077899-4077980
  hyper

SEQ ID NO: 83545 - DNA, 170 bp, Homo sapiens
  chr19:40829862-40830032
  hypo
gggaagacaacagctcgcacgcccagaatcgctcccccatccccactcactttactccctgtcgtggtgtctgccttggtctcggcgccgaggcggtcaaacacagacgtcctatggagacctgggagggaagtgaagccatcagggagaggccccggtgggccaggcct

SEQ ID NO: 83546 - DNA, 30 bp, Homo sapiens
  chr19:4086323-4086353
  hypo
gggaaatgtacatttcgtctggggtgcaat

SEQ ID NO: 83547 - DNA, 343 bp, Homo sapiens
  chr19:40889677-40890020
  hypo
cttttcccttaccttcgtctcggccaggtagtcagccgaggacttgagctgccaggggttggcagcgtcagggtgggggttgcgcttgaagaagtggtgggccttgcaggcggcgtgcaacaggtgtggcttgggcaggccctgggtttcgcagatgtagcgcacctggtcgtactcgttgttgccggggtagagaggccagcccaggtgcagctcagccatgacgcagcccagggaccacacgtccaccttctcgcagaagggcagccccagcaggatctcaggggcccggtagaagcgcgactggatgtatggctccttcacgtagcgcacctcgctgaaa

SEQ ID NO: 83548 - DNA, 30 bp, Homo sapiens
  chr19:40900239-40900269
  hypo
tggctgaagcccactcggggcagcctgagt

SEQ ID NO: 83549 - DNA, 30 bp, Homo sapiens; identical to SEQ ID NO: 45889
  chr19:40901793-40901823
  hypo

SEQ ID NO: 83550 - DNA, 432 bp, Homo sapiens
  chr19:40902263-40902695
  hypo
catctctgggactttcgggagctgcacttccgggaggtgcacatcgggcacagccatctcgggcaccttcgggagtttcacctcagggagtttcatctcagggagcttcatctctgggacttttggaagctgcacttctgggaggtgcacatcgggcacggccatctcgggcaccttcgggagttgcacttcagggagtttcatctcaggaagtttcatctcaggcacctttggaagcttcatctcagggactttcatctctggcactttcggcagctgcacctctggaagccgcacctctggcacagccacctctgacacctctgggagtttcatctctgacactttcggcagctgtacctctggaagccgcacctccggcacagccatctctggcacctttgggagtttcatctccgacactttcagcag

SEQ ID NO: 83551 - DNA, 20 bp, Homo sapiens
  chr19:40908670-40908690
  hypo
gactccgtctcaaaaaaaaa

SEQ ID NO: 83552 - DNA, 95 bp, Homo sapiens
  chr19:40926574-40926669
  hypo
ctaaaaaaaaaaaaaaaagaaaaagaaaagaaagaaacaggcccgcagagtgttgtaaacagagggcgttcatgatccctcgaccactggacaga

SEQ ID NO: 83553 - DNA, 22 bp, Homo sapiens
  chr19:40951175-40951197
  hypo
aatattattttttgccgggcgc

SEQ ID NO: 83554 - DNA, 221 bp, Homo sapiens
  chr19:40951614-40951835
  hypo
aggtttcctcctctccgaagccctccctggcagtccaggttgggttaggatccattctaggattccatggcctcctgtgccgccatcccagtcctggactgtcagttactatatggactgaggaacgccccgccgagggcaggtaccaaggatatctctgtcaaccacctcttggtctgcaggatcacctagcacagggctggacacgtagcaggtcccag

SEQ ID NO: 83555 - DNA, 109 bp, Homo sapiens
  chr19:4096416-4096525
  hypo
cccagggaggtggcccggcctggtcacgtggccaacaggaccttggggtgcagtcctgtgcctccctgacagctgcaggcctggaaggaggccgcgtccctccttgtgc

SEQ ID NO: 83556 - DNA, 406 bp, Homo sapiens
  chr19:40972742-40973148
  hyper
ggacgccgcgtgtgacggcgtgagggtgtgaccccgtgagaccccacaggagggagtgacggcgcgcaagcgcgtggatgcgggggtgagtttgtgcgccgaggcccccgcgagtatggcagcgtggcgagcgtgaccccgtgggagtgtgcagcgcgtgacgccgccgtgccctcgcgagtgcagccgtgcaccccacgccgcggccgggtgtgactgcgcgtgggcctcgggcggcggggcgcggggaccgcgggcgggagggggtcccgggggcgcgctgagcgcggcggcggcgcgagagagggaggcgcggcggcgcatgcggatctggctgagccgcgggccggcggggccgagctgagccgggctgggccgggccgggccgggccgggcagcggacgcc

SEQ ID NO: 83557 - DNA, 70 bp, Homo sapiens
  chr19:41008366-41008436
  hypo
cgcctctttgtgcctcgggagggctgtggcatctgggatattgacaaggtgaggccggggatgcagggga

SEQ ID NO: 83558 - DNA, 30 bp, Homo sapiens
  chr19:41009824-41009854
  hypo
gggtgcagggtgtggcggagctggcccagg

SEQ ID NO: 83559 - DNA, 531 bp, Homo sapiens
  chr19:41018532-41019063
  hyper
caggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggctt

SEQ ID NO: 83560 - DNA, 83 bp, Homo sapiens
  chr19:41019075-41019158
  hyper
cgcctggcagccgccggtgacttcggccacgacgaagcttccagccgccgcctggcgcgccagcaccgcgcgctcaccgggga

SEQ ID NO: 83561 - DNA, 536 bp, Homo sapiens
  chr19:41025379-41025915
  hyper
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactag

SEQ ID NO: 83562 - DNA, 30 bp, Homo sapiens
  chr19:41028694-41028724
  hypo
aacaagtcaatgcatcgctaatattgccag

SEQ ID NO: 83563 - DNA, 311 bp, Homo sapiens
  chr19:41055109-41055420
  hyper
gtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggtgaggccagcgcaggggcctggggcggggcggggcggggcggtggggcggagaaggtgggcatggggcggggctgaagatggagacggctgagaccctcc

SEQ ID NO: 83564 - DNA, 444 bp, Homo sapiens; identical to SEQ ID NO: 37525
  chr19:41059909-41060353
  hyper

SEQ ID NO: 83565 - DNA, 113 bp, Homo sapiens
  chr19:41062945-41063058
  hypo
ctcagagtttgccagcgagacaggtatggcagggcgggaacggctggcagctgtgaaccagatggtggatgagctgatcgagtgtggccatacagcagcggccaccatggccg

SEQ ID NO: 83566 - DNA, 340 bp, Homo sapiens
  chr19:41073518-41073858
  hyper
cccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggc

SEQ ID NO: 83567 - DNA, 195 bp, Homo sapiens
  chr19:41074018-41074213
  hyper
cggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccaga

SEQ ID NO: 83568 - DNA, 221 bp, Homo sapiens
  chr19:41102775-41102996
  hyper
ccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggc

SEQ ID NO: 83569 - DNA, 16 bp, Homo sapiens
  chr19:41105986-41106002
  hyper
agagctctactgaagc

SEQ ID NO: 83570 - DNA, 69 bp, Homo sapiens; identical to SEQ ID NO: 37530
  chr19:41106351-41106420
  hyper

SEQ ID NO: 83571 - DNA, 290 bp, Homo sapiens
  chr19:41115521-41115811
  hyper
tgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccac

SEQ ID NO: 83572 - DNA, 100 bp, Homo sapiens
  chr19:41119177-41119277
  hyper
gaggcgggaccaaggcgctgtgggaggagcttagaaacctggcattggtgggggcggggttactgcgatgtgggcggagcttgtctgggaggccgggtcc

SEQ ID NO: 83573 - DNA, 39 bp, Homo sapiens; identical to SEQ ID NO: 37531
  chr19:41119370-41119409
  hyper

SEQ ID NO: 83574 - DNA, 66 bp, Homo sapiens
  chr19:41119669-41119735
  hyper
ggggggcggtgtttgcagggagggaagtagcgtgaggcaggttggggaaggcgtgagaggcctagg

SEQ ID NO: 83575 - DNA, 391 bp, Homo sapiens
  chr19:41198090-41198481
  hypo
gcccctgccagcttgcggtgcagggcataggtctcctcgggtgggggacacagccggtgccgcagcagcaccgggatgaggtcctgtatgcggcgggccgtttcccccgacccaaagtcataagggccctgggtggcgaaaggctcccccaggatcatcactgcctccacgtgggcgtcggagaatgcctgggagtgggggtggggggagagcaaaggcagccagtgtggacatagagccctctgcataacccagaaacaacgtgtagcctccactccctccagtctccaccatcaacacaagccccgactcccccaagagtgagcagcttccactccttccagagcctggactagacaagcagctgcctattccccgagtaagcacccct

SEQ ID NO: 83576 - DNA, 39 bp, Homo sapiens
  chr19:41245584-41245623
  hypo
gtgtcatgtgccacacgagaccaacgtggaaaagtctga

SEQ ID NO: 83577 - DNA, 45 bp, Homo sapiens
  chr19:4131483-4131528
  hypo
aagaaaagaaaaaggcgggctgggcgcggtggctcacgcctgtaa

SEQ ID NO: 83578 - DNA, 51 bp, Homo sapiens
  chr19:413211-413262
  hypo
gcaccagctgattcccggggcatcctggcccctccacggcaccagctgatt

SEQ ID NO: 83579 - DNA, 59 bp, Homo sapiens; identical to SEQ ID NO: 13408
  chr19:41354396-41354455
  hyper

SEQ ID NO: 83580 - DNA, 260 bp, Homo sapiens
  chr19:41354575-41354835
  hyper
cgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacg

SEQ ID NO: 83581 - DNA, 30 bp, Homo sapiens
  chr19:41381504-41381534
  hyper
ccccattcttatacccgcctcttccgcgaa

SEQ ID NO: 83582 - DNA, 30 bp, Homo sapiens
  chr19:41416060-41416090
  hypo
tggatgacttggctccgtgtatgacacgga

SEQ ID NO: 83583 - DNA, 54 bp, Homo sapiens
  chr19:41595988-41596042
  hyper
ccggcgcttctccatcgccaccctaaggggttttggcgtgggcaagcgcggcat

SEQ ID NO: 83584 - DNA, 75 bp, Homo sapiens; identical to SEQ ID NO: 37535
  chr19:41596078-41596153
  hyper

SEQ ID NO: 83585 - DNA, 30 bp, Homo sapiens; identical to SEQ ID NO: 45895
  chr19:41615907-41615937
  hypo

SEQ ID NO: 83586 - DNA, 80 bp, Homo sapiens
  chr19:4163466-4163546
  hypo
gtgtgttggttatttcgagccctgctgccaagggagattctgtggtggcaggagtgatagtttttgttgttgctgttttg

SEQ ID NO: 83587 - DNA, 254 bp, Homo sapiens
  chr19:41641726-41641980
  hyper
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgtccccaccacaggaatcttgttttctaaccggccgtgctggtggacactgcgcaattttgcacttggagcgccgaagaagtt

SEQ ID NO: 83588 - DNA, 15 bp, Homo sapiens
  chr19:41642001-41642016
  hyper
cgaggcgcgtgtcct

SEQ ID NO: 83589 - DNA, 168 bp, Homo sapiens
  chr19:41673489-41673657
  hypo
gcctcggtttcctcacgtgtaaaatgggaattaactaaggcaatgcctctcaaacacttggcacagcccctggcatggcatacagtccatgccattgctgttgagtttgtaatgattatatataattaagtctgtgctgacaatacgtagctacgtaggaccaagcat

SEQ ID NO: 83590 - DNA, 30 bp, Homo sapiens
  chr19:41681188-41681218
  hypo
cagtcacataaaagacgcagtggggtgctc

SEQ ID NO: 83591 - DNA, 23 bp, Homo sapiens
  chr19:41694633-41694656
  hypo
accacgcccggcaagaactttta

SEQ ID NO: 83592 - DNA, 95 bp, Homo sapiens
  chr19:41699111-41699206
  hyper
cctaactagcccagccgcgcggagcgcctgggagaggagaaggagccgacctgccgagatggaggcgaccggcacctgggcgctgctgctggcgc

SEQ ID NO: 83593 - DNA, 30 bp, Homo sapiens
  chr19:41732411-41732441
  hyper
ctaccctcccctttccggcctctgcagact

SEQ ID NO: 83594 - DNA, 65 bp, Homo sapiens
  chr19:41854198-41854263
  hypo
cctggtacagctccacgtgctgctccacttttaacttgagcctcagcagacgcagctctgcccgg

SEQ ID NO: 83595 - DNA, 16 bp, Homo sapiens
  chr19:41881147-41881163
  hypo
gcatgcaagtgagccc

SEQ ID NO: 83596 - DNA, 120 bp, Homo sapiens
  chr19:41881463-41881583
  hypo
tgagccactgcgcccggcccgtgagcccgtttctttatctgcaaaacagggattaaaaacaagccaacaccccttcagcactcctccgcaaaaaaacaccccaaaacaaaataggccagg

SEQ ID NO: 83597 - DNA, 93 bp, Homo sapiens
  chr19:41927388-41927481
  hypo
caggtgtgagcctggcgtgtttgaggagctgggaggagcccagaggggcaggtgtggagtgagcaggtgtggagtgagcgggtgtagggtgag

SEQ ID NO: 83598 - DNA, 25 bp, Homo sapiens
  chr19:41947444-41947469
  hypo
tcttgctgtgcggcccagttcctag

SEQ ID NO: 83599 - DNA, 104 bp, Homo sapiens
  chr19:41956235-41956339
  hypo
gtgaccctgaacatacggtatctgggagccagcagttcccctcctgggcatatactaaagagaaaaagagaaacacgtgtaggcgctcaccaaagacacctact

SEQ ID NO: 83600 - DNA, 206 bp, Homo sapiens
  chr19:4197993-4198199
  hyper
gtgaatgaatgaaagtgtgagtggcgagagccctgccggccgcgtggaggtgcgaggctgcggacgtcgcgggcccggaggcacctgcgcgcccttggccgactcggaggaggtggagatggacgcccgcgggtcccctggagatgcagccggcggcctgcgctggtgagggagccgggcccccggcgccgcgtcctcctcatcct

SEQ ID NO: 83601 - DNA, 470 bp, Homo sapiens
  chr19:42028283-42028753
  hyper
tctaaaacaaaccaacgaggctgccaacctgtgagatagttggtccacttgtacaaaaccccctccatgcttcagagccccacaccgctcatcctcccggcccggcgccggccgcggtgatggggtaggcgcggggcctggggcagcctttcccggcccgcccgggccccctccgccggcacgaagccgctttctgcctgcgcgcgccgcagggacgtggcggcccttagaggccgggacagcgggcgcagcgtggagcttgggggccgcgaggcgcgggctcagacatccccgggtaagcctcggcggcggcggccgcgacaacggcaaaaatgcgactgcgaccgcgaccggtctcgtgctcgcgcttccgcggcccggctgctccctccggcgccccggcgctgcctcttcctcgcctgccttccttccccctgggctccccgtttgtttttcgaccttcctttata

SEQ ID NO: 83602 - DNA, 86 bp, Homo sapiens
  chr19:42069045-42069131
  hypo
gaacataattttgaccgaaaaaaaaagcaagtatttgaaaattcagtatttcttttttctttttttttttggagacagagtctggc

SEQ ID NO: 83603 - DNA, 197 bp, Homo sapiens
  chr19:4212352-4212549
  hypo
tgctgaatagttgcacgtggaatgcgtgaatgtgcatggaatggaggctatgaagcaggaggtggggcagggaggcctcttgcccagatccaaacccctgtccctgtttctcccgtcagtccccggaggccagctccctgcacatcctggagagacaggtaggtgggaaggtggggaggagccggtcctcctgctgc

SEQ ID NO: 83604 - DNA, 30 bp, Homo sapiens
  chr19:42195459-42195489
  hyper
ggggaggtgccaggccgggagggactctgc

SEQ ID NO: 83605 - DNA, 22 bp, Homo sapiens
  chr19:42202343-42202365
  hypo
ttcattttacttcaccggaaaa

SEQ ID NO: 83606 - DNA, 30 bp, Homo sapiens
  chr19:42257218-42257248
  hyper
tggaatttctaaagtcgctcctaaagcact

SEQ ID NO: 83607 - DNA, 30 bp, Homo sapiens
  chr19:422922-422952
  hypo
aacaatgccaacatccgacaggccactcta

SEQ ID NO: 83608 - DNA, 30 bp, Homo sapiens
  chr19:42297369-42297399
  hyper
ttctcaaaataaaatcgaatcttattttat

SEQ ID NO: 83609 - DNA, 155 bp, Homo sapiens
  chr19:42348878-42349033
  hypo
cggagggagaggcagcggtggcgcgaggctcaactcgaagcgctattggtgggactgatagtcttgtgcgccaagaagctggcagaagggaaggggcgggacatcagttcaggatctcaaaccgcattggtcgtctgcctcggctgagagaggcg

SEQ ID NO: 83610 - DNA, 141 bp, Homo sapiens
  chr19:42349292-42349433
  hypo
tccccttccctgcctcgcgggccccttggcgcgttcccggttccccactcgctccctggggcacgggaaggggggagggggacatgcatgaaattaattgttggtagtggccacaggagcaggaagcgctggacacagtga

SEQ ID NO: 83611 - DNA, 154 bp, Homo sapiens; identical to SEQ ID NO: 45900
  chr19:42373753-42373907
  hypo

SEQ ID NO: 83612 - DNA, 757 bp, Homo sapiens
  chr19:42408203-42408960
  hypo
gaagaaattggtccacgagggcccactgacgtggcgggtgactaaggacaaggcagtgggtgagtgccagagcagctgcctagtgcagggtgttggggcagtgagccaagggcggggagggggtcgcgcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctagagggtttataagtgaggtaggaactgctgcaggtgtttgcacagaggcgtgtcttgtgtaaacaaggagaagaaaggccaggagtccagtgaggagggatttgtaaacatactactaggaagttgcaccagggccacaaacactggaagcggctggagggtgggagtggctggaggggtttcgttaggtaagccagggtacatgcccgattccataaggaggtgtgagaggtggggctcaggaggacacatcgggccctggatatt

SEQ ID NO: 83613 - DNA, 40 bp, Homo sapiens
  chr19:42409381-42409421
  hypo
tctcgccctaagccccggcccagcccgagcaggtgagggg

SEQ ID NO: 83614 - DNA, 116 bp, Homo sapiens
  chr19:42419358-42419474
  hyper
cgcctcctccggacacgttataacgaggagccgtgggatcggcgctccgggccctgctcccacgctccccccgccgtgtctcacacgcgtctctgccatctcgcagtctctgtgcc

SEQ ID NO: 83615 - DNA, 149 bp, Homo sapiens
  chr19:42444147-42444296
  hyper
acacagcactagggtcggattcacagttgggagctccctcggctgcgggtcagaccctcccctccactccctctcgaggaccctgactccgcggccccggaactgtcttctcgccgcccctcggcgtctctgcgcgcctgtctcatcgg

SEQ ID NO: 83616 - DNA, 119 bp, Homo sapiens
  chr19:42445005-42445124
  hyper
ccccgaggcagaaagcgcggaccccgcctgtcgccgccgccgccgcccgctcccggactcgcgccccccgcgcgtccactctgatttctcggcccatttttcttcctctcctgtcactc

SEQ ID NO: 83617 - DNA, 53 bp, Homo sapiens
  chr19:42445145-42445198
  hyper
cggctgccccgccgcgctccgcttcccgcgggaacccccgctgcagccagccc

SEQ ID NO: 83618 - DNA, 30 bp, Homo sapiens
  chr19:42474541-42474571
  hypo
tgtcagtgcccagatcgatgcagaggatgg

SEQ ID NO: 83619 - DNA, 30 bp, Homo sapiens
  chr19:42484215-42484245
  hypo
gcgtcagcacactcccgcctctgggccttt

SEQ ID NO: 83620 - DNA, 22 bp, Homo sapiens
  chr19:42493742-42493764
  hypo
ttacaggcgtgagccaccgtgc

SEQ ID NO: 83621 - DNA, 50 bp, Homo sapiens
  chr19:42496595-42496645
  hypo
tctggtgccagctcccgcagcctctgcgcctgggccggcctcccttcccc

SEQ ID NO: 83622 - DNA, 30 bp, Homo sapiens
  chr19:42501421-42501451
  hyper
caactgggtgctgaacggacagctcccaag

SEQ ID NO: 83623 - DNA, 50 bp, Homo sapiens
  chr19:42507833-42507883
  hypo
gcctgggcaggcacacgaggggctggaccagccatcgggccctgcagccc

SEQ ID NO: 83624 - DNA, 166 bp, Homo sapiens
  chr19:42573985-42574151
  hyper
aaagcatgctgggggcggggagagcccgggagtggagagctggggaggatggagagctgggagacccggagaggccaagaagggggcaaatgaggtggagagatagggaggagggagaggaggatggagaggagcaggtggaagagaaaggcggaggagggtgggg

SEQ ID NO: 83625 - DNA, 82 bp, Homo sapiens
  chr19:42578971-42579053
  hypo
gtcagtttcctcatccgataagttgaaattcctctgtgtttgggttcaaggagtaggtctggaaatgtttcttttcttcttt

SEQ ID NO: 83626 - DNA, 285 bp, Homo sapiens
  chr19:42636368-42636653
  hyper
agctgtgggggttagcggggacccggcatgggagagagggagttgctagagtacagaggagaaggacaatggagacagctgaggaggaggggcaggcagggcccgcagagcaaacctaaatgtgctgcctgtcctctgagcagtggcacaggcaccagcccccttacctggagcccccatgctggagtgaaccatgctgcccgccccgccagggctgggggaacaactgtgtcatctccccaccctctctgggggccgagccctccctgccggaagtcactcagg

SEQ ID NO: 83627 - DNA, 85 bp, Homo sapiens
  chr19:42680612-42680697
  hyper
ctttctcttctgcctcggctctcgctcctccgctcctccgctcctccgtcctttcagctccgtcctcagccgactgccctctcct

SEQ ID NO: 83628 - DNA, 186 bp, Homo sapiens
  chr19:426825-427011
  hypo
tccggggagggaggacgacagtgcgaggggcagagtccggggagggaggacgacagtgcgagacgcaggcgggtggaggaatccctggaccctggacccgcgctatgggcacatttgtaggagttcttggccagagaatcgggaagggcatgagtgcaagtgagaacagcccgggtgtgggcacag

SEQ ID NO: 83629 - DNA, 152 bp, Homo sapiens
  chr19:42683697-42683849
  hyper
ggaggaggaggaggacgcaggcacgcgctgcgcggtcttggcttagcagctgcaaccgcccttcgctttgttaccagcaaggctaccccatgcatactgagtggacacgcgggaccctcatgtgtgtgtgagaaacacgagaatcaccaact

SEQ ID NO: 83630 - DNA, 43 bp, Homo sapiens; identical to SEQ ID NO: 45904
  chr19:42697082-42697125
  hypo

SEQ ID NO: 83631 - DNA, 143 bp, Homo sapiens
  chr19:42722596-42722739
  hypo
tctgccctccagggtcgcccagatacccgctccctaacttgcaacaactagagagggtctgtcagggagtctaggctgtggtgtatgcgtgtccccttaccgcggggccttgggtgtgacggtcgccacgccccccacttagg

SEQ ID NO: 83632 - DNA, 127 bp, Homo sapiens
  chr19:42774775-42774902
  hyper
atatttgggggcctgcggggggctagccgactcagccaccctgccagagccagcccagccagggcggggatgcatgcaggcaagaagaggggggctgggcttgcgggtatcacgctgggtgctgtgg

SEQ ID NO: 83633 - DNA, 77 bp, Homo sapiens
  chr19:4278832-4278909
  hyper
acatccccactctcccggtccgtttcaccgccagacatcggttccatttcgaccctcactggcggtcattcccaccc

SEQ ID NO: 83634 - DNA, 116 bp, Homo sapiens
  chr19:4279316-4279432
  hyper
cgcccccctccccagcgtcccacctcccggcggcggcggggaaagtctctccgaaagcgtgaagggggattggaggaggtttttatttccctttgtgcgggtggctggggccggat

SEQ ID NO: 83635 - DNA, 218 bp, Homo sapiens
  chr19:4279567-4279785
  hyper
cgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccc

SEQ ID NO: 83636 - DNA, 23 bp, Homo sapiens
  chr19:4280205-4280228
  hyper
cggagagccgcttggagccggac

SEQ ID NO: 83637 - DNA, 20 bp, Homo sapiens
  chr19:4280809-4280829
  hypo
cactgcgcccggtggatatc

SEQ ID NO: 83638 - DNA, 104 bp, Homo sapiens; identical to SEQ ID NO: 37544
  chr19:42827981-42828085
  hyper

SEQ ID NO: 83639 - DNA, 184 bp, Homo sapiens; identical to SEQ ID NO: 37545
  chr19:42828316-42828500
  hyper

SEQ ID NO: 83640 - DNA, 34 bp, Homo sapiens
  chr19:42856588-42856622
  hypo
atctcacactgcaaccgcacgtgagtgaggcggg

SEQ ID NO: 83641 - DNA, 16 bp, Homo sapiens
  chr19:42884253-42884269
  hypo
gcgcccagcccagtga

SEQ ID NO: 83642 - DNA, 40 bp, Homo sapiens
  chr19:4290546-4290586
  hypo
ctccactacagttcacgcccactgccggtgcagggtgccg

SEQ ID NO: 83643 - DNA, 516 bp, Homo sapiens
  chr19:42905683-42906199
  hyper
tacaacaaaccaaaccgacctgcaagggagggccagtccccgtccctgcggcggtcgccgcagcagcagcagcaaaaggcagcggtggcgtgcaggtccagccgtctcggtgaccggtgtgtgtgcgcgtccccctccccgtggcgagggtctcagctttcgggcccccgccccgcccccttgccacccccgacttaagtaaggcacagcccgcgtccccttccgcccggcccggaaggcattcatgacggaggccggcgcagatgggaacaacaggcttttagtgtcgccccccgcagcccccgtctacccccgcagcccccgtctccccgctcggcccggctccggcgggaggagtgaggacgaggcggatgcgctccacgcacagctctgcggcctggcgcgtctcgcggcacagcgccgctagggtcaggaagccgtgcggcaggtcctccaccacgcgcagcgtcaccggctggcccaggttgcgcagtcgccgcgcgagcatgaccgagt

SEQ ID NO: 83644 - DNA, 46 bp, Homo sapiens
  chr19:42906867-42906913
  hypo
ccctggctggagcgtcgggggtggaaaccctcggggaaggcggcac

SEQ ID NO: 83645 - DNA, 93 bp, Homo sapiens
  chr19:42907199-42907292
  hypo
agataggcctggctccgttagtttggttgtgtgtgtggctggcagggaatgccatgggaagggcagtcgcctgtggagcgctgtgaaaggctg

SEQ ID NO: 83646 - DNA, 30 bp, Homo sapiens
  chr19:42916465-42916495
  hypo
cctggggcctggcagcggccattcccgtct

SEQ ID NO: 83647 - DNA, 26 bp, Homo sapiens
  chr19:4292523-4292549
  hypo
gtgtctggcctcgatccccccttttt

SEQ ID NO: 83648 - DNA, 101 bp, Homo sapiens
  chr19:42927377-42927478
  hyper
ccagggtgggcctctcggctgtcacatcacccccttctcacaatggatcatcccgttgtccccgcaagcggcaatgggccagtccgcggacccccccaact

SEQ ID NO: 83649 - DNA, 675 bp, Homo sapiens
  chr19:42927725-42928400
  hyper
ccgcgaggccctgcccggagggccaatcctcgctacacactactgtcgggcccccctattacccaatcccgagcttgctcttctctgggtccagctccctaaccaattctggtctccctccgctgccgtgctccgcccccaaccgccagaatttaagatctggctccgccccctaccgcgcattaaagggctcgcggccaacaaaaaggcaaccccgggggtggcgaaaagcgtccttcgggcaggactagtgcggagccccgcggggagcaccccagcagggaagtcccgatcttcccacgtgctgggaagcctcccatgtgctggctcagtctcgccatcccactcaccttcccagggagggatgccctagcacgcggcccggcccgccttttgaagggggaaagtggggcgcctctgagcctctgcctggggtgggggcgggccaggtcctctgccaactcaaagacgaggcggggcgccagcgctggaggcgtggctgtgcctgagagccgttggaggagggagccccgctttccctctcctgtctcctagttctcctattgcgcttttcctgggggatctttctccctctgtctccgccccctaatccatgctcccgataatgagggtgggggatggtggtaggagaacgctcggcgcctgcgcactagc

SEQ ID NO: 83650 - DNA, 270 bp, Homo sapiens
  chr19:4304414-4304684
  hyper
gattctgaggtcccacggcagggccaggggtcgagccccttgtcttctcatccaaggctctctccagctcacatatcaccaccaacaccgcccagtgagccccaggcgctggatgtgagggctctgggcgaggccagcgcggaactacatttcccaggcggccgcggcgggtgcgcctgcgcaatgcgcgcggtgatggagcgctaaccgggggcgcggcggcggcgagggctcggcgggccattggctaccggccgcggcaaaggcagc

SEQ ID NO: 83651 - DNA, 30 bp, Homo sapiens
  chr19:43044394-43044424
  hypo
agcacatcagcccaccgtggggaggcttgc

SEQ ID NO: 83652 - DNA, 30 bp, Homo sapiens
  chr19:4305492-4305522
  hypo
tcaggatgtaggtatcgggttgtagccttt

SEQ ID NO: 83653 - DNA, 42 bp, Homo sapiens
  chr19:4305764-4305806
  hypo
ggctcacctgcctgccgtgtgtgtgtgcgcatgtgtgtgcat

SEQ ID NO: 83654 - DNA, 36 bp, Homo sapiens
  chr19:4311212-4311248
  hypo
gccctgagaaggccacgtccccgaggagaaatggac

SEQ ID NO: 83655 - DNA, 152 bp, Homo sapiens
  chr19:43258522-43258674
  hypo
ccagtggctgagttacgaacagagcaagcatagagcccgctatgctttgtagtaatttgggggataaagagcttttgtcctgatagctgaaacttcccattaattgtccaagaatactgtgccggtgggttagagtccgcagaacaggacaa

SEQ ID NO: 83656 - DNA, 30 bp, Homo sapiens
  chr19:43385119-43385149
  hypo
tgcctggctgattcccggggaggctgtggg

SEQ ID NO: 83657 - DNA, 76 bp, Homo sapiens
  chr19:4361174-4361250
  hypo
atcctgttaaggctgcgggactcgagggtaggcagtgggccgggcccccgtcgggtcaggacggaggtgggggctg

SEQ ID NO: 83658 - DNA, 161 bp, Homo sapiens
  chr19:4361539-4361700
  hypo
cccagcagggggtgccggccagtgtggacggaggggcggggcggggacacgggtgagtcactgcggcaggggcacaagcacctccacgtagctgagcgggaagaagcccgactggccgtccagcatgccctcgtaccagttctcatcgatctggttggtca

SEQ ID NO: 83659 - DNA, 34 bp, Homo sapiens
  chr19:436312-436346
  hypo
agcctccgagccacacggccgtgccccccagcca

SEQ ID NO: 83660 - DNA, 52 bp, Homo sapiens
  chr19:4363354-4363406
  hypo
ccctgggctcacctgcgcttgagcttctccgccagctcgtccaggatctgca

SEQ ID NO: 83661 - DNA, 30 bp, Homo sapiens
  chr19:436614-436644
  hypo
catccctggcctcaccgtgtctccgcctga

SEQ ID NO: 83662 - DNA, 32 bp, Homo sapiens
  chr19:43692087-43692119
  hypo
agctcagcgtggcgtcgcgtgcaccagcgctg

SEQ ID NO: 83663 - DNA, 78 bp, Homo sapiens
  chr19:4378773-4378851
  hypo
tgagcaactgagtcccgaggaatgatgggtgtggggccggccaggggtttcacctccgccccacgacactgcctctga

SEQ ID NO: 83664 - DNA, 35 bp, Homo sapiens; identical to SEQ ID NO: 37152
  chr19:4380549-4380584
  hyper

SEQ ID NO: 83665 - DNA, 30 bp, Homo sapiens
  chr19:44022537-44022567
  hypo
gtaaaaattattcctcgggtaattggagac

SEQ ID NO: 83666 - DNA, 38 bp, Homo sapiens
  chr19:44029701-44029739
  hyper
ggttgcaattctggccggaaacccgctggtgcctgtgg

SEQ ID NO: 83667 - DNA, 202 bp, Homo sapiens
  chr19:44030617-44030819
  hyper
gctgcagcccagccccgctgggatccatgagtttggtccccggactgaccagcatagagcagccgcagccccagctccttgatcagctgggcatcccgaggcgctgtttccaggactgggtcgatcagaacggcctcccgggactctctgtcacccagcaggtacgtgaaggtgcagctcacaggctcgaacatctgggaac

SEQ ID NO: 83668 - DNA, 225 bp, Homo sapiens
  chr19:44203639-44203864
  hyper
ggccttctgcctgcgcgcgcccccacgtcccctccttgcaccctgtctccgtctcggcaggcggccggaacgtgaacgtacgcggctgcggctcccgagacctgtgcagcgccctggactggacccacgggctctctgtgctcccaagacactggctgtcgagccactgcagcccccaccgccgcgccgtcctagagtcccactgccgctcgggcgccgcgcccg

SEQ ID NO: 83669 - DNA, 54 bp, Homo sapiens
  chr19:44223121-44223175
  hypo
ctgctggtctccccccgccgctgcggggccgtcgagacccgcctggccgctgag

SEQ ID NO: 83670 - DNA, 137 bp, Homo sapiens
  chr19:44223519-44223656
  hypo
cgccctggtgttgggcgtcatccaggccctgccggtcccagggctggcggccgcctacgatgatgcgttgctcatccactcactgcgtggctaccaccgcagctttggtctggacgacgactcgctggccaagctgg

SEQ ID NO: 83671 - DNA, 133 bp, Homo sapiens
  chr19:44274041-44274174
  hypo
cccaacagccacagacggtaggcacgaccatccccagttagcagacaagcaaagaggctcagagaggagagccaaggtcccagctcagagcggtggagctagaatcataaatcgcatacgtccgagcccaaat

SEQ ID NO: 83672 - DNA, 318 bp, Homo sapiens
  chr19:44302850-44303168
  hyper
gggttgggatcctagcgcgccaagagcaggcgcccagcggaggccacgccttccccgaggctgccaggcctctcatcgtccctcccggagcccagccccgctctcccgcgcaccttggctcaggttggggagggcgtcatgagtcatgaggtgggcgttgcatttgtcagttgtgcagccgcgcaccaccgagtagtctggcggcagcgcgtccgcgttcgattgcgtctggcccgcaggaggcccggtccagcagcccttccgcaccagggtcaccggcgcgcgataccctgggggcgggatcggggctcgtgctct

SEQ ID NO: 83673 - DNA, 99 bp, Homo sapiens
  chr19:44324802-44324901
  hyper
cggatcaggagcgcacgctcattcggcccagtgacctgtgggaattgtagtcccgggccggaaacgcaggagacgccagaaacccaagtttgggacggc

SEQ ID NO: 83674 - DNA, 15 bp, Homo sapiens
  chr19:44324902-44324917
  hyper
cgtcccaagggtttc

SEQ ID NO: 83675 - DNA, 49 bp, Homo sapiens
  chr19:44331793-44331842
  hyper
acagtgtgtctcagacggcgtggcagggacggggcgtgtccccacggag

SEQ ID NO: 83676 - DNA, 16 bp, Homo sapiens
  chr19:44405908-44405924
  hyper
tgatttctgtggagac

SEQ ID NO: 83677 - DNA, 198 bp, Homo sapiens
  chr19:44405925-44406123
  hyper
atctactcaccacgtaggggctacagcagctcggacaccggaaaaagatctagagctcgagggtgaccctagcgcggtgacttctgggaaatgtagtccacccggaataaccatgtccacggcgcccgccattctgtagcctatgctcggagggcacatgagcaagagcttgaccatctgtaccgttggttgacttgc

SEQ ID NO: 83678 - DNA, 45 bp, Homo sapiens
  chr19:44455296-44455341
  hyper
tgggaagtgtcccaacggtcggtggggttgcgggcacttccggtc

SEQ ID NO: 83679 - DNA, 46 bp, Homo sapiens; identical to SEQ ID NO: 37556
  chr19:44455621-44455667
  hyper

SEQ ID NO: 83680 - DNA, 490 bp, Homo sapiens
  chr19:44488127-44488617
  hyper
gggagtctaattgcccggtcgatgcgcaggaaatttggctcccgcaggcgtttcgcgagtagcttgggaggcgtgggaattttggcccaggcaggaggacctgtgaattctgggaagtggagtccatttgctctgtggagtcgtgggaactttggctcaggcaggcggattcgggggattctgggaagtgtagtccagacgcctgtggcatcatcgacacttccggtctccgagcaggacactgctacttaacaaggtggtttgagccaagtatgtgtcttgcgggtctttgcgaaagtgaaccagttattaggggcgcctaacgacctggggggtcaactaagggggtaagaagccctggagaagacctgaggtttggagatgcgaggggtgggagggaagtttcgttgccgtcgatggagccttctggcgttgggggctgtactcaggtccaccggaggagtcgtcgggggttcggggggggcgggga

SEQ ID NO: 83681 - DNA, 60 bp, Homo sapiens
  chr19:44529378-44529438
  hyper
atgctctgtttgagtcgcgggccctttgtctcacacgggcgagtccggggaattctggga

SEQ ID NO: 83682 - DNA, 67 bp, Homo sapiens
  chr19:44529707-44529774
  hyper
agggagtgggattggcgcggcccggtgtgccctactttgacctcgcttagtccgcctccctcctccc

SEQ ID NO: 83683 - DNA, 104 bp, Homo sapiens
  chr19:44556147-44556251
  hyper
gtccagacactctggcgcagagaggacacttccggtctcctagtctgaggttcctgctttaatgaccggggtagtttgagccatttctgcgtcttgcaggacat

SEQ ID NO: 83684 - DNA, 304 bp, Homo sapiens
  chr19:44576101-44576405
  hyper
gtagtcaaagagcaccgcggagtcccacgcttcccgccggaaggtgatactatagaacgtctcctttgagattcaaggaagtgtagcgcaggagatctgttgaatgacgagcaagtaggctcaggacggcgtatccggggaattctgggaaatgtagttcacacgctgcgcggggtaggggcacttccgctcccggggggcgaggttgctgcagtgcattcggtggtagtttggtgtcagtcctgtgtcttgtcggtccttctaaacgtgtccccttacgatgctggctcgcaaccacctggaa

SEQ ID NO: 83685 - DNA, 27 bp, Homo sapiens
  chr19:44599783-44599810
  hypo
acaaaatgggcctggcgcggtggctta

SEQ ID NO: 83686 - DNA, 30 bp, Homo sapiens
  chr19:44615558-44615588
  hypo
cttgaacgcgggaggcgaaactccctctca

SEQ ID NO: 83687 - DNA, 55 bp, Homo sapiens
  chr19:44645516-44645571
  hyper
tccccatgggcagtgcgggaatcgtaggcaaggagcaccgcggagtcccatcgct

SEQ ID NO: 83688 - DNA, 448 bp, Homo sapiens
  chr19:44711515-44711963
  hyper
gctttctaggatacccggaagctcaggttactcggaagtatttccgctccaaggagcggaactatggccggtttcccctggggcattctgggaagtgtagtcaggggcccgcgtagcctggggcacttccgcttttggatggcggagctagggaattgtgggaagtgatccggggtttctctttagttgctgggaagttttttcgctctaggagggcgaaaacaagtgtttggatccgctgggaccctccaagttttctcagcctcgtcagggagcaagcggggccctggccctcgtctggaggaaggctagagaagctgtggccagctgggaggctggagttgggagcagtttgtgttctttcctctcggctgagcctcacgtttggagcagttcttgcgtccccgggttgggagcgtcctggatcggttgtcgcttggttagaggg

SEQ ID NO: 83689 - DNA, 247 bp, Homo sapiens
  chr19:44905364-44905611
  hyper
aaaaccctgagccagcgcccctctgccctcatccagagatgcacatcccaagactgaccctaagcttcgacccgaagaggcacagcgcaagtcgctgtcacgaaacgtgaagatgcactgttttgtcaaacccagggctgctccccaaaccgagcccacgctcgagcccacgctcttcccatcctatcccgggtaggtcgggccgctgaacttccctagtctaccccacctacgaggccttatcatt

SEQ ID NO: 83690 - DNA, 35 bp, Homo sapiens
  chr19:44907102-44907137
  hypo
ggttcccagtctgggcgtggtggctcaagcctgta

SEQ ID NO: 83691 - DNA, 336 bp, Homo sapiens; identical to SEQ ID NO: 37560
  chr19:44952282-44952618
  hyper

SEQ ID NO: 83692 - DNA, 46 bp, Homo sapiens; identical to SEQ ID NO: 37561
  chr19:44952619-44952665
  hyper

SEQ ID NO: 83693 - DNA, 149 bp, Homo sapiens
  chr19:44952666-44952815
  hyper
cccaccggaaacggaagtagtcgactcgaggtgtgggactacctttcccagaaccctccgcagcgcagtccgatcctaggggcgatggtgtcgtaaatgcgcgtccacctcgagtcacgcccactgcgaggcggcgggaggcggcatgc

SEQ ID NO: 83694 - DNA, 124 bp, Homo sapiens
  chr19:45003229-45003353
  hypo
cagcgtgggggttctcgagcctacgatacagcagctcaatgggaactgggccctttgtccttctcttgcccaatcatgacggcctgggtgttgtgcagtcagctcttcccgggaccaaatctgc

SEQ ID NO: 83695 - DNA, 48 bp, Homo sapiens; identical to SEQ ID NO: 45632
  chr19:4512122-4512170
  hypo

SEQ ID NO: 83696 - DNA, 30 bp, Homo sapiens
  chr19:4513397-4513427
  hypo
ccacaccggcctgtacggtccctttggcca

SEQ ID NO: 83697 - DNA, 251 bp, Homo sapiens
  chr19:45147116-45147367
  hyper
agagacctgcgcaggcgcaggcgcgcgggaagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgc

SEQ ID NO: 83698 - DNA, 35 bp, Homo sapiens
  chr19:45147699-45147734
  hyper
aaattggcagcaacacgggtcgggcacaagaccct

SEQ ID NO: 83699 - DNA, 77 bp, Homo sapiens
  chr19:45207322-45207399
  hypo
acagcgctggtggaacgtcgagacaccctgcgccttatgtgcagcagccccagccccaccgccgaggtccgctggtt

SEQ ID NO: 83700 - DNA, 30 bp, Homo sapiens
  chr19:4523538-4523568
  hypo
gtcagaagtccagctcgggcatcagggtgt

SEQ ID NO: 83701 - DNA, 21 bp, Homo sapiens
  chr19:4524273-4524294
  hypo
cacaatggggccggtcgcggt

SEQ ID NO: 83702 - DNA, 30 bp, Homo sapiens
  chr19:45257135-45257165
  hyper
gtattccttaatctccgaggggatgaggag

SEQ ID NO: 83703 - DNA, 30 bp, Homo sapiens
  chr19:45257570-45257600
  hyper
ggactcgggattatgcgccccccctacaca

SEQ ID NO: 83704 - DNA, 30 bp, Homo sapiens
  chr19:45257848-45257878
  hyper
gaactcaggcctggacggtttctctgaaat

SEQ ID NO: 83705 - DNA, 41 bp, Homo sapiens
  chr19:45279876-45279917
  hypo
ccccacagtcttgaacgccatcctcccgcctggcttcttcg

SEQ ID NO: 83706 - DNA, 30 bp, Homo sapiens
  chr19:45287728-45287758
  hyper
tgccggtggccaccacgtttgagggtgcaa

SEQ ID NO: 83707 - DNA, 98 bp, Homo sapiens
  chr19:45300099-45300197
  hyper
acagctcaggaagtccgggaacattattcgaccacagcaaacaagagagccagcaggaagcggggcggtgggggggagggtggcggtgaaaccagcca

SEQ ID NO: 83708 - DNA, 63 bp, Homo sapiens
  chr19:45316633-45316696
  hypo
ggctggggtgggtggcggggctatggcctggctgactgccacctcccccgatctctcccagag

SEQ ID NO: 83709 - DNA, 30 bp, Homo sapiens
  chr19:45316929-45316959
  hypo
gcctgaccctccacccgggggcttcacact

SEQ ID NO: 83710 - DNA, 39 bp, Homo sapiens
  chr19:45350901-45350940
  hyper
ttccctatgaatggtcgggggcgacggagacgtcgccgg

SEQ ID NO: 83711 - DNA, 33 bp, Homo sapiens; identical to SEQ ID NO: 16517
  chr19:45381918-45381951
  hypo

SEQ ID NO: 83712 - DNA, 398 bp, Homo sapiens
  chr19:4547992-4548390
  hypo
tcctcccttgcttcccgcccacggctggcctggggtggacactcacttcatacaccccgagtactgctggcagcgagccacaggcactcggaccacgcagcgggggaaggcagccagcaggccccccgaagctgcgtccagctccaagctcagcagccgctgccctgtctcgccaccgccgggccgtccacacctggggacaagcagagtggtgaggctgagcgcatctcagcccatctcccctcctgctggcgaccccttcccacctttgcccagacttacctgtccggccggtaggtctcaaactcctccaggaagacactgagcccagacgtccctgaggtgctggcattgggccggacgaggaacttgaggaccgtccccgcctcagaacccag

SEQ ID NO: 83713 - DNA, 108 bp, Homo sapiens
  chr19:4550222-4550330
  hypo
tgtcatccggcaaggcgctggaggcattgtactgcatcccgggggctgcgcagcacccgggcctgggggtgacaagggtgtggtcaggacgaacgtaaaggttctcat

SEQ ID NO: 83714 - DNA, 237 bp, Homo sapiens
  chr19:4550864-4551101
  hypo
ttctgctctcggaagcggccttcaaacacagctgccacctgtgtcaggtcaaaggcgcagacagccgagccagggatgctgaggggttgggatgaaagagtttggtgagcccggtgggaggccccatctcggacaagtgcgtgcaggagcctctgtctgcaggagccagtgaatcttcagtcttcctaggccagagatgtcccctgtccctcccgcatctgtcgaatgcagccactc

SEQ ID NO: 83715 - DNA, 30 bp, Homo sapiens
  chr19:45511777-45511807
  hypo
gccactgacctagagcgtgtcccttcctct

SEQ ID NO: 83716 - DNA, 166 bp, Homo sapiens; identical to SEQ ID NO: 45635
  chr19:4554076-4554242
  hypo

SEQ ID NO: 83717 - DNA, 62 bp, Homo sapiens; identical to SEQ ID NO: 45636
  chr19:4554999-4555061
  hypo

SEQ ID NO: 83718 - DNA, 312 bp, Homo sapiens
  chr19:4555896-4556208
  hypo
ctggaggaggtgacacggcctggggaaaagccatggccagcggaggtcgggcgagcagaggcctggaggttggacctggggcgcagggagtctgaagactcacgctgtagttggcgcacaccgggttgaaggcgttggaaccgcacacaaagagcgtggactcgtcccgaaggagcagcacctttacgaagtttcgacactcgccctgaggtggggacaggaggaagcggggagcgcgatgtgggcgtggtcatggtgatgggcgtggccagaacctgagttgtgtgggtggagggccggtctgttgtgggc

SEQ ID NO: 83719 - DNA, 449 bp, Homo sapiens
  chr19:4556922-4557371
  hypo
ctgattcgcaggggccgggaccgagccagggccaactcacctcctgtttgcccttcatccgacacacgtttatgtcgctggggttagatctccaggtcagcttctgcagacagagagagctggtgagggggtaacgggtcccagcagccctgagtgaccccgccgtgctgggccgaatccacccagctccccggcgcagtgccgcgtccccctggccctacccctccactcccacctgcaccccttcctcaccctctggtaccgcagctccgtggacgtggggggctccagctctacgcggtagaggttgtccctgggggaggggcatagttagtgagaactgggggctccgccaccctctcccgttccatccttcccactgccaatgtggtgtgcacacgggggcatgcagggccatgccaatgcctctgacacgagcaactctagcg

SEQ ID NO: 83720 - DNA, 107 bp, Homo sapiens; identical to SEQ ID NO: 45911
  chr19:45570386-45570493
  hypo

SEQ ID NO: 83721 - DNA, 257 bp, Homo sapiens
  chr19:45574443-45574700
  hypo
gggcccagacctgcccgcagatgtggacatagggtgtcggcccagcatgtcccacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacgga

SEQ ID NO: 83722 - DNA, 221 bp, Homo sapiens
  chr19:45574935-45575156
  hypo
ggcagtgggggcactcgaagcgggtgctgccaggcgtcatgccgtgcatgcggcggtggcggttgagcttactgctctgggcgcaggcgtagttgcagaactcacaggtgtaggggcgctccccggtgtgtgagcgccggtgcaccgtcaggttgctgctgttggtaaaatgcttcccgcagaactcacagctgcccccgggcccgcggctcttgccccct

SEQ ID NO: 83723 - DNA, 30 bp, Homo sapiens; identical to SEQ ID NO: 45914
  chr19:45601584-45601614
  hypo

SEQ ID NO: 83724 - DNA, 30 bp, Homo sapiens
  chr19:45603183-45603213
  hypo
cccccagctggcactcggtaaccagccttc

SEQ ID NO: 83725 - DNA, 33 bp, Homo sapiens
  chr19:45603877-45603910
  hypo
gtaataacccctgtgcggcggctgagtgcttgg

SEQ ID NO: 83726 - DNA, 30 bp, Homo sapiens; identical to SEQ ID NO: 45915
  chr19:45616778-45616808
  hypo

SEQ ID NO: 83727 - DNA, 30 bp, Homo sapiens
  chr19:45622695-45622725
  hypo
ccacggtgcctggcccgtttaactgtgttt

SEQ ID NO: 83728 - DNA, 515 bp, Homo sapiens
  chr19:45626532-45627047
  hypo
tgcccacacctctcccgcccagcactggcacctgtgaagggcctctggaggctgggtcttcctgcaggcaccaggaagaaacctacgagcgcatccttgctgagggcaggacccgctctccacatcctggaaacccaacagagaaagacagtctctctggcagcctccctgtcttgaagttcgagaaggctgcatttctaggctcccacaacctgtctgtccggtttgaagccggggcctgagggcttcagggtactgatgcaggacagacagctctggttcaaacctccctctgtccgctcccacaggtgtggcctcagaagaccattccctctgtagcgtggtagaggctggaaattctactctgcaggattatgatgcggattaaatgcagtaatcgagtgtttggcagagtgcctggtagggaaggggttcagtaaagagctgctcgcaccattctgtgcagggaatgctttagggcatgttttagaattttagaacgtgtttcactacat

SEQ ID NO: 83729 - DNA, 30 bp, Homo sapiens
  chr19:45633892-45633922
  hypo
acctgcattgcaaagcgtggttattctgag

SEQ ID NO: 83730 - DNA, 30 bp, Homo sapiens
  chr19:45654552-45654582
  hypo
tggctgaggtgccagcgaggtctaacccat

SEQ ID NO: 83731 - DNA, 51 bp, Homo sapiens
  chr19:45655298-45655349
  hyper
gcttgccctgaggcacggcccgacgggggcgccctggaggcgctgttggcc

SEQ ID NO: 83732 - DNA, 158 bp, Homo sapiens; identical to SEQ ID NO: 37564
  chr19:45655399-45655557
  hyper

SEQ ID NO: 83733 - DNA, 814 bp, Homo sapiens
  chr19:45655647-45656461
  hyper
cgcccccggtctgctgccggtcctccaggcactgcagcgcccagctcaggcggcacggccactggttggcgagcaccacccacgccaccgcctggcgcggcgtggggcccccaaagtccccctgctgctgctgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctccacctccttcttcacctcgcacatgaaacccagctggctgccgaacttttcacgcgacaccagccgctc

SEQ ID NO: 83734 - DNA, 82 bp, Homo sapiens; identical to SEQ ID NO: 37566
  chr19:45656661-45656743
  hyper

SEQ ID NO: 83735 - DNA, 591 bp, Homo sapiens
  chr19:45656790-45657381
  hyper
cgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctcacggcacgcggccgccactgcacgtgctgcagctcctcgctctcgcgctgcgcggcctcctgctgcatcagcgctgcgggaagggagcccgggagccgcgtgagccgcagacccgccggggtgggcggggcctagtacgggcagggcggagcgctcctggagaggcgaggggcgcccagcagaggcgaggggctggaagcgagccgcggccgctccttaaagagctggaagccggtgcagaagcgggggcgtggagaggcctggagccgggcttggaccggaagcggtctgaaggccaggctgtggggtcgggatgggcagaggtagagccggcagaggagagatgggaggaggcaaaaagagatacgaggaagagccagggatgggcaagaggctggaggcggagcgagggtgtggaggg

SEQ ID NO: 83736 - DNA, 30 bp, Homo sapiens; identical to SEQ ID NO: 16519
  chr19:45709152-45709182
  hypo

SEQ ID NO: 83737 - DNA, 42 bp, Homo sapiens; identical to SEQ ID NO: 45639
  chr19:4572555-4572597
  hypo

SEQ ID NO: 83738 - DNA, 120 bp, Homo sapiens
  chr19:45751309-45751429
  hypo
agtcaccgcgtccagccccctttttaaattttattattattttttattgaaatacaattcacatacataagagtcacccttttcaaacagagtccggtaggttttagtatattcacaagg

SEQ ID NO: 83739 - DNA, 44 bp, Homo sapiens
  chr19:45753553-45753597
  hypo
ggatggtccccacagcgctgtgtggcctccgagaggctcttgtc

SEQ ID NO: 83740 - DNA, 83 bp, Homo sapiens
  chr19:45755351-45755434
  hyper
tctggggctgggtgccggctccccaggagcccccctcctcttattcccagccctctgcccctccaggacgcacccagggcgcc

SEQ ID NO: 83741 - DNA, 264 bp, Homo sapiens
  chr19:45810003-45810267
  hypo
gcgcctacttctgggcggggatcatgtcgtcaatggactggcctttctccaacttcttctccatttccaccatgagcttcacaccatccaccaccagctgcacctgttctacttcggacgagcccagccgatcagcgttggacacgtcaaatactgagcccacggcagctgtgtccacgccacctgtgggagcaagggacaggggcgtgaagaggcagcgaaggtgcagaggggctgggacgtggcccccgtgccaaatgcaac

SEQ ID NO: 83742 - DNA, 92 bp, Homo sapiens; identical to SEQ ID NO: 45921
  chr19:45810770-45810862
  hypo

SEQ ID NO: 83743 - DNA, 492 bp, Homo sapiens
  chr19:45826794-45827286
  hyper
taaccctcgccccctcggtgccactgggagatttccgctgtgcgggggacagggagggtctcggtcgccgggaaaggagttatttttagagggcgctttgctgtctcctctgccgcaaaggccgagacccgaggcgctgggtatgggggggttcgggggcaggtgttggaggggggttcgccacgtgtcctggttaattataaccgggcgtctcgggtgtcctcgggcctcgcctccttacaagggcagccacggggccctgggtggccgctcccacctcccggggaagggggctgggcagcgacgccgttcagagcgcgggcgccagactcgcgcagatctgggcagagcaagcgctctcggcgcctcggctgtgagcaaggacttccagggctgagaggggggttctgtggaggagagtacagtatagaggaagccgctttctcctcctgggacgcgccaggattgcaggctgatcgggtctcctcctcc

SEQ ID NO: 83744 - DNA, 35 bp, Homo sapiens
  chr19:45835233-45835268
  hypo
tggtcaacagagcgagactacgtctcaaaaaaaaa

SEQ ID NO: 83745 - DNA, 250 bp, Homo sapiens
  chr19:45851193-45851443
  hypo
cctaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgctcaacatcctggcgctggtgtaccggtgagcactgcggccagccatggct

SEQ ID NO: 83746 - DNA, 77 bp, Homo sapiens
  chr19:45852140-45852217
  hypo
gagcccctgtgccagcgcgctttggagatccgagagaaggtcccatccccctcaccccaccccgaggaaccccttgt

SEQ ID NO: 83747 - DNA, 30 bp, Homo sapiens
  chr19:45855901-45855931
  hypo
ccgcgcctgcagatacggaggatgagaagc

SEQ ID NO: 83748 - DNA, 443 bp, Homo sapiens
  chr19:45888782-45889225
  hyper
cgccaggtacccaggcgccagcagccctgcctcgcacctgccaggtaggtggcgcagtcagcataaccctcgcggtaagggtcgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcac

SEQ ID NO: 83749 - DNA, 91 bp, Homo sapiens; identical to SEQ ID NO: 37572
  chr19:45889315-45889406
  hyper

SEQ ID NO: 83750 - DNA, 30 bp, Homo sapiens
  chr19:45926223-45926253
  hypo
ggcgattcttaaacacgagcaataaattca

SEQ ID NO: 83751 - DNA, 163 bp, Homo sapiens
  chr19:45931112-45931275
  hyper
ggaccccctagaaggcggcccattccccgctcccgattcatttccttgaagcagaagtgcggtaaagggcccgccgcctgcgatcagtggaattctgaatcggttaacgttagttaagagcgaggggaaaaaattgccctgggttctacgttatttccaagtt

SEQ ID NO: 83752 - DNA, 53 bp, Homo sapiens
  chr19:45931735-45931788
  hyper
gccgtatccaagctccgattccgcctctttcttccaaacgccccaagttccag

SEQ ID NO: 83753 - DNA, 34 bp, Homo sapiens
  chr19:45941595-45941629
  hypo
atttataggcgtgagtcaccgcacctggccctga

SEQ ID NO: 83754 - DNA, 74 bp, Homo sapiens
  chr19:4597429-4597503
  hyper
tagacgctctatatacgaatgaaaggatgaagggatgaagtcagaatttctgcccatcgcgcacttccatgctg

SEQ ID NO: 83755 - DNA, 30 bp, Homo sapiens
  chr19:45976163-45976193
  hyper
ttgtcctcacctgcccggaggtctccgcgt

SEQ ID NO: 83756 - DNA, 264 bp, Homo sapiens
  chr19:45997416-45997680
  hypo
tgcttacctagaaggcgtggctccaccgtgaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcccagagcccggactgagctggggagtcaagacctcgggcgatgagggctgagcaagtcggagtcgtaggtccagttct

SEQ ID NO: 83757 - DNA, 634 bp, Homo sapiens; identical to SEQ ID NO: 37574
  chr19:46001719-46002353
  hyper

SEQ ID NO: 83758 - DNA, 71 bp, Homo sapiens
  chr19:46002431-46002502
  hyper
cgactttacctacaaggaggctccggggaggccccccgagctacagctcgtttctgcggagccagaggtgg

SEQ ID NO: 83759 - DNA, 94 bp, Homo sapiens
  chr19:460027-460121
  hyper
taaataaacaaaggccgcttccttggccgccctggaagtccctgctgcctcccatctggaatcctggggtctgtccgggcgccagcccctttcc

SEQ ID NO: 83760 - DNA, 32 bp, Homo sapiens
  chr19:46012412-46012444
  hyper
agagaatccccctcccgcgtttgttccttctg

SEQ ID NO: 83761 - DNA, 51 bp, Homo sapiens
  chr19:460675-460726
  hyper
cgacccccgcgaccccgcgccccgacagcggctgagcgcgggcaggggaca

SEQ ID NO: 83762 - DNA, 21 bp, Homo sapiens
  chr19:46087047-46087068
  hypo
ccgcgccggaccttactatgc

SEQ ID NO: 83763 - DNA, 148 bp, Homo sapiens
  chr19:46105207-46105355
  hyper
gagcaacagagggggcgggcaccgagacggcgcgggagactgaggcagcccccgagggggcggggaggagcggtctcgccacgagcagggcaacctagtgagaccccgcagcatcgcgggcagccggggaggacccggcacttacctg

SEQ ID NO: 83764 - DNA, 56 bp, Homo sapiens
  chr19:461131-461187
  hyper
gcgcccctgggaccccggccctcctcgtcccggagcctggccgcgaggctggggaa

SEQ ID NO: 83765 - DNA, 86 bp, Homo sapiens
  chr19:46144079-46144165
  hypo
ctagaattatatagccttagtttttgactctgtccagatcttcagtatggccccgcctctggagttgaccacgcctgtcattctga

SEQ ID NO: 83766 - DNA, 45 bp, Homo sapiens
  chr19:46146928-46146973
  hyper
tcgcccctgccatcccgcgtccacaggccgcgcagctggccctct

SEQ ID NO: 83767 - DNA, 61 bp, Homo sapiens
  chr19:46148823-46148884
  hyper
ggccaggattggctgcgcccggatccccctaggtaccgtctggtcccgcccacaaccggag

SEQ ID NO: 83768 - DNA, 30 bp, Homo sapiens
  chr19:46172830-46172860
  hyper
tgctgctccagagggcggaggtgaggaagc

SEQ ID NO: 83769 - DNA, 355 bp, Homo sapiens
  chr19:46173896-46174251
  hyper
gctctaaggggcagacggcgggggagctgtaccagcgctgggaacggtaccgcagggagtgccaggagaccttggcagccgcggaaccgccttcaggtgtgaccaggagggctggggacgcggggaggacctgaggctgagaggggtgggcttgggatgggccttgggctgacgggcggggaagaaatctcggggcgctgtgggctggagaggcccggggactgacctgagcatggtgggaactggggcgggaccacggttcctgggggaggcctgggaggaagcttgaaatgggaggagccttgggcggggcctgcacagaaataaaccttgaagggggcggggtttgggatgg

SEQ ID NO: 83770 - DNA, 58 bp, Homo sapiens
  chr19:461788-461846
  hyper
caacctctccgagaccggccgcaccttccctggcctcaagggtcggttccttctgcac

SEQ ID NO: 83771 - DNA, 200 bp, Homo sapiens
  chr19:46180359-46180559
  hyper
ggctggggtgagctccgatcccgtcccccgcccaacccagcgcgcctctcctcggctcccccaactgccctgctggttggcctctgcgggtctcctcccgtctctaggcttctgccttccccaccccgacagaggaattccgcgggtcttgggcctggcggggcccgtgagcgcgctgacagctgcggcggggtgggggg

SEQ ID NO: 83772 - DNA, 30 bp, Homo sapiens
  chr19:462130-462160
  hyper
cggactcagcccctgcgcgtccgcgggagg

SEQ ID NO: 83773 - DNA, 151 bp, Homo sapiens
  chr19:46234852-46235003
  hypo
gtgagccaccgcgcccggcccgtcccctcctttcttacctcctgatttacaaatgagaaaattaagccttaggaggaaggaaagtcccatacattaggagttagtccacatcatagaatagcagctccacatcgctcgagcccaggagttc

SEQ ID NO: 83774 - DNA, 60 bp, Homo sapiens
  chr19:46269160-46269220
  hypo
agggctgggggccaccgggaggcctccctcaggcacggagatggccgtctctggcttcag

SEQ ID NO: 83775 - DNA, 57 bp, Homo sapiens
  chr19:46283022-46283079
  hyper
cggttcggcttacctcgctgaacgccccgcgtccgatcaccttcagaatctcgaagt

SEQ ID NO: 83776 - DNA, 43 bp, Homo sapiens
  chr19:46283125-46283168
  hyper
cgctgggggggtggtgggggaaaagaaccgagggtcaccagaa

SEQ ID NO: 83777 - DNA, 244 bp, Homo sapiens
  chr19:46321178-46321422
  hypo
tctgcagcctggaggcggggtggccggggatgggttacctgcttcatgatgaggcgggacaggatgttcatgacgaagccccccaggcgggggtacatggtcagggactggatgacggtcctcatgagcagcatgggcagggggctctgctccatcagctgctgcatcaccacggccagcacctctgacgtgtacacgttccgctccgcaaagcacaggttggtggctgcgaggaggcggagag

SEQ ID NO: 83778 - DNA, 85 bp, Homo sapiens
  chr19:46324647-46324732
  hypo
tgatggatttcatgtcgcacttcacggagtcaatgttgtgtaatgcgatcaggagctctccagggttcagcggggacaaggctga

SEQ ID NO: 83779 - DNA, 149 bp, Homo sapiens
  chr19:46327091-46327240
  hypo
cagcaggagcagctccggggagttcatgcccattcctcggatctagaggcagagacagggatgaccagacccagggtgagagcttaggggagggtcaggtgttgcccggcagggtggcttgcggggcatgctggcgcccagggtgagac

SEQ ID NO: 83780 - DNA, 30 bp, Homo sapiens; identical to SEQ ID NO: 45930
  chr19:46346873-46346903
  hypo

SEQ ID NO: 83781 - DNA, 95 bp, Homo sapiens; identical to SEQ ID NO: 45931
  chr19:46356540-46356635
  hypo

SEQ ID NO: 83782 - DNA, 15 bp, Homo sapiens
  chr19:46379843-46379858
  hyper
ctctacctgccacct

SEQ ID NO: 83783 - DNA, 534 bp, Homo sapiens
  chr19:46379893-46380427
  hyper
cgccttgccggctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtctctcccggagtcggccagcccgaggcaggaagccctgcggtttctggcttctcccaggcggcctccggatctggcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtggccaccagctctgctggcgtgggcaggtgtgacccccaccccagggacagc

SEQ ID NO: 83784 - DNA, 149 bp, Homo sapiens
  chr19:46404522-46404671
  hypo
agacactcacctgcacgtcggtcctcccggcggtcttccgacaacacgtagcgctgagggcaggcgcttgggggcggcggctgtgaagagggggccgcagggggctcctccgccccagcacctgcccccggcgccgccacacctggccc

SEQ ID NO: 83785 - DNA, 22 bp, Homo sapiens
  chr19:46461106-46461128
  hypo
agcactttgggaggccgaggcg

SEQ ID NO: 83786 - DNA, 30 bp, Homo sapiens
  chr19:46474960-46474990
  hyper
catccctctcccatccggaggaaaaggcca

SEQ ID NO: 83787 - DNA, 117 bp, Homo sapiens; identical to SEQ ID NO: 37581
  chr19:46476943-46477060
  hyper

SEQ ID NO: 83788 - DNA, 354 bp, Homo sapiens; identical to SEQ ID NO: 37582
  chr19:46477118-46477472
  hyper

SEQ ID NO: 83789 - DNA, 327 bp, Homo sapiens
  chr19:46519255-46519582
  hyper
cgcgattgagtttgtcggggcgggcgggaagctgacagctgcctctgtggtctcaggaggcggactccgccggtgcagccgcccccgacgcgggaggaccgggcctcatcgtcccgggagcgctccgcgtcgcgaggccgcggcgccgcgcgctcctcatcccgggagagcggccgcgggagccggggtcggggccgccctgcgcgcccctcgccctcgcccacaggtctgtgcccctgccctgcggtagggaggggacgcactggcgctgccaaggcccgtctccggacctagccgcctcctctcccacgccgtcctaggtggtcg

SEQ ID NO: 83790 - DNA, 30 bp, Homo sapiens
  chr19:46580568-46580598
  hyper
gctggctcaaatccccgtggaagatgcacc

SEQ ID NO: 83791 - DNA, 142 bp, Homo sapiens; identical to SEQ ID NO: 45640
  chr19:4670725-4670867
  hypo

SEQ ID NO: 83792 - DNA, 50 bp, Homo sapiens; identical to SEQ ID NO: 45641
  chr19:4672854-4672904
  hypo

SEQ ID NO: 83793 - DNA, 25 bp, Homo sapiens
  chr19:46763496-46763521
  hypo
ctaccgcgcccggccttttttgtct

SEQ ID NO: 83794 - DNA, 57 bp, Homo sapiens
  chr19:4679562-4679619
  hypo
tccctccattaggcccggagcaggggtgggtgtggcagcccccgatcccgtgcttcc

SEQ ID NO: 83795 - DNA, 45 bp, Homo sapiens
  chr19:46800530-46800575
  hyper
gtgggggattccctacgtctctggctgccccgcccctctggccaa

SEQ ID NO: 83796 - DNA, 30 bp, Homo sapiens
  chr19:46807600-46807630
  hypo
gccctttggaagccccgcctccttaggact

SEQ ID NO: 83797 - DNA, 238 bp, Homo sapiens
  chr19:46811841-46812079
  hypo
gagcagccagggtgccggagggcactgggcctgtgtgtagctgcctgtgacctccccgctgcccccgggcctccccagccctgtccaggaggaaggtggaggcccccacggagcggtgcttctccttgcgcatgaagagtacactcaccagccgcgggcgcaccctcaacctcaaggcggccacctggaaggtgcgtggggccgggccagaggagggcggggacgctggggctgggtg

SEQ ID NO: 83798 - DNA, 84 bp, Homo sapiens
  chr19:468719-468803
  hypo
cacggccccacagaccgtctgtgcacacatgctgtacatgtggcagtgagccacgggtgagggaggaaacgtcatccacacctt

SEQ ID NO: 83799 - DNA, 35 bp, Homo sapiens
  chr19:46876191-46876226
  hypo
cccagctagaccttgcgtgtcgcagcagctacagt

SEQ ID NO: 83800 - DNA, 635 bp, Homo sapiens
  chr19:46907187-46907822
  hyper
gaagcccctggttggcggcggtggccgtcactgctgctgctgcttctgcagccaccacggcccaagcatcccccagatggcgtccccttcctctggcttcctctcccgtagcaacagcagtccctgcagaggactctggagtggtggttgcggggtcctaccccgcagggggcaggtgggcgtggcggggagaggcagtagagtcgctcagggtcagctctgacctgtccccgcggtgttcccggccccagcagctgctcagttatttgtcgagtgctgacggtcggtcggaagaaaccacccggactgaggaaggctgaccccagatgcgcctagttgggaatgtgctggaaagatacgccccctggagggagtgcgcccaggaagtggggaggagcgtttgagatcgaaggagtggccgcgtaaaggccctgaggtctcgcaaggaagggtcccggggcgtcccaggccctgttctaggtgcaagaaacaggaacctcctggagcgagcatgcggtggggaggcagggggtacgcctcctacatgaggaggagatccacgcattaggaagtgaggcctgctggggacaaaagtctggcaggcagggccccaggagggccggggcaggagaggg

SEQ ID NO: 83801 - DNA, 51 bp, Homo sapiens
  chr19:46908071-46908122
  hyper
tgcctccatggtggtcgctgtcgggttggatttccacgtgcctggagttta

SEQ ID NO: 83802 - DNA, 497 bp, Homo sapiens
  chr19:46916491-46916988
  hyper
tttccaggatgcctacgtgagccgggggcgaggtcagtcccaaggctcaaggcccactccaagctggaaacgtggtgtcccagctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccc

SEQ ID NO: 83803 - DNA, 35 bp, Homo sapiens
  chr19:46917060-46917095
  hyper
cggttcccaaacctgccatccgaaatgtgcaagtt

SEQ ID NO: 83804 - DNA, 205 bp, Homo sapiens
  chr19:46929995-46930200
  hyper
cttggaatccaggaccgtttccacctcctccattttctgcaaagggcgcaggcgcctggggtcagcctgtggtctccatagcaacggtcggacgcgctgctaggttctggctctgactgcgcctgcgcggctggtcccgcggggtctcccgagtagcggaagatatttgtgggtctttgagacccttcctcgcttagaaattact

SEQ ID NO: 83805 - DNA, 52 bp, Homo sapiens
  chr19:46931467-46931519
  hypo
ggtttgaggggcagccgaataatctcttcgaattcctcgtggttgcagtcct

SEQ ID NO: 83806 - DNA, 283 bp, Homo sapiens
  chr19:46932053-46932336
  hyper
ctgccaacagagtgtcgtaggcgcggccctggcaggcagggaggcgcgtccctcaccgctggcccagaggttgcactcagtgccctgtcgccggactaggacgaggatgtggccgctgcacttgctcccgcggtgacgtcaccgcctccttccgctctgcggcctggcggtctccatggcaaccgctgaagcatccatctcctctgccattggccgactggccgcattgaaatcaagagtctgagggggtcattcggaggtgaggggtcggccaccagccctc

SEQ ID NO: 83807 - DNA, 78 bp, Homo sapiens
  chr19:46974489-46974567
  hyper
ccccaacccaggccccggtgctcacacgtgtccctgaatctgcagcaaaaggccctaggaccctcccccgggcctgac

SEQ ID NO: 83808 - DNA, 41 bp, Homo sapiens; identical to SEQ ID NO: 13444
  chr19:46974568-46974609
  hyper

SEQ ID NO: 83809 - DNA, 55 bp, Homo sapiens
  chr19:46974831-46974886
  hyper
cgccgctcgggggtcttgggctgcgcaggtgccgacgtctccatggcaaccgggc

SEQ ID NO: 83810 - DNA, 21 bp, Homo sapiens
  chr19:46974887-46974908
  hyper
tgggttgctagggctgagccc

SEQ ID NO: 83811 - DNA, 51 bp, Homo sapiens
  chr19:46974909-46974960
  hyper
gccggcgcgccggcgctgcaattggacctagggagccgggtgcaagagtgg

SEQ ID NO: 83812 - DNA, 563 bp, Homo sapiens
  chr19:46992698-46993261
  hyper
tcctcatctagggagcgtaaccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcgaccccaaacactcctccccatccccgccggagcactccctccaggaatgagggaatgaaaacaatgtttctttccagcacattccccaccaggcctatctgggatctgactcacccagtccgcgtggttcattccgaccgtcagtcattcaacaaataacagccgccgccgcgtgccaggcacggtgttggggctggggacacgaaggggaaaggccaagccacactttttccctacggagctggccctaagc

SEQ ID NO: 83813 - DNA, 434 bp, Homo sapiens
  chr19:46993281-46993715
  hyper
cgccacgcccacctgcccccatgccgcataggtccccacagccaccgctcagggccctctgcaggggctgctgctgctgcaagcccacggggcgctggggggagtttgaaagcaggaggaaagggacgccatttgggggaatgctcaggccgtggtggcagcagcagctggcggtcactgcggtgaaccaggggctcccgggtctctcctcaagcaagccggccccgtgcgtggaacttggcagtcctacactagggctctgatcaccagcctttcccaagtggctcctccagccctcgggagggagcagctccctgcattgctaatattgggacaaaacgatctccctgtttttgcacttcctgattgcaataccccagtcaccaatttcctctattaacctccctgacaagtacagtcggtgtgccaggggg

SEQ ID NO: 83814 - DNA, 77 bp, Homo sapiens; identical to SEQ ID NO: 37596
  chr19:46996589-46996666
  hyper

SEQ ID NO: 83815 - DNA, 30 bp, Homo sapiens
  chr19:4700942-4700972
  hypo
ttctcatctgtcatacgagggggaaaagac

SEQ ID NO: 83816 - DNA, 30 bp, Homo sapiens
  chr19:47017854-47017884
  hypo
gagggcaggggttgtcgggttcaaggtgtg

SEQ ID NO: 83817 - DNA, 318 bp, Homo sapiens
  chr19:470831-471149
  hypo
cagctccctgggtgccgggcggggtccacgccggagctgcttcactgcgcccgttctagacaggagcaggcaccatggggcaaggccaccagcctgtggcacagcgagccggtgcaccccatgcctgccctcccgcaggcagccgggaatgtccacagagatacaccacagccctgtgagacgggccaggcccggggagcccccaccttcatggtggagaaactggggctcagggctcagcctcacacccgacagcacacgtttactgagcacttactattttttctttttcttaaatttgtttttgtttttgttttc

SEQ ID NO: 83818 - DNA, 30 bp, Homo sapiens
  chr19:47105822-47105852
  hyper
aggaagcttttctaccgtcctccttcctca

SEQ ID NO: 83819 - DNA, 20 bp, Homo sapiens
  chr19:47116638-47116658
  hypo
gctggaatgcagtggcgcca

SEQ ID NO: 83820 - DNA, 260 bp, Homo sapiens
  chr19:47116898-47117158
  hypo
ttatagacatcatttcacttagttcatacccaggctggatggactgattaaaacgcagcacccgctcaaggtgtgcggaccctgcccaggcttgccggcaggagtcactagagaaatctggcagtagaggagtggaggccgggcaggtgaagcctcttgcaccacacttactggaagcagctgagcggggtctcaaagcccagcgcactcggatcccaacgcccacgccttctcccaccgcatcccggtacccatgcttc

SEQ ID NO: 83821 - DNA, 30 bp, Homo sapiens
  chr19:4714199-4714229
  hypo
ccgtggatgatgctccggagcccgtcccac

SEQ ID NO: 83822 - DNA, 337 bp, Homo sapiens
  chr19:47142808-47143145
  hyper
ctggaaagcatcaggcgcgccggacgtgccagggccccaggcccggctgcggaagaggggaggggagccaaggcgctcctcgccccgccatcggggtccgccggcgccgaggaggggcctgggcgtgtgccgagcctccgcgcctctcgcagctggtttctatcagcagtctggcctgggcagcccccgaggaggaaaccagctcagagagggggaagacagggtgacgatccagtcttccctcccgctcctccaccgcggccagaagctgggggatgggggagacggacagacagacactgcctgccgtgagcgcagcctccgttcctctcctgag

SEQ ID NO: 83823 - DNA, 14 bp, Homo sapiens
  chr19:47152977-47152991
  hyper
cgtcagaaagggcc

SEQ ID NO: 83824 - DNA, 377 bp, Homo sapiens
  chr19:47200235-47200612
  hypo
tggtggggccagaatcggatgggcagcacttgctgatgagctggaagcagggaggctgggggtgggcagagggtgtgatttgcaggatctgtctggagtaactgggggtaggaggaggtgtgggaaagtttgtgggcacagcgggaagtccgagggagctgaaagcccggaggcttaccttatagtatctgttggtcgtgttgttctggaagagcgtgatacacttgcagtccaggcgccaatagtgccgctttctctgcagagatgtttgaagagtcacgtgaaccgccagactttcctgcccagtccctatcccgtggagctgcttggggctccaggtgcctggagcaccacgtgcacgccgtaactctagcacc

SEQ ID NO: 83825 - DNA, 120 bp, Homo sapiens
  chr19:4725471-4725591
  hypo
ctgggattacaggcatgagccaccgcgcccgaccccaactacactgtaaaagagctttctgaaaagaaaaactgtgtgtgtatgtgtttaccttccgatggagttttgctcctgttgccc

SEQ ID NO: 83826 - DNA, 24 bp, Homo sapiens
  chr19:4725831-4725855
  hypo
gtgccaccacgccaggcctcttta

SEQ ID NO: 83827 - DNA, 37 bp, Homo sapiens
  chr19:47273996-47274033
  hypo
catgagccactgcacccagccccggcttttattttaa

SEQ ID NO: 83828 - DNA, 37 bp, Homo sapiens; identical to SEQ ID NO: 45936
  chr19:47284561-47284598
  hypo

SEQ ID NO: 83829 - DNA, 30 bp, Homo sapiens
  chr19:47345049-47345079
  hypo
aagcatgagatggggcgataatcctggatg

SEQ ID NO: 83830 - DNA, 44 bp, Homo sapiens; identical to SEQ ID NO: 16528
  chr19:47429440-47429484
  hypo

SEQ ID NO: 83831 - DNA, 32 bp, Homo sapiens
  chr19:47482387-47482419
  hypo
cacctgtattgtgctcgcggtctgtttctttg

SEQ ID NO: 83832 - DNA, 294 bp, Homo sapiens
  chr19:47522989-47523283
  hyper
gaaaggcgagcagggcgggtccgggggcggagacgcggcgggcggggctccggcagaccccgcccccgcccgcagcgctggtcgcgcgtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggtaggggaagcttgcgggctggcaggagg

SEQ ID NO: 83833 - DNA, 162 bp, Homo sapiens; identical to SEQ ID NO: 37600
  chr19:47523562-47523724
  hyper

SEQ ID NO: 83834 - DNA, 248 bp, Homo sapiens
  chr19:47524686-47524934
  hyper
gttctgtccctgggtcggagtgtaaaatccacactccggtctgctcccacctccagagatgtggaatccactcccaacgtcccgtcccgttcccaaggccccgggaggcggggctcgcccccagttcccaagcccctgagccccggggccccgccgacacctcctccgcgccgcccgcccagcctgcaggcgcagcgcaaggagaagtcccggaacgcggcgcgctcgcggcgcgggaaggagaacct

SEQ ID NO: 83835 - DNA, 35 bp, Homo sapiens
  chr19:47540684-47540719
  hypo
cagaaaactgaggcacggcgcggagaggttaagtt

SEQ ID NO: 83836 - DNA, 76 bp, Homo sapiens
  chr19:47593170-47593246
  hypo
tggcccgggtggctccgatgccccagaggagaaactgtaagggcagggctcacctcggccgcggctgctgccctcc

SEQ ID NO: 83837 - DNA, 66 bp, Homo sapiens
  chr19:47603348-47603414
  hypo
caggatccccaagtccgattctgcggactagtcgtttattaggattgaaggcgcagggcctttgct

SEQ ID NO: 83838 - DNA, 30 bp, Homo sapiens; identical to SEQ ID NO: 45939
  chr19:47633375-47633405
  hypo

SEQ ID NO: 83839 - DNA, 96 bp, Homo sapiens
  chr19:4769594-4769690
  hyper
gggacagctctccaccgaccgaaggaggagaatgctatttatttcagcaccaaatatccggacagcgcctctcgggaggtccgagaagagaaccgc

SEQ ID NO: 83840 - DNA, 562 bp, Homo sapiens
  chr19:47742701-47743263
  hyper
cgcagggcctgagtcctggctttccgcggtggggaaggggtctcccgggtcccctcggtgtggccggccctgcaggccgggaggctggaccggggccgggtgggggctgggcgggggcgcgggcgtccgcagggtccgagcggccggcgcgcgtgtgaaggttaccgcttcccggcggggcgggggccgcgcgctgttgctggggtctgcggggcctgcctgcgcccgcgccccccctccttcccggccagccagtgagcggtacccgccgccgttgccaggggaaactcgccgccccgttacccagcaacaagcctggcccaaccaggcgcgaggaccccccaggccccgcccgccgctgcccaccgcgtgcccaatgccaggcgggcagagccggcccagctcccggagacggcgagcgcgctcattggccaccgccgcgtccgcccggatctgggggagccctcggcgcggggggcggggaaccgggccccggggagctgccgggcgcgcggcctgcaaacctgcgaccggctggggtgatacccgggctgtgcaccat

SEQ ID NO: 83841 - DNA, 30 bp, Homo sapiens; identical to SEQ ID NO: 37603
  chr19:47746438-47746468
  hyper

SEQ ID NO: 83842 - DNA, 77 bp, Homo sapiens
  chr19:47783551-47783628
  hypo
ccacaatgtgcactttggatgaggtgggagccatgggaggcttctgaggtgaggagggtgtgcgctgattcagatct

SEQ ID NO: 83843 - DNA, 26 bp, Homo sapiens
  chr19:47819208-47819234
  hypo
catccatctgtccatcgattcatcca

SEQ ID NO: 83844 - DNA, 30 bp, Homo sapiens; identical to SEQ ID NO: 45941
  chr19:47847634-47847664
  hypo

SEQ ID NO: 83845 - DNA, 146 bp, Homo sapiens
  chr19:47848947-47849093
  hypo
tattttactctgaattatcatgcgtgaattaagaccaaggctgtcttgtaaaataaaatttgttgtggaacaatttatacagctcctttgaggtaggaggcaggactcaactctggagatggggctcggctcgaatattggaccaa

SEQ ID NO: 83846 - DNA, 30 bp, Homo sapiens
  chr19:47861508-47861538
  hypo
ggcagagccaggctgcgaacccaggtagtc

SEQ ID NO: 83847 - DNA, 23 bp, Homo sapiens
  chr19:47864411-47864434
  hypo
atgacaatggcaggccgtcccgg

SEQ ID NO: 83848 - DNA, 120 bp, Homo sapiens
  chr19:4790000-4790120
  hypo
acaattctgaatgaagacgctgttgaacatcttggttgtgatactggctacatagctgcatgtttgtcacacctgttctctttatttatttttatttatttatcttagagacagggtctc

SEQ ID NO: 83849 - DNA, 7 bp, Homo sapiens
  chr19:47910558-47910565
  hyper
gcccggg

SEQ ID NO: 83850 - DNA, 508 bp, Homo sapiens
  chr19:47921346-47921854
  hyper
atacagacacgattgcgcacccaagagaaacaccattatggggtaggacgaccgcgtcctgtcgtcacagaaccatgcacctgggaagccaggggcaccttcctctcatcaggtcaaatcccttcctcagtgatgaagacacggaggctcaaagaggcagcaggactcgcacgggaagaggctagaacgttcctgcctcggaccctcgcctggctgggcaccctggttctgtgtgtcccactctttccctctccctcttctcctaacttctcctgtgccctgaagttgaatccaactgctccccgctgctcaaggcactctcaccaaaagcggtcctcacagcctacccggaacccccaaaacgggcgcgcgcctcctcccctgtcttctatccccgttcccatccccagggagacaggctccgtggggccagcagcctggtgagaccacctctcccacccctgtcccactcctagccctggagaggcaggggcggcttggaacaaaa

SEQ ID NO: 83851 - DNA, 39 bp, Homo sapiens
  chr19:47923045-47923084
  hyper
gtctctctctgtctccgcttctcccgtcctttctctcct

SEQ ID NO: 83852 - DNA, 99 bp, Homo sapiens
  chr19:47923344-47923443
  hyper
cccgtggctgtcctgcggtgaggctggccgtttaaggcagtccgaggggaagggtctggaggccttgcctttcctcaaggccggcgcaccccagatagg

SEQ ID NO: 83853 - DNA, 77 bp, Homo sapiens
  chr19:47924604-47924681
  hyper
ccccaacctgagcaccgaccactggggctatgcccaccaggcagccacgtcccccggggatccgcagtggtccccag

SEQ ID NO: 83854 - DNA, 39 bp, Homo sapiens; identical to SEQ ID NO: 37606
  chr19:47925553-47925592
  hyper

SEQ ID NO: 83855 - DNA, 363 bp, Homo sapiens
  chr19:4792849-4793212
  hypo
gcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccg

SEQ ID NO: 83856 - DNA, 623 bp, Homo sapiens
  chr19:47933200-47933823
  hyper
agccaggggagggggcggagaagggaggccgagtcccaggagaggaggccgagtctggggggaaaaggagaccagggtccaagagcaggtgcagccgagtccctagccccgggcgggcggtggggacgagtctctgcgcgaggccctagaagccccggatgtggcagtacgcctccaggctggcgaagaggatgtacaggagccagaggcccaggaagagcgcggtggtggcgagcttgggtccgcgcgggccgcccagctcgccgccgatgtgcggccggcgccggtacagcagcacggcaatgcccacgaaggcgaagacggtgaagagcgtgacggagaaggccagcgtgccagtgcgcacctcgaaggggcggccctgcaccgcccagtacacggcggccacagaccaggcgacgcccaggccaaggaacacgttcaccgcgttggagccggtcacgttgccgatggacgcgtcggcgcactggtcctgcagcgccgccaccttgctggcgaacgtgtctgcgaggcagagacatacaggtcggaggggctttgcgccgccacccacaggggcgggcatccgcctgccccctcccagcctttcccggtcgcctgctttc

SEQ ID NO: 83857 - DNA, 38 bp, Homo sapiens
  chr19:4794081-4794119
  hypo
aggacagtctttctccgggagcccgctcactcattctg

SEQ ID NO: 83858 - DNA, 137 bp, Homo sapiens
  chr19:47947714-47947851
  hyper
ggccgcccccgacctcggcgtgggctgtgagctgtccgcggtgctgaaatgctggggccggcgaggagggagggtctcccgagacatgctcctcacacaccctgacacacacagacagctgccgacacagtgacatg

SEQ ID NO: 83859 - DNA, 146 bp, Homo sapiens
  chr19:47950977-47951123
  hyper
ggctcacccaggccccgcccctgagccacatcaggcctcgcccattccgaagccccgcccctctccgggccgcctcgggcgtgctcacatggtctcgtcgtcgccaaactccagctctccgcacgcgtcctcgtagtgcacgccgc

SEQ ID NO: 83860 - DNA, 201 bp, Homo sapiens
  chr19:4795123-4795324
  hypo
aaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttag

SEQ ID NO: 83861 - DNA, 15 bp, Homo sapiens
  chr19:47960571-47960586
  hyper
ggatctggatgacct

SEQ ID NO: 83862 - DNA, 192 bp, Homo sapiens
  chr19:47960799-47960991
  hyper
cgaataccacgcacaccgggaagaagaccagggtcagcagcgcctcccacacctgcgggcggcgggcgtcagggcgaggccgggcgggccgccttctccctccccgcctctctgtctcagtctctgtccgcctctgccactcctcatctctctccccaacccccaaccccgccccgtcgtctctccctatcc

SEQ ID NO: 83863 - DNA, 30 bp, Homo sapiens
  chr19:47969433-47969463
  hypo
aagtacaccactgcccgtgccgccttgtca

SEQ ID NO: 83864 - DNA, 137 bp, Homo sapiens
  chr19:4798614-4798751
  hypo
ctccatctcaaaaaaaaaaaaaagaaagaaaaatgcctaaggacacagcgcatgaaggaagggtcgagattggaacccaggaccgtcagagttcataccttgtgctgattctccatccgggacgccagacacatgga

SEQ ID NO: 83865 - DNA, 78 bp, Homo sapiens
  chr19:47986518-47986596
  hypo
ctctctccctcctcccgtccacgcctcactcacgggcaatagagtcaaggttgtactcagagccgggctcgtagtcgc

SEQ ID NO: 83866 - DNA, 319 bp, Homo sapiens
  chr19:48003347-48003666
  hypo
tttctgtccctagcacgctctcattttaagtaatttgttctctggcaactacatctcgggctctgttctctctaattcctccccaggatgtagggaagccaggttgggctaatttccgctcctttttcggcagcaactcctacctggctggtctcagaatcctccccgccccccacaccgctcccttctgcatgttaattctgacaacagaacagattttcctctctccccggcaggcggtgggtctgcaatggaactcccactcccaaatgctccgggattgggaaggggtgatcagctgcaccgacaccaccgacac

SEQ ID NO: 83867 - DNA, 186 bp, Homo sapiens
  chr19:48003928-48004114
  hypo
caaagcaggtggctgcgtcgtgcttgctctggagctgcaggtgcagctgtgcagcctggcagaacgcgtttccagcagctggaacagaagagaagggcagtcctggcctcagtggggctccacactttatgaagccacagagacactgccctgggaggtgggtcgggctctcgagaatgcggaaag

SEQ ID NO: 83868 - DNA, 109 bp, Homo sapiens
  chr19:4800481-4800590
  hypo
ggagttctgctcattcgctcatctactcagtgactttcttagaccctccccagcactttgagggtgtcagtcactgctgcgtcctcagcacccacgccagggtctgtcc

SEQ ID NO: 83869 - DNA, 324 bp, Homo sapiens
  chr19:48076446-48076770
  hyper
acccccggatctcctcgctcacgcgcggcgcaggcgcgcgtacgtgaccgcgggccgcctcacgcctcccagagcggcctcgcgcgtgcctcctggccgcgcgctctcggctgcttctccgaggggcggggcttgccgcgggcgggaaaggaggcggttggtcgccattttgggagggggcggttgagggcggagagtgagaagagtgagccggggaggagcggcggggggaggggccagtcccccaagacccgcatcccgaggccgagagtcccgggagcctccactccagccattgttcctggtgggcggtgttagaacgcg

SEQ ID NO: 83870 - DNA, 31 bp, Homo sapiens
  chr19:48106994-48107025
  hypo
ggcgtgagccactgcacggggccagggctgg

SEQ ID NO: 83871 - DNA, 71 bp, Homo sapiens
  chr19:48137031-48137102
  hypo
cctgtagtgagtcatcgggtgacaagccctgacctgaagccaggctatttataacccgtctttattgagct

SEQ ID NO: 83872 - DNA, 30 bp, Homo sapiens; identical to SEQ ID NO: 45947
  chr19:48137321-48137351
  hypo

SEQ ID NO: 83873 - DNA, 146 bp, Homo sapiens
  chr19:48151265-48151411
  hypo
aacttgctcctgggtcggtgtgcgggatagggggagggtgcatcagtctttgtggagcgtctgccttctctccgtctccctgttttcctgttaccgtctccccgtccctctctctgtctctctgaactgctcgttccctccttgcc

SEQ ID NO: 83874 - DNA, 85 bp, Homo sapiens
  chr19:4815691-4815776
  hyper
ctggtattagaaccccgactcgggaggcacacggccgttcagaaaggactacatttcccagggttccttgcggcaggagcagggc

SEQ ID NO: 83875 - DNA, 79 bp, Homo sapiens
  chr19:4816471-4816550
  hypo
tgccagcctgccatgcgtgcaggggtggcggctgcgggcaccccggccaagtgggaaagggtggcggggctcccagggg

SEQ ID NO: 83876 - DNA, 30 bp, Homo sapiens
  chr19:48207394-48207424
  hypo
cgcacttcagctgtacgcttgggcccattt

SEQ ID NO: 83877 - DNA, 24 bp, Homo sapiens
  chr19:48213122-48213146
  hypo
agttcacagatcctccggaatttt

SEQ ID NO: 83878 - DNA, 80 bp, Homo sapiens
  chr19:48237374-48237454
  hypo
ggcaagagaggatgacgctcgaatggacatggtggccactgaggtggagagaaatgagaagcaggggagaggctgggcgt

SEQ ID NO: 83879 - DNA, 94 bp, Homo sapiens
  chr19:48244303-48244397
  hypo
gcacccacatgggcccgtttgtggagcggggacctgacgaggccatggaggacggcgaggagggctcggacgacgaggccgagtgggtggtgac

SEQ ID NO: 83880 - DNA, 37 bp, Homo sapiens
  chr19:48293267-48293304
  hypo
tcactgtgcccggccacacaggcgtgagccacactgc

SEQ ID NO: 83881 - DNA, 38 bp, Homo sapiens
  chr19:48297784-48297822
  hypo
gtgacttcttctctccgtcaggccgaatcagagcttct

SEQ ID NO: 83882 - DNA, 30 bp, Homo sapiens
  chr19:48313221-48313251
  hypo
ccattcttggccagacgcaatgactcacac

SEQ ID NO: 83883 - DNA, 30 bp, Homo sapiens
  chr19:48334093-48334123
  hypo
tttagtcaggaaagacgggctggagaaaat

SEQ ID NO: 83884 - DNA, 53 bp, Homo sapiens
  chr19:4835677-4835730
  hypo
atactgaatattcttcgatctgattttcctttttaattcgcataggccagagt

SEQ ID NO: 83885 - DNA, 30 bp, Homo sapiens
  chr19:484049-484079
  hypo
aggctgcttctagctcggaacaaccgcaaa

SEQ ID NO: 83886 - DNA, 300 bp, Homo sapiens
  chr19:48478580-48478880
  hypo
cctggcctctataatcaaattggattgtatccagattctgcttaccgaacgatgctctgtggcttctctttggacttagccagctctcaagtgctggcttgcccactgcctggctcccagggcactcaccatggaccagccccagtggctttccctcactttgtacagcgcacccatctttgttgcccttgttcgtgtggttcatatctgaccctttttaaacctcactctggtactttatctccacacctgtattcctacctcaggtatcacctcagttatcactttttttctgtttta

SEQ ID NO: 83887 - DNA, 275 bp, Homo sapiens
  chr19:485119-485394
  hypo
gcaacctcaacccagcggaggaccctgctgacctgcttagttgtttatggagggtcattgccgtgctctaccacgtaacacacgtacacacacacacacaggtgcacgtttacaccacgtgggtgcgcacgatgaggcacacacaggcaggcgcgcacacacacgcgtgctcacataggaacacgaagaggcaggagccgggcgtgcccgagccccgtggcgccctgggcatcccaaacaccgcctgcccagaacaggtgcgcagtgagtgcctg

SEQ ID NO: 83888 - DNA, 182 bp, Homo sapiens
  chr19:48525268-48525450
  hypo
agctgggattaaatgcgcgcgattaaatgctgggattaaaggcgcgaaccaccacactcagccccaatttgaaatctagggtgggcctgaagcccacgcctctacgacagtgtgaagcctgaggagtaacctttgttttatccccttctgcttcctaggaatttccgcgttggtccctggct

SEQ ID NO: 83889 - DNA, 44 bp, Homo sapiens
  chr19:48563530-48563574
  hypo
tgcattttccatactcggtcattaaaatccgaggtgtattttat

SEQ ID NO: 83890 - DNA, 21 bp, Homo sapiens
  chr19:48586356-48586377
  hypo
ccaccgcgcctggccctggct

SEQ ID NO: 83891 - DNA, 21 bp, Homo sapiens
  chr19:48614830-48614851
  hypo
aagcccagcactaagcgtcat

SEQ ID NO: 83892 - DNA, 30 bp, Homo sapiens
  chr19:48771570-48771600
  hypo
atgatggttacacagcgatgtggctgtact

SEQ ID NO: 83893 - DNA, 115 bp, Homo sapiens
  chr19:48774859-48774974
  hyper
cctggtcccttacaccgtccattttgaggaaggggtcaagaagcgagtacaaaatgtctgggcaggacgaatctctgtagtcggtccttcctggcggcctcgttaggttgattta

SEQ ID NO: 83894 - DNA, 60 bp, Homo sapiens
  chr19:48775188-48775248
  hyper
ggaaaggggaaggcacgaatgacccacgtgttcagaccccgagcgcgcccttcaccttgg

SEQ ID NO: 83895 - DNA, 84 bp, Homo sapiens
  chr19:48775999-48776083
  hypo
ctgggcagggccagacgtgcaggatgcactggtttcttacgagaaagagctttttttttttttttttttttgagagggagtctc

SEQ ID NO: 83896 - DNA, 30 bp, Homo sapiens
  chr19:48800316-48800346
  hypo
cccgaggcctccgctcgaatcagacgctgt

SEQ ID NO: 83897 - DNA, 274 bp, Homo sapiens
  chr19:48800569-48800843
  hypo
tggccaagagagccacggtctctgctagtcttgtggctcaaaatggacccggggatggcatgggggtgcctggtgggcaccaggacggtactggagccggccctctgggtgctggccaggtccacgctcagggtgccgtccagcttcgcggcggcggcggccaggtccttctggcgctgcgcctccgcctgctcctggagctccacctgcagggaaggtgaactgggccccgacacacactgaggcctggccccacccccgcaggccccactct

SEQ ID NO: 83898 - DNA, 168 bp, Homo sapiens
  chr19:48806475-48806643
  hypo
accaaggcagagagacgaacagagaggagtcacagagacaaagaggtgtgggaagatacggcaggtgggacacagaaatacacagcaaggcagagagggaaagccagagactcggcaatagcaagggagatggggagatgcaggcggggagaacggtagatatgggta

SEQ ID NO: 83899 - DNA, 16 bp, Homo sapiens
  chr19:48834248-48834264
  hypo
tggagtgcagtggtac

SEQ ID NO: 83900 - DNA, 30 bp, Homo sapiens; identical to SEQ ID NO: 45957
  chr19:48844484-48844514
  hypo

SEQ ID NO: 83901 - DNA, 18 bp, Homo sapiens
  chr19:48857797-48857815
  hypo
aagcgtgagtcactgtgc

SEQ ID NO: 83902 - DNA, 32 bp, Homo sapiens; identical to SEQ ID NO: 37612
  chr19:48867764-48867796
  hyper

SEQ ID NO: 83903 - DNA, 325 bp, Homo sapiens
  chr19:48901815-48902140
  hyper
tgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggtgcgcgcgaccggggcggggcgggg

SEQ ID NO: 83904 - DNA, 33 bp, Homo sapiens
  chr19:48902532-48902565
  hypo
aggaatgggcctgggcgcggtggctcacgcctg

SEQ ID NO: 83905 - DNA, 153 bp, Homo sapiens
  chr19:48902805-48902958
  hypo
cacagtgagactctgtccaaaagaaaaagaaaaggaatggagttcagaaagaaaggggcgaagtctagtggagaggtggcagctaggaagtatcagaggtatcaggtaccaaggacagagtttggggaggcgttcggccggtagagcataggg

SEQ ID NO: 83906 - DNA, 30 bp, Homo sapiens
  chr19:48903408-48903438
  hypo
aggggccagttgtagcggacctctggtaga

SEQ ID NO: 83907 - DNA, 215 bp, Homo sapiens
  chr19:48918124-48918339
  hyper
ccaccggatgccccccgcccggaaaagcgctgctgcaagggtttctgcatcgacattctgaagcggctggcgcataccatcggcttcagctacgacctctacctggtcaccaatggcaagcacggaaagaagatcgatggcgtctggaacggcatgatcggggaggtgagggggcggacgggaggcggggaatcttcggggcggagtcgagaggc

SEQ ID NO: 83908 - DNA, 95 bp, Homo sapiens
  chr19:48918639-48918734
  hyper
aaaaaaaaagaggtcggcaccctggggcaggggcgcggccaaattgaggaaacacctgattggggcctggggcggggtcgcgggagggacatgcc

SEQ ID NO: 83909 - DNA, 117 bp, Homo sapiens
  chr19:48947361-48947478
  hyper
ggagaggatttggtccctcaactatcacccagcctgagaacgagggggcgggggccttggagcccaccggacttttttttaaacccgacaagggctttttaacgtcaccagatgggg

SEQ ID NO: 83910 - DNA, 24 bp, Homo sapiens
  chr19:48947874-48947898
  hyper
cggaagccccgccttcccttgcac

SEQ ID NO: 83911 - DNA, 22 bp, Homo sapiens
  chr19:48989603-48989625
  hypo
ccgcgcccggccttttggaaca

SEQ ID NO: 83912 - DNA, 66 bp, Homo sapiens
  chr19:48994825-48994891
  hyper
ggggacaaaccttcacgtcccatttaccgcatcccccaaaagcaacaaaaccggctaatatttctg

SEQ ID NO: 83913 - DNA, 43 bp, Homo sapiens
  chr19:48997015-48997058
  hyper
cgctgtcctctggctcgtcggccccgcgcggagacttgagcag

SEQ ID NO: 83914 - DNA, 30 bp, Homo sapiens
  chr19:49002701-49002731
  hyper
agcggatgtagtactcgctgctcacggagg

SEQ ID NO: 83915 - DNA, 30 bp, Homo sapiens
  chr19:49012484-49012514
  hypo
gagtgaggagggaggcgctgactgacagat

SEQ ID NO: 83916 - DNA, 217 bp, Homo sapiens
  chr19:49014319-49014536
  hyper
acgcttggcgcacaccgatgttctctatccccagcccaagacccagagaagggaactccgcaagccctgggtctctccagaagccagagacagcctcccgtgttgtgtcccccttagaaatagtattcctgtcctctgcccccaattctcccagaggccctgtccttccccttcttcctgcacacaccagcacaaacacatgcgtgcacgcatacac

SEQ ID NO: 83917 - DNA, 32 bp, Homo sapiens
  chr19:49015396-49015428
  hyper
tgcagatgtcaggcacgcgcagcccacacaca

SEQ ID NO: 83918 - DNA, 25 bp, Homo sapiens
  chr19:49043152-49043177
  hypo
agcactttaggaggccgaggcaggt

SEQ ID NO: 83919 - DNA, 84 bp, Homo sapiens
  chr19:49043417-49043501
  hypo
ataactgactgtgtatcttggagtgacagagctgtccctgcttgtgtaatgtgcctatccatgcattggcgaggcgtgtcgatc

SEQ ID NO: 83920 - DNA, 177 bp, Homo sapiens
  chr19:49117219-49117396
  hypo
aacgccaatggcttccgactgacagtcacagtatctgcctgttggagcatctgtctctggccaaatctgacagcccccacgagtttctcctgctcatcagctctcacccgcagaccagccaggatgcctctccactgggcctgctcgctcagccttaaaggccgaaggcttggcaaa

SEQ ID NO: 83921 - DNA, 374 bp, Homo sapiens; identical to SEQ ID NO: 45960
  chr19:49119027-49119401
  hypo

SEQ ID NO: 83922 - DNA, 420 bp, Homo sapiens
  chr19:49127373-49127793
  hyper
ccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggtgcggcccaggccggctgcacggccattggctgagcggatgcacaccctccccccacccctaggtctgatgggggctgttggtgctgacttgcgggaccgcctggaggaggacccggcgtgtgaggagggtgcgggggtcggggcagggaccggagtctaggggactgagggaccaagaggaacagagactcaggcccgggactggggcaccggggtgggagatgg

SEQ ID NO: 83923 - DNA, 229 bp, Homo sapiens
  chr19:491311-491540
  hypo
cctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagcttttgagtggccctttgacccgtgagacagggccgtggaagctggggt

SEQ ID NO: 83924 - DNA, 105 bp, Homo sapiens
  chr19:49143016-49143121
  hypo
cctccctctgaatctcgcctccgctcacgttgacaaagaggctgagaatggccaggccattggggccgcgggaggcagcgctgaaattcccgtagagttcctggt

SEQ ID NO: 83925 - DNA, 55 bp, Homo sapiens
  chr19:49180462-49180517
  hypo
atggaccttgaaacacggtgccgagtgaggaagccagactcggaaggccatggag

SEQ ID NO: 83926 - DNA, 30 bp, Homo sapiens
  chr19:49218773-49218803
  hypo
agtatggggtcagctcggtgccaccgaaga

SEQ ID NO: 83927 - DNA, 239 bp, Homo sapiens
  chr19:49242534-49242773
  hyper
gcgccgtggccagcacgctcttgtagttggcgcccgatgccagtccggcgccgaagatcttgaggacccccggaggcgccgtggcgcgggtagccagcgggggctcgggggccacgcccgccgccagctccggcagcttcttctcgctggcccagcgctgcgcgccccccggggtcccagggcctcctgcgccgctggaccccgtggtcccggtccccgagccccggaagagctgggag

SEQ ID NO: 83928 - DNA, 61 bp, Homo sapiens
  chr19:49244940-49245001
  hyper
cccaacaggaagtcacgcccccatcgccaaggccacgcccccgccgcggaccccagctttc

SEQ ID NO: 83929 - DNA, 24 bp, Homo sapiens
  chr19:49266812-49266836
  hypo
gcgagactccgtctatttaaaaaa

SEQ ID NO: 83930 - DNA, 20 bp, Homo sapiens
  chr19:49285394-49285414
  hypo
gagacagctctctgtcgcct

SEQ ID NO: 83931 - DNA, 76 bp, Homo sapiens; identical to SEQ ID NO: 45962
  chr19:49328490-49328566
  hypo

SEQ ID NO: 83932 - DNA, 29 bp, Homo sapiens
  chr19:49394189-49394218
  hypo
gaaaataaaaggaaacgtcaccacaatgg

SEQ ID NO: 83933 - DNA, 173 bp, Homo sapiens
  chr19:49399218-49399391
  hyper
caagcacagccctgccgctggattgttgcgggctccgcacgtaaagaatctcgcgccaggctctcgtaatgagaccgcgccccgccccggacccctagaccccgtctccgcaatcccgggtttggggtgggggtcccggctttcccaggctccaccaccgagctctgccaagc

SEQ ID NO: 83934 - DNA, 85 bp, Homo sapiens
  chr19:49402037-49402122
  hypo
cgggggttctgaacacgaatgccgtgtgggggttccttaaagagaccagagaccggcccggcgcggtggctcacgcctgtaatcc

SEQ ID NO: 83935 - DNA, 41 bp, Homo sapiens
  chr19:49459034-49459075
  hypo
agcgagtgtctcaagcgcatcggggacgaactggacagtaa

SEQ ID NO: 83936 - DNA, 31 bp, Homo sapiens
  chr19:49463923-49463954
  hypo
ttacaatttttgaagccgacttcaattgtgg

SEQ ID NO: 83937 - DNA, 30 bp, Homo sapiens; identical to SEQ ID NO: 45965
  chr19:49482126-49482156
  hypo

SEQ ID NO: 83938 - DNA, 113 bp, Homo sapiens
  chr19:49541820-49541933
  hypo
tcagtggtcaatgcccgcccataggactgcttggccttgcactcagacacccagtgccccccggtccacaccccggcggcaggtcctccacctacccccgggccaccttcctt

SEQ ID NO: 83939 - DNA, 199 bp, Homo sapiens
  chr19:49545552-49545751
  hypo
tcgggagtcagcaggcgcccgggccaaccgcagccagcgaggggtgagcaatacttcactggcgagtcatcagggtgaggctggccgtgtgtgatgcagtcactggctgggtgacagacccccggaccgctgtggactcaggtgtgctggaggtggaggtgttgggcgaggtgcctgcagctggcggcagttccctctg

SEQ ID NO: 83940 - DNA, 177 bp, Homo sapiens
  chr19:49553709-49553886
  hypo
ggcagagggaactgccgccagctgcaggcacctcgcccaacacctccacctcgagcacacccaagtccacagcggtcccgggatctgtcacccagacactgactgcatcacacacggccagcctcaccctgatgactcgccggtgaagcatcgctcgcctcacgctggctgcggttg

SEQ ID NO: 83941 - DNA, 30 bp, Homo sapiens
  chr19:49558182-49558212
  hypo
ttgatggggcggcaccgtggccgaagcatc

SEQ ID NO: 83942 - DNA, 3 bp, Homo sapiens
  chr19:49560012-49560015
  hyper
cct

SEQ ID NO: 83943 - DNA, 116 bp, Homo sapiens
  chr19:49560299-49560415
  hyper
gccagcccaggggctcggcgtgcaccggccatggcgggggctgtgcaggaggcggtgccgagcgagagcccggcttacttgggatagaaccgaaagtcccgcgccgaggtggtcag

SEQ ID NO: 83944 - DNA, 218 bp, Homo sapiens
  chr19:49575257-49575475
  hyper
gcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgc

SEQ ID NO: 83945 - DNA, 4 bp, Homo sapiens
  chr19:49576122-49576126
  hyper
cgcc

SEQ ID NO: 83946 - DNA, 30 bp, Homo sapiens
  chr19:4962354-4962384
  hypo
ctgttcactttgcagcgtcaagttgcaggg

SEQ ID NO: 83947 - DNA, 95 bp, Homo sapiens
  chr19:49628304-49628399
  hypo
tagagtgagactccgtctcaaaaaaaaaaaatagagatcatgttggttttttgcctatggctggcttgccctcttagaatcgttttcctgaatct

SEQ ID NO: 83948 - DNA, 78 bp, Homo sapiens; identical to SEQ ID NO: 37093
  chr19:496464-496542
  hyper

SEQ ID NO: 83949 - DNA, 30 bp, Homo sapiens; identical to SEQ ID NO: 37622
  chr19:49649675-49649705
  hyper

SEQ ID NO: 83950 - DNA, 137 bp, Homo sapiens
  chr19:49652128-49652265
  hyper
tgggggtggagccagcgtggggggcgtggcccgaagagaccaaatggaggtggaggtatgggctaaactgaactctccaggccacgggaggggcacggctgagggtcccttccgtccccagacgtgatggtgtggtc

SEQ ID NO: 83951 - DNA, 88 bp, Homo sapiens
  chr19:49661511-49661599
  hyper
ccggggtgaggagttcgcccctggactgaccccagagggtccgcggcccgctgaccccgcccgcggatggtcacgccccagccctgct

SEQ ID NO: 83952 - DNA, 88 bp, Homo sapiens
  chr19:49703569-49703657
  hypo
ttgtaccacctgggccgcactgtcctctgcatcgacttcatggttttcacggtgcggctgcttcacatcttcacggtcaacaaacagc

SEQ ID NO: 83953 - DNA, 49 bp, Homo sapiens
  chr19:497872-497921
  hyper
ggagccggtggtggccgtggccttgggcgcctcgcgccagctcacctgc

SEQ ID NO: 83954 - DNA, 120 bp, Homo sapiens
  chr19:4986513-4986633
  hypo
gccatggcaggtcggcgggcacagaggagggctcgggaggctgtgtcctccagcgtctccatgtttactgtgccaggccaggtgctgaggggccggcgaggaagacgtgaggactggaga

SEQ ID NO: 83955 - DNA, 30 bp, Homo sapiens
  chr19:49867107-49867137
  hyper
gcggagcgcaaccaacgctctagaccagac

SEQ ID NO: 83956 - DNA, 42 bp, Homo sapiens
  chr19:49890887-49890929
  hypo
aaaggacaggccaggcgctgtgtctcacgcctgtaatcccag

SEQ ID NO: 83957 - DNA, 200 bp, Homo sapiens
  chr19:49924370-49924570
  hyper
gggccaattagggctcggtccgcctcccgaaaatgcaaattttgggacgccttgccaaacacgcgcggcggccccgcttcccgcgcagcagacgcggccggctccactctcttctttaaaccaatgagagcgcggtccgcacgaacggcgccccaggcgcgctgatctagccctctgcggaccaccgggttgccatggtt

SEQ ID NO: 83958 - DNA, 939 bp, Homo sapiens
  chr19:49925640-49926579
  hyper
aacgcacacgcaggtcgcgcaggaactaggcgcagtccggagcgcagggcatggtctttattaagatggggacgggcagcgcgctcagggcgcatccaacaccagcagcttgtgcatgtacgagttcagccagtggcggcgctcgagggcggccagcaaccgcgcgcgctcccggaaggccgcgtcgtccgccagcgccaggctcctccgcggcctgggggtggcgggatccgcccaggcccgtcctggggggcggaggctgtggagagacgcggtgaccgcgcgtccagactcgctcttgccgccgcctgtcctccccgcggtctaactcgaagccccgttactgcccagtccgtggagtggctcggtccggctccccctgtctctctcgttctctgtgtgggtctctgtctctctgctcaccaggttcgaaactccccaggtactgagaccgagtctgatgcacttgtccgcccacagcgctcagcgcatggccaggcgcacaccaagaacccaataaacgttgctcaaagaatgaatccgtttctgcaacgactcctttcgagcctctccacgcctttctcgggatctatctttctgtgtctctttcccttgctgattttctgtccatttcccgcaccaccactaccaccaaaccctcctcccgccttcccccacccctagtctctgtcttctcgctgggtctcggtcgccctctctttgggcttctgttccgctttctggatcttccgtcccctttctctttggttctcttcccacttctccaagttcccacccctccctgggagttctgggactggcacctacctgaggaccccgaccgggggcagggcgactcccgaggcagtgcggacgccccagggcaccaccagcagcagcagcagcagcagcagcagccgaacccgagggctcctggac

SEQ ID NO: 83959 - DNA, 49 bp, Homo sapiens
  chr19:49929427-49929476
  hyper
taaggaaattaactacgactcccaagtagccccgcgcctcagtctctct

SEQ ID NO: 83960 - DNA, 135 bp, Homo sapiens
  chr19:49931210-49931345
  hyper
ctggtggggcgaccacgtggcgcagcaggcggggccctctgcctgttcttcgcggggaccgcgctgctgatcggcatctttgtgctgctgtggtgtctttaccgccgggcagctagacagcggcccttcgcacat

SEQ ID NO: 83961 - DNA, 166 bp, Homo sapiens
  chr19:49932009-49932175
  hyper
cgcgggggtcgcccgcagcgtctggaggccctgtcccccgccacgctccccaacaacttcgtgtgagccccaccgagttctgccggacctgcacatccccacagtgaaggaaaaccctgcgcttctggtatgcttagctagagtagtgccccggataaagggtcta

SEQ ID NO: 83962 - DNA, 664 bp, Homo sapiens
  chr19:49935705-49936369
  hyper
catcacctctcaatccggctctgctccacccaggctgtcctagagccggcccaggccccgccccactcacctccgcagttcatcaacttgcgcacgttggtggtggacatgatgcggcggctccgcaggaagtccgcgatctggccgccgatgggcacgatgatggtcatgaccaggtggggcagcgcggacaccaggcctacctgcgggaacaggtgtacagggacactagggttcggggccgccggctcggcgtctctgcccggtccgtgcaccaccggctcctccctgcctcgggatcgccgccagttccctcccgccgacccctccgcgcccccctgccctctcctcctgggctctaccttgctgatctcgaagccgaacacttcttcgaagtaggcgggctgggagatgagcagcaggtagaacgtccagctgcggcagaagttggccacgatgatggcatagactggcatagacgtgaagaagcgccgccagggagtgctaaacttctgtgggggcgaggggagggccgctaagacggggagcggggctgagggcttctccgcgtcccttcagggaccacagtgtagttctgcagaaaccaaaggatcccgaccgcactgaaacttctatggacccaaaggcgcgggctacaccatgt

SEQ ID NO: 83963 - DNA, 366 bp, Homo sapiens
  chr19:49936853-49937219
  hyper
tagcccctctctttgcgttccagtcccgtctcctctagagtctgcaggaaccgtccctgatctacacgctgtgcaggttcgtggcttgctatctctccccgccccttccccgaagatttggtcccggaccgtgagggggttcatgagtttcgcgctctctccgatggcgtcctcgatgtacttgcgctcctcctccgagatgctggggtgcagcgcgggggactcgtaggagacgagcagccagaacaggtaccagaagatcccgaagctgcctgggggggtcaggagggggatgggagcgaggtgaggaccggccccgctccgccccagcgccacccggaaccaggcatccgggtccctcaccgt

SEQ ID NO: 83964 - DNA, 30 bp, Homo sapiens
  chr19:49939994-49940024
  hyper
caccgggcgcccatccgcactcagctccag

SEQ ID NO: 83965 - DNA, 46 bp, Homo sapiens
  chr19:49944610-49944656
  hyper
cgaaactcctcctggcggaactccatggtggcggctcctgccgccg

SEQ ID NO: 83966 - DNA, 178 bp, Homo sapiens
  chr19:49954045-49954223
  hypo
aggctggatttgtgtcgattctggtctggttgtctgggcttgctggagctccttcgaggcctgtataaaggaaaactacctccaggctcggagtctgtgccatcagacccctcatttgttcctcaaatggagcaattcttatgcatgagagctgtggataacgcgagaaattagacgg

SEQ ID NO: 83967 - DNA, 71 bp, Homo sapiens
  chr19:49971866-49971937
  hypo
ggcagcagaaaaaggcgccccaaagtcggcaggagcttgtctcttaccccaccctccgtggtacccatgct

SEQ ID NO: 83968 - DNA, 79 bp, Homo sapiens
  chr19:499757-499836
  hypo
cccttgctgaatgctcggatgaagacatttaatgtgggccggtgccctggcggtgctcccttcacgctctgtccaatcc

SEQ ID NO: 83969 - DNA, 30 bp, Homo sapiens
  chr19:49976596-49976626
  hypo
gagtgtggccatgtccgagttccccaggat

SEQ ID NO: 83970 - DNA, 86 bp, Homo sapiens
  chr19:49979926-49980012
  hypo
ccaacgaaggtagagcgagaagcgccaccctgcagagccctgttcctacagaacaacacgtccccaggcaccggtgatggggagca

SEQ ID NO: 83971 - DNA, 28 bp, Homo sapiens
  chr19:49997370-49997398
  hypo
gagccatcgcgcccggccaatttttttt

SEQ ID NO: 83972 - DNA, 93 bp, Homo sapiens
  chr19:49998339-49998432
  hypo
caccaattaaatcatcgtctgcggatgaaatgaggagagagtagctttctttctctttttttttttttttgagacggtctcgctccgtcgccc

SEQ ID NO: 83973 - DNA, 120 bp, Homo sapiens
  chr19:50049634-50049754
  hypo
agttcggtttttttttttaggtttacctgggctttttggagtgtacccatgcagccaggtgtggttcagggtcagctagatatttgagtagagttgggccgtgtgcggtgactcacgcct

SEQ ID NO: 83974 - DNA, 140 bp, Homo sapiens
  chr19:50050702-50050842
  hypo
acaagctaaaaacaacgccttccactaagttcaactcttcacagacagccagtgtttcctaccatggagaatctacacagatttaagcaaatatgtacaaatagtctttatttttttttggaagacgaatctcgatttgt

SEQ ID NO: 83975 - DNA, 31 bp, Homo sapiens
  chr19:50053089-50053120
  hypo
atccacactgtagcccgtgtcaggacgtcat

SEQ ID NO: 83976 - DNA, 59 bp, Homo sapiens
  chr19:50129682-50129741
  hypo
cggcaaacactttaccggcaggctggagtgcctctgtcctgcggcgctggagtgggtgg

SEQ ID NO: 83977 - DNA, 244 bp, Homo sapiens
  chr19:50166617-50166861
  hypo
agattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgctcctggggccctaaccctgtctcccgagtcctaacacca

SEQ ID NO: 83978 - DNA, 796 bp, Homo sapiens
  chr19:50194078-50194874
  hyper
accctacgcgcctgacgttataatgcacctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtggtaagtactggaccccaggggctcgggctccggcggggcctggagtcctgtgtctagggttgggcgtgcaagcctctccatcacttgtcctcgacgctcgcctccgctcacagcctcagcatcccaggctgcgaggcatgcgcagtgggtgcttccttccccattccctccagcacgggcggggggaggggacgctgagcggatgaatttatagacaccatccccctcgccttggcatgaaaagcggcaatggggtggacagcgtcaatgtctaaca

SEQ ID NO: 83979 - DNA, 130 bp, Homo sapiens; identical to SEQ ID NO: 45976
  chr19:50216075-50216205
  hypo

SEQ ID NO: 83980 - DNA, 174 bp, Homo sapiens; identical to SEQ ID NO: 45977
  chr19:50216693-50216867
  hypo

SEQ ID NO: 83981 - DNA, 30 bp, Homo sapiens
  chr19:5023215-5023245
  hypo
tgagggaacctggcacgcgctggtgctctc

SEQ ID NO: 83982 - DNA, 87 bp, Homo sapiens
  chr19:50250231-50250318
  hypo
ttggactccaattcccgctaacctcccacagcctgcctccaggtatccacccggccctccaagccctccaggcgtcaaataccagtc

SEQ ID NO: 83983 - DNA, 98 bp, Homo sapiens
  chr19:50292243-50292341
  hypo
tccagctgcagcacacgagggttcccagcactttaggaggccgtagcaacaggcgtcagtcgggcgagtatctgcctggatgacggcaggagccacct

SEQ ID NO: 83984 - DNA, 33 bp, Homo sapiens
  chr19:50297021-50297054
  hypo
aaggcttcctgggggcggcgatcccagaattga

SEQ ID NO: 83985 - DNA, 30 bp, Homo sapiens
  chr19:50302697-50302727
  hypo
gttctcccatgaagccgtcaagacgcacat

SEQ ID NO: 83986 - DNA, 30 bp, Homo sapiens
  chr19:50305210-50305240
  hypo
cctcaccgtgacctgcgcttcctacagtcg

SEQ ID NO: 83987 - DNA, 41 bp, Homo sapiens
  chr19:50306672-50306713
  hypo
gtcggccttcctcaccgtggggaagccggctgacccaggtc

SEQ ID NO: 83988 - DNA, 30 bp, Homo sapiens
  chr19:50308605-50308635
  hypo
tcaaagacctgcaggcgggagctgccggga

SEQ ID NO: 83989 - DNA, 30 bp, Homo sapiens
  chr19:50309103-50309133
  hypo
tgacttgaaccttcccggtccccagccctc

SEQ ID NO: 83990 - DNA, 133 bp, Homo sapiens
  chr19:50315790-50315923
  hypo
gagctggaaggcctccggggtcatcttcaacagggactatcacccaggccctgtccctgtcccacgttccctcctggggacctgtcatggaagcttttccacaccacagtcgtgttctcggtcctcgcagagc

SEQ ID NO: 83991 - DNA, 525 bp, Homo sapiens
  chr19:50316196-50316721
  hyper
ccagagtcaaaacaccgaacccccttcggtttagatacaggcgtccaaggccccacctgctgacgggcgggggcgccgccgcgactgctcctgcagaatagggggaccccgctggaggccgcgaggcacagcagatgcacagtgccgcccgtcccctcctcccccatttaggactcccaccgcggtccctcacgtggggactgtcagtgcgggtcttggagcatggcggtaatcagagtaactcggcctgtggtccggagccgccagagggcgagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcctagccacc

SEQ ID NO: 83992 - DNA, 120 bp, Homo sapiens
  chr19:50318985-50319105
  hypo
agataaaagaaaaatagaaacccaataaaaaataattttaaatgataaaggtaaaaacctttatcattaggctttctgtaagtacttttcaattggtgattattattattattattactt

SEQ ID NO: 83993 - DNA, 120 bp, Homo sapiens
  chr19:50319645-50319765
  hypo
ccatctcgcccggccgaagattatgttttaaaatatttactggccattcaaaattttgtgtgtgtgtttgtgtgaaactagtcaggtttctttttatttatttatttttattttttttga

SEQ ID NO: 83994 - DNA, 120 bp, Homo sapiens
  chr19:50320005-50320125
  hypo
agtgctgggattacaagcgtgagccacggcgtccggccctggtcaggtttctttctattaaaacaaatataaagtggcagggcacgatggctaacacctgggatcgctttagccgaggag

SEQ ID NO: 83995 - DNA, 30 bp, Homo sapiens
  chr19:50326491-50326521
  hypo
cacaggcctgagctgcggtgccaagtccac

SEQ ID NO: 83996 - DNA, 124 bp, Homo sapiens
  chr19:50326993-50327117
  hypo
cagaagcttccccttcgcggtagctggaattcgtaggtaacacagagcagggtttctcatccttggccctagtgacactgtggacacagtcattccttgtagtgggggccgtcctgggtattgt

SEQ ID NO: 83997 - DNA, 45 bp, Homo sapiens; identical to SEQ ID NO: 45981
  chr19:50331949-50331994
  hypo

SEQ ID NO: 83998 - DNA, 432 bp, Homo sapiens
  chr19:50353152-50353584
  hypo
aacactgatgactcccgaatttctctctccaggctatgacatcaatatctatctacattgtttagtcaacatccgaaacagaagtagggactccgtctctaacctcctacagctgtgtctatttctcctctctaccttcactcgactccgcccacactggctcccttttattccttctactttcaggatttgtctttgctgttctgtcctctttgcacacttttccagccatctggaatggcaggttgctcacaggtcgttttcttgacttcccttgcttgctaactttacctcgctatggtcatatcccatcgccctgtggatgtgcgctagttaacacttagcacagcctgtgattatgtctctccccagtggaccgtggggcctgtgagggacgtggtctgattcggtcgtcgccgagcacagaactgg

SEQ ID NO: 83999 - DNA, 30 bp, Homo sapiens; identical to SEQ ID NO: 45983
  chr19:50362485-50362515
  hypo

SEQ ID NO: 84000 - DNA, 389 bp, Homo sapiens
  chr19:50364773-50365162
  hypo
ggaacatcagaggggcggcaggcccaggggtcaggggaggaggggggtcagggggtgcagcccggggggtgtccgggctgagcgggctcacccggttgttgtggcgcgcctgctccagagtggcggtgaagaggaagcagcggcaggggacgcccgcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcctggggacacgagaggtcacaaac

SEQ ID NO: 84001 - DNA, 63 bp, Homo sapiens
  chr19:5037561-5037624
  hypo
gtctccagaaagagccggcgctaagctggactgtcctttccttgggaccggcctcatcttggt

SEQ ID NO: 84002 - DNA, 30 bp, Homo sapiens
  chr19:5038391-5038421
  hypo
gtgaggcgtgtactccggatagccctggtc

SEQ ID NO: 84003 - DNA, 75 bp, Homo sapiens
  chr19:50387489-50387564
  hypo
cctgtgcccggtccccgcagaaagggatgtgagccgcactgacaggaccaacaagttctacgagggtcccgagaa

SEQ ID NO: 84004 - DNA, 111 bp, Homo sapiens
  chr19:50393297-50393408
  hyper
cccaacgcttgacgacgccggtgccgtcccagagctggcgcacgacaggcccgtgcaatgccgccacgtcgtcgagcgccaagcgcaacgcctcttcccggctcaagccgg

SEQ ID NO: 84005 - DNA, 41 bp, Homo sapiens
  chr19:50393536-50393577
  hyper
cgccagaagggcctgcggaagcttaggaacaccttggtggc

SEQ ID NO: 84006 - DNA, 215 bp, Homo sapiens
  chr19:50393796-50394011
  hyper
ggacagcgagctcagcagcgcgcgcggcagcaggtcccagccacccacgatgcggctgtacctgcaggcggggcggggcggggtgggggcgtgacctgggctctgcggccctgcccctctgccttgccccacccaccccggcagctggcccttatgggcaccggcccgctcccccgtcatccacctctcccgaccccgcccgtccctgacatccc

SEQ ID NO: 84007 - DNA, 212 bp, Homo sapiens
  chr19:50394919-50395131
  hypo
ctcctccgatattaccgaactgttaacgccgcccatcccccctcattcggctggcccggctggtcacagctcatcccggttgcgtgttattttgcctatttttcagccagccagccagactgtgagctccatggaggcagggatgtgggcagctggagaggagactgggagagggtcccaggcgtgctgtgtcctcccgggggctcagtgat

SEQ ID NO: 84008 - DNA, 142 bp, Homo sapiens
  chr19:5041033-5041175
  hypo
gagcagagcccctcccgcctctttcatgggtgccctgggttccaggtggctgagggtgggctgcgtagcacccaggcctcaccctgagctggttttggggtgtttgttcaccaggtactgtaccccgcggcaccaggacttt

SEQ ID NO: 84009 - DNA, 30 bp, Homo sapiens
  chr19:50441485-50441515
  hypo
aatagtgcttggcctcgctgtgccttggtt

SEQ ID NO: 84010 - DNA, 200 bp, Homo sapiens; identical to SEQ ID NO: 45651
  chr19:5046161-5046361
  hypo

SEQ ID NO: 84011 - DNA, 30 bp, Homo sapiens
  chr19:50475206-50475236
  hypo
ccggtggggacagaccgtgggcccctccca

SEQ ID NO: 84012 - DNA, 30 bp, Homo sapiens
  chr19:50477609-50477639
  hypo
gtcctgagaaatgcacggttaggtgattct

SEQ ID NO: 84013 - DNA, 51 bp, Homo sapiens; identical to SEQ ID NO: 45986
  chr19:50481531-50481582
  hypo

SEQ ID NO: 84014 - DNA, 438 bp, Homo sapiens
  chr19:50553997-50554435
  hyper
tgggggcttggacctcggatcggcctcccacgcgaagcttgctccccaccagcatccccacgttggtggcgacgctgccccggccccacggatacttccgcgcctgtcagactccctgatgaactacccttcccagagtaccgcgggagctcgggctcctgagggcgacggtcctctgatggcagatgcgggagaaactctggcgtcaggcggccctcgcgtggagcacacgaagtcgtggcttattctggcttcagtatgtggggtggagaaggcgatccacgcagctgcgtctatttcctgtggatcaatcgcaaaatacgttctgtaagccccgcccccactgcgtgcgggcggcttttgtctccacggcaaccgtcaactctggaaacgcctgtctttctccatggcaactgtctacgccgcaggctggagctg

SEQ ID NO: 84015 - DNA, 30 bp, Homo sapiens
  chr19:50578991-50579021
  hypo
gacccttgttctcgccgtgaatgtcaatgg

SEQ ID NO: 84016 - DNA, 30 bp, Homo sapiens
  chr19:5058670-5058700
  hypo
gctgagtcctgtctgcggcccctcgctcac

SEQ ID NO: 84017 - DNA, 30 bp, Homo sapiens
  chr19:5064302-5064332
  hypo
ctcattctgtgtctgcgatgatagcgcatt

SEQ ID NO: 84018 - DNA, 30 bp, Homo sapiens; identical to SEQ ID NO: 37635
  chr19:50651036-50651066
  hyper

SEQ ID NO: 84019 - DNA, 30 bp, Homo sapiens; identical to SEQ ID NO: 37636
  chr19:50651328-50651358
  hyper

SEQ ID NO: 84020 - DNA, 30 bp, Homo sapiens
  chr19:50694460-50694490
  hypo
aaaaaaaaaaaaaggcgagccagatttccc

SEQ ID NO: 84021 - DNA, 30 bp, Homo sapiens; identical to SEQ ID NO: 37637
  chr19:50706864-50706894
  hyper

SEQ ID NO: 84022 - DNA, 76 bp, Homo sapiens
  chr19:50762327-50762403
  hyper
attgccaagcttgaccgtttggcgcccccgtgtggccgccgctgacccccgcgtgtccgtccgctctccccaggcc

SEQ ID NO: 84023 - DNA, 758 bp, Homo sapiens
  chr19:50815293-50816051
  hyper
agcttctgcattgggcggttcatgcacccagggtgggcgtgggggaggcttggggaaggggccacgccgacccctccctccctgccctgcgggtgggctgagaagacccgccattagcaccagagttggacgatttgcagacctcccctccccacactgtctccgaaccccgcccccatccctgagagcgccccctcaccactccccccaccagcgacaggctaggcccgccccgcccacatttgagtgagagaaacttattgctctgtgtgtgtgtgtgtgtgtgttggggagggtgagccgcggagctcaggaagaccccccgccattcattcctccccaatcgccccgccccctggcccgtgtccgtgcgttcccggagcgcaggaggggtgcgacatgcgtgtggggggcgcgtcatgcagcgcatgcgtgtaggtgcaggcaccctggcggccggggggaaaagggggagccggacttggaaagagtccctttagctcgctctctccctccccgaatcccacactattgacttgggggatggggtgggaggggaggagaatcacgttttgtagaagtttatcatgattgtggttattttgaaaagctgaactcaaaagctgggtacgtgtggcggactggcgagcagggggagacgttgggaagaggtcagtaccctttggaaaagaccctcaccccctttccccgcctccttcggctttcgtgaaggtcaggggaaacgggggggcttgtta

SEQ ID NO: 84024 - DNA, 53 bp, Homo sapiens; identical to SEQ ID NO: 13470
  chr19:50816431-50816484
  hyper

SEQ ID NO: 84025 - DNA, 30 bp, Homo sapiens
  chr19:50817841-50817871
  hyper
ggatgtcctatggctcgtggagacctgaga

SEQ ID NO: 84026 - DNA, 37 bp, Homo sapiens
  chr19:50818167-50818204
  hyper
gggggtggcaaggggcgcgaggcgcagggacaccccg

SEQ ID NO: 84027 - DNA, 734 bp, Homo sapiens; identical to SEQ ID NO: 37641
  chr19:50818424-50819158
  hyper

SEQ ID NO: 84028 - DNA, 149 bp, Homo sapiens
  chr19:50829560-50829709
  hyper
cacaggagagaagggcgccccggccatgggggaaggagccgctcagtgtcttgagggggcatccagggccatgtcccttccgcacctcctcttccccacctccccccatccaaccccaaatctcgccaactcagcgctttctggggacc

SEQ ID NO: 84029 - DNA, 636 bp, Homo sapiens
  chr19:50831403-50832039
  hyper
ctgggagactgggggcgcctggagaggcgggggtggggtggatgggggccccgagagcgcgctcaccctggcagcccgcgacgagtaggggtcctcgaagagcgcccacacgcggggctgccagcggcgccaccatgtgccgcccgcgccgcccgcgccccctggcggccccccggcgccgccgcccgcgtcctggaagcagaggcgcttgagctcgccgcccgctccgtccaggccgccgccgcccgcgcccgcctcgtcgtccaggcctccgtcgtgggcgcctgcggcgttggcggcgttggcggcgcccgcggggtcgggcgcctcgaaggagtcgagcgcctcctcagcgtcgcgatgctgccggtaggtcatccagcagcaggcctccacgtcggtctcgtcgatgccccagaagccgagctcctcctcaaacaggggcccgcacacgtcggctgggcagtgcagcttgccggtgcggtagtagttgagcacgtacgcgaagactcccgggtgccggtcaaagaagaactcgtcggcgcccgggtcgtagtcgaagcgtgccgccgcctcgggctccgtcaggccggccagccgcgtccccggcagggtgcgcagcgtcgagcggtacgt

SEQ ID NO: 84030 - DNA, 83 bp, Homo sapiens
  chr19:508329-508412
  hypo
cctggaagagcctggcgatgtgcgggcgggttgcagggaagaggcccagcaggtgcaaatttagaccccgagtgtggggcaca

SEQ ID NO: 84031 - DNA, 91 bp, Homo sapiens
  chr19:50832951-50833042
  hyper
tgagactgcatggggcgggaactagagatggaggactttcccgcgcaagggggacaggctggactgaaagaggacacgggaagaacaaaga

SEQ ID NO: 84032 - DNA, 142 bp, Homo sapiens; identical to SEQ ID NO: 37645
  chr19:50833828-50833970
  hyper

SEQ ID NO: 84033 - DNA, 100 bp, Homo sapiens
  chr19:50836291-50836391
  hyper
caagtaccttggccccgaaagctcagagtcgaggggaatctccccgctataatctttgggtccctggatcccaagtcccccgtctccaaaactaggattc

SEQ ID NO: 84034 - DNA, 59 bp, Homo sapiens
  chr19:50836392-50836451
  hyper
ggctgtcttaccgcccccggaccctgagccttcgccccctcccccgtactcaccccaag

SEQ ID NO: 84035 - DNA, 350 bp, Homo sapiens
  chr19:50837039-50837389
  hyper
caacctaggcaggttcgttcaatggaaatattggatttttactgagtagcgctagctctgctacccggtgcgcatgcgcatcacctgggcggcacccgcggtactgcgcctgcgcggtctcgcgccttcccaggtccgctccgcgagggcgagcgcgcgccagtcccactcgtgcgccgctcttcatgtccccgcggtcgaagacggtcacatacgcccccaagaaaacgtcgccgaggatccacacaggtactggaggcgaagcgatgtccaaggcccggaagccggacaagcagaggcggacgtcaccctgagcaaactgcaaggcgacaaggcggcaactgggtgtc

SEQ ID NO: 84036 - DNA, 306 bp, Homo sapiens
  chr19:50919769-50920075
  hypo
gaggctgtgctactgcgtacgggggcaccaggggactgggggcaccctgggggggcagaggagatcaccggcccaccacctgcctcctctcctgcagggggggaccacacgcgctgcaagacggtgctcacgggcaaggtgggcggcctcctggccttcgccaaacgccgcaactgctgcattggctgccgcacagtgctcagccaccagggtgagcggccctggccactgggcccccactggccctcaacctgctctgccgtcaccccagatcctagacacccaccccatcggctggcactgcca

SEQ ID NO: 84037 - DNA, 95 bp, Homo sapiens; identical to SEQ ID NO: 45988
  chr19:50926491-50926586
  hypo

SEQ ID NO: 84038 - DNA, 170 bp, Homo sapiens
  chr19:50938552-50938722
  hypo
ccatcctcctcgctacgcctctccaggcctttccccagcctctatccttgaatctgtccccgcacagccccagggctgacccacgcctcccgtgctcccagccctcccggggctccctggcacccgcaggcagagcccagcccctcggctggcatcggctccggtcagct

SEQ ID NO: 84039 - DNA, 89 bp, Homo sapiens
  chr19:50947770-50947859
  hypo
ccaacaaatatttatcgagcacctgttgtgtggtgtactcttctacgtatcagagatataatggggagaaaaaaaatgtcaacatggcc

SEQ ID NO: 84040 - DNA, 104 bp, Homo sapiens
  chr19:50967770-50967874
  hypo
tgcaagctggaggtccgaggtgagggcgtggccatccccaacactggctgacccttgctcgggccctgtgccagcctggccggtggccccgggctgagcaccgc

SEQ ID NO: 84041 - DNA, 30 bp, Homo sapiens
  chr19:50979216-50979246
  hypo
acgaagtctgggggtcgatcctgggaggct

SEQ ID NO: 84042 - DNA, 100 bp, Homo sapiens
  chr19:51022774-51022874
  hypo
cgtgctgtgctgtgacggtacgacctatattgcaacatggtttgatgagtttcttataaagttaaaactggagtcaaggctgggtgtggtggctcacgcc

SEQ ID NO: 84043 - DNA, 30 bp, Homo sapiens
  chr19:5102740-5102770
  hypo
gtgcagcacccgccccgcccataggagagc

SEQ ID NO: 84044 - DNA, 183 bp, Homo sapiens
  chr19:51046349-51046532
  hypo
atccgggcaggagttcgggagctggcctcccattcagaggcaaacaactgctgggcacctcctgtgtgccaggctcggccctaggtgctggggatccggcagggaacattgcaaagtccctgccttcatgcaggtggcagcgcggcgggggacagatgacaaccaaggcggcaggtcacacgg

SEQ ID NO: 84045 - DNA, 45 bp, Homo sapiens
  chr19:51049613-51049658
  hypo
caaaaataaagagcctctgattaccctcgacgtggtccatgcctc

SEQ ID NO: 84046 - DNA, 30 bp, Homo sapiens
  chr19:51051953-51051983
  hypo
cggcggcagacgtcacggccactccacctc

SEQ ID NO: 84047 - DNA, 30 bp, Homo sapiens; identical to SEQ ID NO: 37649
  chr19:51055016-51055046
  hyper

SEQ ID NO: 84048 - DNA, 213 bp, Homo sapiens
  chr19:51071278-51071491
  hyper
ttggggtgcaaggcccgctgcggggaggcgcggggggcggggctgcggccgggcctggagcctctcgcgctctcccccctccccggctcctgggtggggagggggcttccgcagcggcggcggtggggctgggggggccgctctgcctcctcgcctcgcgcccgcctgccgtccggccccgcgccctcgcccgccgcccgccttccttcttgc

SEQ ID NO: 84049 - DNA, 56 bp, Homo sapiens; identical to SEQ ID NO: 37650
  chr19:51111640-51111696
  hyper

SEQ ID NO: 84050 - DNA, 33 bp, Homo sapiens; identical to SEQ ID NO: 45994
  chr19:51128766-51128799
  hypo

SEQ ID NO: 84051 - DNA, 30 bp, Homo sapiens
  chr19:51132785-51132815
  hypo
acaggagacagacaccgtgcccataagccc

SEQ ID NO: 84052 - DNA, 87 bp, Homo sapiens
  chr19:51142492-51142579
  hyper
gacccactgggagcccggccaccccctcccacctccgggcccccagctcccgttgagggcttagagactacaattcccggcaggtct

SEQ ID NO: 84053 - DNA, 171 bp, Homo sapiens; identical to SEQ ID NO: 37652
  chr19:51142587-51142758
  hyper

SEQ ID NO: 84054 - DNA, 277 bp, Homo sapiens; identical to SEQ ID NO: 37653
  chr19:51142834-51143111
  hyper

SEQ ID NO: 84055 - DNA, 46 bp, Homo sapiens
  chr19:51143316-51143362
  hyper
tgcttctccagggtccgggggcccagttctccgccccgctatctca

SEQ ID NO: 84056 - DNA, 230 bp, Homo sapiens
  chr19:51161225-51161455
  hyper
tctctctccgacacccgcagcccgaggaggattttacccacctggaggtgctgcaagccctggaggcccagttaccaggggccatggagagcgggcgcgtgagcagcatccgctttgagaacatgaacgtcatctgtgggactgctgggcgccggaaccggtgagtaagcggcgggggcggggcctggagcgagcgggaggggcggggcccggggcgaccgggtaagagc

SEQ ID NO: 84057 - DNA, 569 bp, Homo sapiens
  chr19:51161685-51162254
  hyper
agagccactgaggggcggggccaagagtgagcgcggttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccaccccccttacaggtggctcatcgcggtcacggacttccagacgcgctcgcgcttgctgcgctc

SEQ ID NO: 84058 - DNA, 576 bp, Homo sapiens
  chr19:51162427-51163003
  hyper
gcaccgccccgcgggctggggccacccacccggagccccggaggacagggggcgttgccttcccaggaaggaggcggggccggctcgagggggtggatactgtgagtttaattataaagaatgacctggtacaaaagccatttctctctgcaaaatcttggtggggagtcaggggaagggaggtgatggggggtaggaatgaacccccatgttataatcccgcgtccctaatcttcctccagtccctgtacgtggacgcctgggtcccaatcccttgagggatgaactgaagcccgcgaaagggaagacctgggcaccggggctttcagcgcgtgccgagccctgtctcagcgagaatcagacgtcctcatccgcccccctcctcttcccctcccacccccccttggaagacaattctcgggcttttatttcaggttttttttctggatttttttgtgtgttctaggggttttgtgttttttttttctgttttttatattttcttcttttgttattgttcctctttttgctttttctctcctctccaccccgcgctgtccccgcattcggtccctc

SEQ ID NO: 84059 - DNA, 39 bp, Homo sapiens
  chr19:51170699-51170738
  hyper
ctcgtcacaggggcccggggctggcagttttcaaggaac

SEQ ID NO: 84060 - DNA, 371 bp, Homo sapiens
  chr19:51170905-51171276
  hyper
cgggctggcgggaagggacttctcctggctgcccagcccggccctgtaccccagctcccggcgcgcagggtccggcggggaggccccccagagacgcagcactggctcgtggtgggcgtggggcgagtggtggtgcggggtgggcggcggggcctcgtagcggggcgatgggggcctgggaggcggctggggggccccgccgccctccgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccc

SEQ ID NO: 84061 - DNA, 357 bp, Homo sapiens
  chr19:51197437-51197794
  hyper
tctctcacacacacacgcacacacacgcacgcggctgcaggcagtcacacacacgcacatcgacacagccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcgctaagggcggcagaaaggcgagtgggctccaaa

SEQ ID NO: 84062 - DNA, 96 bp, Homo sapiens
  chr19:51198175-51198271
  hyper
cgctgcgccgccggggccccagggctggccagctggaggacagcgcggggggcggctgcggcagggagctcccaccggggccgcccccgagacccc

SEQ ID NO: 84063 - DNA, 689 bp, Homo sapiens
  chr19:51198505-51199194
  hyper
cggggggcgcgggggcgcggggcgcggggtcgggccgcggcggtagcgcgaggaccgcggacggcgccggcttcagcaccgcggacagctccggaggcgggcggcgggcgcgaggcttaaccccttggcgtcctgcgccgggcggcggagggggccgggcaggggggagggggccgggaggggaacgcgggggcccccttggcgggagaagggggaggggcgaggcttggaggggggaggagaaggggaggcacttccggtctgggcccccccttaatccccctcccccctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggcacacgccaggaggggagacacacggaaggaccgcccagctccggca

SEQ ID NO: 84064 - DNA, 82 bp, Homo sapiens; identical to SEQ ID NO: 45995
  chr19:51203231-51203313
  hypo

SEQ ID NO: 84065 - DNA, 78 bp, Homo sapiens
  chr19:51211065-51211143
  hypo
gagtctgtgtatgcccgtgctgctggccaactagactgttaactcctgccatgtgtacttttgcgtgtttttcttttc

SEQ ID NO: 84066 - DNA, 69 bp, Homo sapiens
  chr19:51222519-51222588
  hyper
gctccccacctcacccgtacccccagccgcacacccaggccaggagcccggcgccgggccaaggacatc

SEQ ID NO: 84067 - DNA, 667 bp, Homo sapiens
  chr19:51227602-51228269
  hyper
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccc

SEQ ID NO: 84068 - DNA, 271 bp, Homo sapiens; identical to SEQ ID NO: 4679
  chr19:51228368-51228639
  hyper

SEQ ID NO: 84069 - DNA, 107 bp, Homo sapiens
  chr19:51228702-51228809
  hyper
cgtctgcgagttccccttctagcggggccggtaccccgcctccctgcccatcccaccacccggcctttccctgcgccgtgcccaccctcctccggaatctcccttcc

SEQ ID NO: 84070 - DNA, 27 bp, Homo sapiens
  chr19:51250646-51250673
  hypo
cagcctgggtgacggagcaagactctg

SEQ ID NO: 84071 - DNA, 85 bp, Homo sapiens
  chr19:51269827-51269912
  hypo
cgacttcgacatgcccgtatccagccagaaacccctctgtaatttttttttttttgagtcttactccgtgacctaggctggaggg

SEQ ID NO: 84072 - DNA, 30 bp, Homo sapiens
  chr19:51274279-51274309
  hypo
ctctgtcctctaccccgtctgggccctgaa

SEQ ID NO: 84073 - DNA, 30 bp, Homo sapiens
  chr19:51281105-51281135
  hyper
ttgccgtgggtggggcgcttggctccgtgc

SEQ ID NO: 84074 - DNA, 328 bp, Homo sapiens
  chr19:51281335-51281663
  hyper
agaaaagtgggatcccggggaggtttttaatttgcattgattttctaatgaatgcggttcagcattcttccaaggaggctctgcggtttttagagctggctgcaggatcctccctggggagacgtggtctttgctggggcagagccaggcgcggtggtggaggtgggtttgagtctcggggagcgcgcgggagctgggcacggccccgtgcttgagaggatctggcattttcctgggcagcctcggcgagagagagtcgtggaaggtgagttaagcctccggattatactctgccaagcagggactaaaaattcgtatccaacagaat

SEQ ID NO: 84075 - DNA, 30 bp, Homo sapiens
  chr19:51295128-51295158
  hypo
cgcctgagctggctccgagaagcaagactg

SEQ ID NO: 84076 - DNA, 93 bp, Homo sapiens
  chr19:51295373-51295466
  hypo
gctgcgggaggccaccgaggccgccgagtaccaggaggccctggagggctggacggtgagcagggcggcggtggggggcgggatgcaggggat

SEQ ID NO: 84077 - DNA, 30 bp, Homo sapiens; identical to SEQ ID NO: 45996
  chr19:51304561-51304591
  hypo

SEQ ID NO: 84078 - DNA, 48 bp, Homo sapiens; identical to SEQ ID NO: 45997
  chr19:51340799-51340847
  hypo

SEQ ID NO: 84079 - DNA, 138 bp, Homo sapiens
  chr19:51412508-51412646
  hyper
tctggaaacagtgtgcggctgacagcacccactgcggatgcaccaggacgcccgagcagaacaattcgttttccatgaccagtgccgcctgccagggctgcgagtgcgggctgcagtcctcgccgtttatgatttggc

SEQ ID NO: 84080 - DNA, 30 bp, Homo sapiens
  chr19:51413099-51413129
  hyper
ggtgggctgagaaggcgggatcagtgctcc

SEQ ID NO: 84081 - DNA, 30 bp, Homo sapiens
  chr19:5142538-5142568
  hypo
ggcaccagcctgccccggggctgggtttct

SEQ ID NO: 84082 - DNA, 33 bp, Homo sapiens
  chr19:51451909-51451942
  hypo
tacctgctttgtcaccggcgcagaacatggtgt

SEQ ID NO: 84083 - DNA, 30 bp, Homo sapiens
  chr19:5148235-5148265
  hypo
gccgccttcagaactcgccctgtggagact

SEQ ID NO: 84084 - DNA, 354 bp, Homo sapiens; identical to SEQ ID NO: 37669
  chr19:51520138-51520492
  hyper

SEQ ID NO: 84085 - DNA, 210 bp, Homo sapiens
  chr19:51520740-51520950
  hyper
gctgggatagggtagcgtggagtaatgagacagaatagggtgggtctggagggcagggactgaacgcagcgcgcctggagagctggctagaacgtcgctggtcgatagaggggcggggattgaacgcggcggggaggtaagggtgcggggatagaactcggggatcggggagaggaaggggtgtgaataacaaaacgggattgaaaacca

SEQ ID NO: 84086 - DNA, 643 bp, Homo sapiens
  chr19:51521998-51522641
  hyper
atggagcggggccgggatggggcggcgtaagaggaggagaaagaacgcggcgaagagtccacggaagagcgaggatccgggtggcagaaatcggacagggcctgagtggggcgggtcacccaggggccgagccagaagaagggcccagctgacttgggggcgggccgtgctccggagcgctgggtgggtgctggggtctcgggggaggagaggtgcgcggggcttggtgacgggaacacattctcctcccgcccgtgcctcccaccggcgcctctccccgccccctgcccccgaccttaccccagagttgcgccatcagcagcggcagcagcttcgccagagcccgggcgccagaggcggcggagaggtggaggtgcggagctctcatggccaggatctgctggggtgtgtgcaggggcgggttaaaacagatgctccgttagagacccccacctcgccgcgctcatccgcccagcctgggccaccccagcccgcaagcacccttttgacctgcagccgataaccccaggggctggcagacgggagattcgggctggaacagcggtaatgggcacaattaccctaatgacgcccctcgcggcatcttcccgtcctccctgtgcccgagtggagcgctctccgc

SEQ ID NO: 84087 - DNA, 293 bp, Homo sapiens
  chr19:51522642-51522935
  hyper
ccccagctaccctggctgcagccacgccgcgcccgaggtttccccctccttcacgcgcggggtggggatccgaggctcggagccagtgggagcctctttctcaacctcacagcggggggacttccgcgtcccgcaggtggagaaaccgaggctctaagccggctcctgcctgtggcccgggggtccccacccatcctctcgcaatccaccccaacccgggtggggtgcaggtagcttcacctgggagtcgccgataggaaggagggaggggacccagacgtgcctctgccctg

SEQ ID NO: 84088 - DNA, 90 bp, Homo sapiens
  chr19:51523176-51523266
  hyper
tttggaactggcttccgtggggattctccgggtcccggtgccaagaaggcttcccaggcgcggggagagggttcacgtccccagcaaggc

SEQ ID NO: 84089 - DNA, 105 bp, Homo sapiens
  chr19:51535305-51535410
  hypo
gggtcacagagaagccgctgtgccggatctgctcggtccagtcgagctggctgaggctgtgttcccccaggcgcacccagtacctgctgccggtggcgacggctg

SEQ ID NO: 84090 - DNA, 296 bp, Homo sapiens
  chr19:5155117-5155413
  hypo
tctggggtgcccccccgcccgccctaggccctgtgaggtcagcgtccctgggcctccccaagctggcagaggggccgtggcaggagcaggtggtgcctgcagcgtcctttccattgttctccaaaacgctctaaaacgggaaggctatttgggacaggctgttgctgtctgccgagcagagtaaagatgagtggataggtccccaaaagtgtcaccgtgcggagccgatgaggtctgcactcgggccggggtgggtgccccgatgccgaggtctcgtatctcggggcagtgtgtga

SEQ ID NO: 84091 - DNA, 642 bp, Homo sapiens
  chr19:51568062-51568704
  hyper
tgaagggtctggggtcggagggccaacctcagccgggaaaccaggtcacccagggacaagcaggaagagctctgagctgtccccactggacccggccccgagtgggcggggggcggagctcgcggctcccacgccccctccccctccggcctgacccctcctaccattgtcccgaatggccgccgcgcctccacccccgcgcattcttacctcctgacaaggccaaggtcagggaggcgatcactagggccaggggccacatggctccgggatcgggaggggagggcagggcgggcggggcctgaggagaaggtgaagggggtgttgagggcgtgcccggaacctccgcgtctgaaacctctctgctcctgaatgtctcctcgcctcattcactcttgacagccctgaccctggaatctgccccccgcctccaattccatccttggtgggggtgcagtggcgaggtgggaggaacagtgtgcaacctcctggggctccggcgtgcagcccctcaccccaggaagccgtccctcctcccctgccctctggcgagctgggtggtcggtgcactctcgcccttttcctccagagtctgccttccattctacccctctgggtctgtccacacgcttggtattagcc

SEQ ID NO: 84092 - DNA, 150 bp, Homo sapiens
  chr19:51684620-51684770
  hypo
taaccgtgtgactagcgactgagtgccttacaggggacgacctcctaagaggctgactggcaggagcccagctaactgctggccagggcaggccgtgggggcgcgttacctgattgtctgaggaactggctggcgcggggactgacgctg

SEQ ID NO: 84093 - DNA, 36 bp, Homo sapiens
  chr19:51688376-51688412
  hypo
ctgctccctgagcatcggagacgccaggaggaagga

SEQ ID NO: 84094 - DNA, 30 bp, Homo sapiens; identical to SEQ ID NO: 45999
  chr19:51715131-51715161
  hypo

SEQ ID NO: 84095 - DNA, 95 bp, Homo sapiens
  chr19:51754542-51754637
  hypo
tgggcttccagtcagcgtcagtcagcggatccttgggccgtggggcagccgcaggtcggttaggccaccagggcggctctcgtgccagtgaggcc

SEQ ID NO: 84096 - DNA, 30 bp, Homo sapiens; identical to SEQ ID NO: 37672
  chr19:51814766-51814796
  hyper

SEQ ID NO: 84097 - DNA, 176 bp, Homo sapiens
  chr19:51815099-51815275
  hyper
cgatgcccccccctgcgcccggggcccggctccggcttctcgccgccgccgccctggccggcttggccgtcatcagccgaggtaccgcagcgccgggggcggggggctcggccgggacgccagggtcttgggtgggtaatcgggggatcaggggtgggggtcgagggctgcatccc

SEQ ID NO: 84098 - DNA, 166 bp, Homo sapiens
  chr19:51830260-51830426
  hyper
ggcgggggctgggggcgggaccccttcgtccccacgcggctaggagaattcgctgacccttgcccctcgccagatcctccgaccatcacggacgtgaccagcgcccgcaccgcgctgggccgggccgccctcctgcgctgcgaagccatggcggttccccccgcgg

SEQ ID NO: 84099 - DNA, 244 bp, Homo sapiens
  chr19:51830759-51831003
  hyper
actaggggtgcactacgggagagtccagagtcctgagaggccagggtgcctggaggggggcggcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggc

SEQ ID NO: 84100 - DNA, 270 bp, Homo sapiens; identical to SEQ ID NO: 1395
  chr19:51831120-51831390
  hyper

SEQ ID NO: 84101 - DNA, 126 bp, Homo sapiens
  chr19:51843467-51843593
  hyper
ggtcacgttactgcccgcggtgacaaagcgggcaggcgcggcgtcgcggtccgaggagaccgtgatggtcggcgggtccgggccgtctggagggaggaggggtcgggaccgcgagtgtcagggtca

SEQ ID NO: 84102 - DNA, 45 bp, Homo sapiens
  chr19:51843801-51843846
  hyper
tgagcgcatccggggcgtctcggctccctccgattccgccgcctc

SEQ ID NO: 84103 - DNA, 30 bp, Homo sapiens
  chr19:51857522-51857552
  hypo
catccgtgaccacaccggtcctgtcaggct

SEQ ID NO: 84104 - DNA, 60 bp, Homo sapiens
  chr19:51914569-51914629
  hypo
ggtggaagaggggtccgaggactgtttggtgtggctttctgattccgcttctgagcctga

SEQ ID NO: 84105 - DNA, 30 bp, Homo sapiens
  chr19:51918050-51918080
  hypo
accttggcatccaggcggccccctaacctg

SEQ ID NO: 84106 - DNA, 137 bp, Homo sapiens
  chr19:51950127-51950264
  hypo
ttatgtgtctgtgcacgtgtgcacgtgcatgcctgtgtcaaaattgggagtgttgcttaggcagtgtaacgtttcacagttgtgtgcagcaaacaagctggtttttagaaactagcagccagcgtttcagggaggag

SEQ ID NO: 84107 - DNA, 240 bp, Homo sapiens
  chr19:52058092-52058332
  hypo
cataggaactggtggcgacatcagtgaaggcctctctgggcaacttccggttcacattggcgtccaggcgtgatttcttcagcatgtccattgacgcgcatgttcaatatcacttttggagctatgctctgcagatagttatcatggtgtaacgcggtggagggcgtgtccgttatttccattgtaaacttttcttcagcggctttgtcaggagaacaacatggtcgtgcccagatagag

SEQ ID NO: 84108 - DNA, 256 bp, Homo sapiens
  chr19:52074277-52074533
  hyper
ttgtccttggctgtacggaataaaagccctttgacgatggcggcctccaatatcataatccgtatgggtgcggccatgccgtcctccctaccaagtttctgaagttgaatgaaccgcggaataaaggtacgccgttatacgccatgataactgttggcggagcgtagcttcaaaagtgttagtgggcatgcgcgcggttcaacagcgcctacggaaatcctaacgggaatgtaacccaaaccggaagtggcctaga

SEQ ID NO: 84109 - DNA, 84 bp, Homo sapiens
  chr19:52077608-52077692
  hypo
caaatatttaaaagtcgttcttaaaagaaaaattgaaacatacaagtttaggtggggcacagtggctcatgcactttgggaggc

SEQ ID NO: 84110 - DNA, 30 bp, Homo sapiens
  chr19:52079361-52079391
  hypo
gtaattgcaaaccctcgctatttcagggac

SEQ ID NO: 84111 - DNA, 30 bp, Homo sapiens
  chr19:52079718-52079748
  hypo
atcctcataactttgcgaggtactgctgcc

SEQ ID NO: 84112 - DNA, 16 bp, Homo sapiens
  chr19:520802-520818
  hypo
ccgtctcaaaaaaata

SEQ ID NO: 84113 - DNA, 25 bp, Homo sapiens
  chr19:52081316-52081341
  hypo
aaagttaactactttcgtcactttt

SEQ ID NO: 84114 - DNA, 120 bp, Homo sapiens
  chr19:52081641-52081761
  hypo
aaactccatctcaaaaaaaaagaagcaagccccagaatgggaaaagattcttgttacacatacagctgacaaaaggttcctataaaacgttgaggacggctgggcgtggtggcttatgcc

SEQ ID NO: 84115 - DNA, 22 bp, Homo sapiens
  chr19:52086395-52086417
  hypo
ccgtgcccggctatgggcatct

SEQ ID NO: 84116 - DNA, 40 bp, Homo sapiens
  chr19:52091303-52091343
  hypo
ttcaaagagcatcagcgaattcacacgggtgagaaaccct

SEQ ID NO: 84117 - DNA, 703 bp, Homo sapiens
  chr19:52097245-52097948
  hyper
agaaagacgattgtgcgtaactgttcaccgcgtccacgtcccgagagttgcgcacgcgtggagatctgcaaaacgctccctttcagctccgcgcatgcacagagaccccaccccgcaagtccttgcccttcggcctgggcaggcgtccactcccatggctgcagggcgcgccgaagagcccactctgcatccccgagacgcggcccaatcctaggaatgtgcttagcgcaggtgctatcttcccttttcacattcccaatctctttctccgccccctcaaactcttgccatactcccacaacagcagaaaatctgaaaaaaaagtccatcccatctttgcactgacagcagtgcacagcagctggcagagaattctggcacggctattgtgcttgcgcaggcgcagacgggaagcgggccggaccggcctagtacactctgggaggcgtgcgcagaatgcgcagcgctgccgcgaggatctctgggaactgtaggcccagtttgtccgagagccgcaagtgtttcgggacgacgcaacgcaggggcacctgggagtcgtaggcggatgggcccaaagccttccgggagtcgtagtccttccgcccgctcctcgtttctttggaggttggcccttccagctccagttctgcccaggtgagcgcccatcccgcggccggccggtcctggccctttgtcgcgatga

SEQ ID NO: 84118 - DNA, 42 bp, Homo sapiens
  chr19:52097998-52098040
  hyper
cgtccctggaaagatggcacccttttccgtgatctctcaatc

SEQ ID NO: 84119 - DNA, 34 bp, Homo sapiens
  chr19:52102053-52102087
  hypo
tgtagacaagggcatcgggcgtggcttagcggga

SEQ ID NO: 84120 - DNA, 27 bp, Homo sapiens
  chr19:52104552-52104579
  hyper
aggggggtgcccttccgcgctgccgcc

SEQ ID NO: 84121 - DNA, 143 bp, Homo sapiens
  chr19:52205697-52205840
  hyper
gctcaggcttggccccggccccaggtggaacccagccggcttgaccccgcccccaggttatgacgaaagcttggccccgccccctcggagcaatgcttcgggccttgtaacattagctaggggagcatcgggcaagggttctt

SEQ ID NO: 84122 - DNA, 721 bp, Homo sapiens
  chr19:52207085-52207806
  hyper
taggggtaggttatgcgtaagggtttaaggagtgaggggaaggggtgcgtttagggcaggggagcgagaaggctcgggggcgggctcaaggctcagggccaggactccagggggcgtggtctggctcggggggcggggcttgtaggttactcagtggcaagccggagttgaggcgtttaaacccgcgtgtcccgcagctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctggggactccggagccccagcatctagctccccgctgtctcagatcccaccgagaagtctgggtt

SEQ ID NO: 84123 - DNA, 30 bp, Homo sapiens
  chr19:52217139-52217169
  hypo
cccgcgtagaacagacgcagcacagtggcc

SEQ ID NO: 84124 - DNA, 494 bp, Homo sapiens; identical to SEQ ID NO: 37681
  chr19:52222430-52222924
  hyper

SEQ ID NO: 84125 - DNA, 31 bp, Homo sapiens
  chr19:52223142-52223173
  hyper
cgcgtcctgctgggagcgagaggggaaagga

SEQ ID NO: 84126 - DNA, 105 bp, Homo sapiens
  chr19:52248329-52248434
  hypo
cttcagctgacatctcgataactttatatttttactgagttgttgaccgataaaggctgaggactttatataaagtatcttctttttttttttttctgagccgga

SEQ ID NO: 84127 - DNA, 45 bp, Homo sapiens
  chr19:522927-522972
  hypo
actgggcaccagctgcgatgcctgcgctgacggcagctcctgctg

SEQ ID NO: 84128 - DNA, 30 bp, Homo sapiens
  chr19:52355375-52355405
  hypo
cagtagaaactggaacgaccaggagtccca

SEQ ID NO: 84129 - DNA, 274 bp, Homo sapiens
  chr19:524057-524331
  hypo
taaatcctggacacccggacagggacgcagggcacggaggcttccaggagtgaccaatcagaggacaccaaagctggtcccagggtgcacctcacactccgccccggtcccttgaggccaaggccgaccgaagcccacctcccctgccccgcccagctccccggggcctcccctgatccctgaccctgtgccgcccactgtgcccgccctcaggtcccgaggaccccgtctgtcctaatcccggcatgacccttaccagcgcagcccggaagct

SEQ ID NO: 84130 - DNA, 214 bp, Homo sapiens; identical to SEQ ID NO: 37683
  chr19:52408028-52408242
  hyper

SEQ ID NO: 84131 - DNA, 251 bp, Homo sapiens
  chr19:52430054-52430305
  hyper
attggattccttttccggttggctggtggctgctctctttacctgcactgggcggtgaccgtgtccctcaaatgtaaatgaggttccaggggtcgctgttttttcactttccgttgacggggtgaacaatatcctcgtacctcgattgcctctccacacccttttggtcctcaaaaatcttcctcttgtcctccacatgtagctagatgcgttttcgcggtatatgactcagggtgcgattgctctttttc

SEQ ID NO: 84132 - DNA, 83 bp, Homo sapiens
  chr19:52430563-52430646
  hyper
gtccactttaccttccgtacgtgcaggattcaaagatggctgcctccagtatccgtgacgagaggacgcgaacttactacctc

SEQ ID NO: 84133 - DNA, 18 bp, Homo sapiens
  chr19:52431077-52431095
  hyper
aaactgtgtctgcttcgg

SEQ ID NO: 84134 - DNA, 17 bp, Homo sapiens
  chr19:52456101-52456118
  hypo
ggggggtcagccccccg

SEQ ID NO: 84135 - DNA, 30 bp, Homo sapiens
  chr19:52489503-52489533
  hyper
ccagtaaccgaggttcgaacctcaacccag

SEQ ID NO: 84136 - DNA, 88 bp, Homo sapiens
  chr19:52490149-52490237
  hyper
aagagcaaggacaagcgcatttacggcatttcctactctgtaaaatggccgcgcccatagccgtggctcctgacggcagccatgtttg

SEQ ID NO: 84137 - DNA, 76 bp, Homo sapiens; identical to SEQ ID NO: 37685
  chr19:52511308-52511384
  hyper

SEQ ID NO: 84138 - DNA, 143 bp, Homo sapiens
  chr19:52512030-52512173
  hypo
gtatagttcccaaggcggaggggagagcctgggacccaggtggagccaaatatgagggctggactcaggagaagtggccagaaattaagggaacaggaccacttcagtgagaaaaaaaaggttgggaaagaggccgggcgcgg

SEQ ID NO: 84139 - DNA, 525 bp, Homo sapiens
  chr19:52531359-52531884
  hyper
tacagccaaaggacccgtcattaacgccccgcttcctcagcgactgcgttcaaatacagccccaatcaggacgctccacgcaccatcggtacacagacccacaggccgcgagtccatgcccagaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttcagactgcgggcgccgctctatgaggtcacagggctgcgcccatcgcagcgtttctgacaggagcggccataatggctgtgggaatcactcttagtcacctcagtgcctttctctcttcgttgcaagggacactcaagagtcgggtgcccagccaaggccaacacggcgcagtggcattctattcagcctgctgtggaaaaaagatggcggcgccctttgtgccca

SEQ ID NO: 84140 - DNA, 116 bp, Homo sapiens
  chr19:52598475-52598591
  hyper
gggagcggaaggacccggcgtgaggacgacacgaggtggcgcggagaacgatgtctcacgacagggagggtctgcagaatcccaggacgtgggaggagaagcggctccttcaggag

SEQ ID NO: 84141 - DNA, 30 bp, Homo sapiens
  chr19:52599113-52599143
  hyper
gacttgggagtggcccgaaagggtggtggg

SEQ ID NO: 84142 - DNA, 30 bp, Homo sapiens
  chr19:52614030-52614060
  hypo
cctcaaacacccacgcggacttcaggcatg

SEQ ID NO: 84143 - DNA, 30 bp, Homo sapiens
  chr19:5269609-5269639
  hypo
gcccttccaggcagccggagaggagagaga

SEQ ID NO: 84144 - DNA, 30 bp, Homo sapiens
  chr19:52753552-52753582
  hypo
catcatttctgagggcgtctgtgaggatga

SEQ ID NO: 84145 - DNA, 174 bp, Homo sapiens
  chr19:52774623-52774797
  hypo
gaactggtcagtatgcggaaaaacacgtgcacatttccatctcaaccagtaaagggaagagatctccaaccggcccacccacctgtctcagggcctgtgatctctactcagtagtaactgggaatggtctgtccctccccctggctgttgctgaccctgcgattgtgcaccagg

SEQ ID NO: 84146 - DNA, 137 bp, Homo sapiens; identical to SEQ ID NO: 46005
  chr19:52780320-52780457
  hypo

SEQ ID NO: 84147 - DNA, 16 bp, Homo sapiens
  chr19:52800002-52800018
  hyper
ctggagtgcagtggcc

SEQ ID NO: 84148 - DNA, 136 bp, Homo sapiens
  chr19:52800078-52800214
  hyper
ggggtagccgggactacaggtgcccgaccgcacggtcggcttaagattaactttaatagcaggaattttcctggatctaatcattagccgactttgctcagtcccggcaagagtacagttccgagacagctgagtt

SEQ ID NO: 84149 - DNA, 222 bp, Homo sapiens
  chr19:52800693-52800915
  hyper
gtagtcacctcctgtcgcggagttttcctgtttcaagtccttcagtgatgcttacatccgccccgcacagcgtaaagtcctcccccgctaggcggattccggtctatgcggtcccccaagcctcgcctttgttggccctggagcacagcgctccaatctcaatccaggagaagccgcgtcttctgcccagtgctgggattctgcagacgccacccatctctt

SEQ ID NO: 84150 - DNA, 145 bp, Homo sapiens
  chr19:52839411-52839556
  hyper
cagaggcactggaggcgtggcctagggaagccccgccccgtcccgtcccggtccgctctctatgctgcgcgcgcgcagttttttgcagacccggaagcggatcgcgtgggtagaaggtcacaccgcagcgcgtcagtttcccttt

SEQ ID NO: 84151 - DNA, 127 bp, Homo sapiens
  chr19:52839797-52839924
  hyper
tctttactgacccaacgtcctgccccgcgcttttaaaagtccttaccgcaaggtggattcccgcccggggagcctcccaacctcgcccccggcccctgaagcgcagcgccgcagccccagtcccggc

SEQ ID NO: 84152 - DNA, 117 bp, Homo sapiens
  chr19:52839925-52840042
  hyper
ggggaggccgcgtcctgtactgggtcctgggacccttgagaccccacacttctaataattcagccccacccttttcctccttgatccgggccttcctactccccaggcctccccttc

SEQ ID NO: 84153 - DNA, 38 bp, Homo sapiens; identical to SEQ ID NO: 37690
  chr19:52840043-52840081
  hyper

SEQ ID NO: 84154 - DNA, 38 bp, Homo sapiens
  chr19:52872835-52872873
  hyper
caggcgggagtgcagcgcacgacctcggctcactgcag

SEQ ID NO: 84155 - DNA, 173 bp, Homo sapiens
  chr19:52872933-52873106
  hyper
tgcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggc

SEQ ID NO: 84156 - DNA, 427 bp, Homo sapiens; identical to SEQ ID NO: 37693
  chr19:52873107-52873534
  hyper

SEQ ID NO: 84157 - DNA, 161 bp, Homo sapiens
  chr19:52893581-52893742
  hypo
cagtcccagggaggccgtgaactcttcctggtcctgggatcctgcagaccctgcccctctcctgactttctcctgcctttttcctccttgatcgggggcccttctgctccccaggcctccccttctcctgatatcgagtgtggggacgtgacttctatctc

SEQ ID NO: 84158 - DNA, 108 bp, Homo sapiens
  chr19:52900866-52900974
  hyper
aatagaaggaattttcgtggatataatctacaaccgattttgctctgcgcaggtaagatccgttttcagaccaaaaccctgaaaacaagcgcagccagtcaagcgaac

SEQ ID NO: 84159 - DNA, 141 bp, Homo sapiens
  chr19:52900975-52901116
  hyper
gaagcgcaggcccggcccaggctttgtcccggcccgccctggtcccagccagtccggcctctaggatgcgcgcgcaatttcgtgcaaacccggaagcggaccgcggggggcgaacgcctagagcgcagtttccggtagacc

SEQ ID NO: 84160 - DNA, 30 bp, Homo sapiens
  chr19:52907400-52907430
  hypo
tcctgacacctggggcgagtttcctagaat

SEQ ID NO: 84161 - DNA, 525 bp, Homo sapiens
  chr19:5292613-5293138
  hyper
aaagcacagaggcaacgtggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctggcagcgaaggctgccccgcgcctggctccgcccccgggaggtgggggaggagagggggtggggggaggaggtcgggctgggggccaggcgggggaggggaccctgcggagcataacggtctggagttttccaaagtgcaagcgacgggcctgaatgggggggcgccaggcagcagcaggcccaagctggccctggagggcggccggcacggtcaggcccgcgctgggctgtggggacccccgtggtccccagcctcggagcctggagggggcgcgacaagagagacaaagcccggggcggcccgggcctcggggtggaagggggtcc

SEQ ID NO: 84162 - DNA, 42 bp, Homo sapiens
  chr19:52927555-52927597
  hypo
tctgagatggagtttcgctcttgtgtccctggatggagtgca

SEQ ID NO: 84163 - DNA, 518 bp, Homo sapiens
  chr19:5293155-5293673
  hyper
cggctcggagatcgggcccaggccccgcgaggcctccacagggcccgccgcagccgctccccgcgtccctcggtccgcccggagcgcggcgcgcagcgaagactcgggagaggcctcggcctggggagctcggcctgggggcggggcaaggggcggggctgtagggggcggggttgcagtgggcggggctgcaggggacgggccccgaggagggggattggggggcagggcggggccccggccggaagtggggcggggggaccagaggggagccccatctggaggcgcggagagcctccgcaggagtccatgaaacactgagcgaaggggcgccccagggagggcacgacccaagacccctccctcccgaagacgtctcacggggagcctctacactgctcctcgcttccccagctctgatcgtagccatggcaacgcatgaggaggctggatgccggacagggcggcggagggctccccaaacacacccaactacaggaggtcggagaaggggcaga

SEQ ID NO: 84164 - DNA, 166 bp, Homo sapiens
  chr19:5293976-5294142
  hyper
gccaatccgagccagcgttgcgcccggggtgcgggtttgaaaactccaccggaggggcccggaatgtagaagcccagcgggacctgggggtctggggacgggacaggggcagaggccgggatggagacccaagggctcccgcgtctgctcccatccctggaaaaaa

SEQ ID NO: 84165 - DNA, 327 bp, Homo sapiens
  chr19:52956606-52956933
  hyper
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgcagtttcctgaagacccggaagccgatcgcgtggggagccggtcttggagcagcgggtgagtttccctttgtctagattagatccgcttccagcgcttctgtacctggtgttggcggaggggttcttac

SEQ ID NO: 84166 - DNA, 1 bp, Homo sapiens
  chr19:52957230-52957231
  hyper
c

SEQ ID NO: 84167 - DNA, 25 bp, Homo sapiens
  chr19:52983447-52983472
  hypo
cgtgcccagtcgattatgaatctta

SEQ ID NO: 84168 - DNA, 156 bp, Homo sapiens
  chr19:53007644-53007800
  hypo
tgtgtttcctttttatttatatagtttttatattgtccataaaatcgagacttccatagcgacttatgggatcttaaaatctttcaaggaaaagtacaataaaatgcaactattgagaaaaaaaattcaaaaataccttaacgtggttttgtcaca

SEQ ID NO: 84169 - DNA, 261 bp, Homo sapiens
  chr19:530219-530480
  hypo
cacaggcgtgagccaccgtgcccggcctgtatgttgatgcagctgtgtgtacccagggcatagcaacaatgccactggcacagtccgagggcagggccacccgtcacgggcacgactcaggggaggctgggctgccccgtcctcaccacggccagttctcccgaccaagcttcacagcaaggagcatgtgggtgtctgggcagccactgagccaggtcagaagtcaggtggggtcacagtgatgcccggaatcagctgggg

SEQ ID NO: 84170 - DNA, 26 bp, Homo sapiens
  chr19:53028928-53028954
  hypo
ttatttatttagagacggaatctctt

SEQ ID NO: 84171 - DNA, 30 bp, Homo sapiens
  chr19:53030640-53030670
  hyper
ttctagtttgcatcccggttccagacaatt

SEQ ID NO: 84172 - DNA, 53 bp, Homo sapiens
  chr19:53031294-53031347
  hyper
ctcccagccacccctcgtcggcccctggagcgtcgcgccgcagccccagtccc

SEQ ID NO: 84173 - DNA, 19 bp, Homo sapiens
  chr19:53064806-53064825
  hypo
tttttttttttgagacgga

SEQ ID NO: 84174 - DNA, 30 bp, Homo sapiens
  chr19:53071305-53071335
  hypo
ccggtggcatgcaggcgcaacttctacaag

SEQ ID NO: 84175 - DNA, 91 bp, Homo sapiens; identical to SEQ ID NO: 37699
  chr19:53073313-53073404
  hyper

SEQ ID NO: 84176 - DNA, 368 bp, Homo sapiens; identical to SEQ ID NO: 37700
  chr19:53073405-53073773
  hyper

SEQ ID NO: 84177 - DNA, 46 bp, Homo sapiens; identical to SEQ ID NO: 4684
  chr19:53073819-53073865
  hyper

SEQ ID NO: 84178 - DNA, 286 bp, Homo sapiens
  chr19:53073866-53074152
  hyper
cttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacggtgtgttcttgcc

SEQ ID NO: 84179 - DNA, 20 bp, Homo sapiens
  chr19:53098049-53098069
  hypo
gccaccgcacctggcccgtt

SEQ ID NO: 84180 - DNA, 30 bp, Homo sapiens
  chr19:53102914-53102944
  hypo
gtctctacttgggaacgctgatcccattca

SEQ ID NO: 84181 - DNA, 740 bp, Homo sapiens
  chr19:53104346-53105086
  hyper
atgcctcagccttcccggccagtctcccttccaaaacccgaaaaacggaggcgctgggctcaagactgactctgtcccgccccggccccgccctctgccggttctaaagggcaaagtctctccgcctcgcgccccgcttccgcctgcccaggccccgcccacctcctcctggaccccgcccaggcctggcttctgtcctgcgcgagcagatcagcgcgaacctggaagcggagagcgtggagtgaaggtcccacggcagcgcgtgagtttctctctgttttatattaagtctgtgcgtcccaggtccccggcgcgtctgtacctgggacgtggggtccccacagacctggaaattctcgcccgtcttcacccagagcaaattgagacttccctttgagagtccggggttcacttccttttgggtttaaaatcgccttgaagctggtgcggtctctggtcttgctgctatagggcaatgtatacactttgtattgggtagttttcctgctcaaaacctttttctaactcctcccgccccgcgctttttaaagtccttacaggtgaggtggattcccgccctgggcgcctcccaccctcgccttcgacggcccctcgagtgcagcgccgtgcccccagtcccgcggaggctgcgtcctctgcctggtcctgagatccttcagaccccaccattgtcttaaggcgccgtcgtcccccacctcccttctcgtgccgggccctgc

SEQ ID NO: 84182 - DNA, 39 bp, Homo sapiens; identical to SEQ ID NO: 46009
  chr19:53105829-53105868
  hypo

SEQ ID NO: 84183 - DNA, 98 bp, Homo sapiens
  chr19:53137932-53138030
  hypo
tcgtggacattaatacgtgacttccattggcagctgctctaatcctggtccacagagagttgacagagcatccagatgtggcccctgaacaatccctg

SEQ ID NO: 84184 - DNA, 454 bp, Homo sapiens
  chr19:53140899-53141353
  hyper
cccaatgcctttggccgacacaatcacaggagggtttggataagacgcctgcatcccggaggagctcgttttccgggggctggagctgggcaggcaagaacaccccgtgtcacaggacaggccccgggtacctccccaacgcgggttcaggggaagaggtgactgtggaggagagacctgtggagcagcagggcccgccacgaggagggaggtgggggggagacggcgccttaagacaaggttggggtctgcaggattccaggaccaggcaaagtacgcggcctccctgggactggggccctggcgctgcgctccagtggcctacgaaggcgagggtgggaggcgcccagggcgggaatccagctctcgggtgaggactttaaaaagcgaggggcgggaggagtcagaaaacagttttgagcaggaaaactacgcgacaggaagtgtatacatc

SEQ ID NO: 84185 - DNA, 206 bp, Homo sapiens
  chr19:53141413-53141619
  hyper
agcgatatccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtg

SEQ ID NO: 84186 - DNA, 160 bp, Homo sapiens
  chr19:53141647-53141807
  hyper
cggggcccgcgaggtgggcggggcctggatgaggtaggggcggggtgggaagccgagagactttcccctttagaaccagcagtgggcggggccagggcgggacctgtgagtctctcagcatcgttcccagcgcagaggcatttttcgggttttggaggcg

SEQ ID NO: 84187 - DNA, 76 bp, Homo sapiens; identical to SEQ ID NO: 46010
  chr19:53148247-53148323
  hypo

SEQ ID NO: 84188 - DNA, 811 bp, Homo sapiens
  chr19:53193195-53194006
  hyper
gggagcagcagggcccggcacgaggagggaggtggggggcgacggcgcctgaggacaagggtggggtctgcaggatcccaggactaggcagaggacacggcctccccgggacaggggccgcggcgctgcgcttcagaggccgacaagggcaaggctgggaggtgcccacggcgggaatccacttcgcgggtgaggacgttaaaaagcgcggggcgggaggagtctgaaaatgattttgagaaaaaaaaaaaaaaaacaacaacaactacgcgataggaagtgtatacattgccctagagcagaaagacaggggatgggaccaacctcagggcgactttagacccaaaaggaagcgacttccagactctcacggggatgtctctatttgctctgggtgaagacgggagagaagttccagatctgtggggaccctaggtccgagggacagaaacgctgaggacctgggaaatgcagacttaatacaaaacagcgaaactcaccgccgcggtgtgaccgtcactccacgcgatccgcttccagatttgcgagaatctgcgcgcgcaggacagaagccaggcctcggcgggccccgcgaggtggtgggcggggcctgggccgggtggcggcggggcgcgaagcagagagactttgcggtttagaaccggcagagggcggggccggggcgggacctgtgtgtctcacatcctggctcccagcgcctctgtttttcgggtttgggaggcgacagcggccaggaagtatgaggcatgattcaaaagccctggaattttctggaacggggatgcaaact

SEQ ID NO: 84189 - DNA, 240 bp, Homo sapiens
  chr19:53194126-53194366
  hyper
cctgtgctcagcttcagagacttccctaaagccactgcctggggtgcgggacggagtgctcaggccagggaggagtgaggtcaccacctgctgcttaaacacagcaggggtgcaggcgcgaaggcgggagcctgaggtcccagctactcaggaagtaggagcaggaagatcgctgagccctggggtccaggccagcctgggcgacaaagtaacaccccctcccgcaaggccaccttcctt

SEQ ID NO: 84190 - DNA, 53 bp, Homo sapiens
  chr19:5319680-5319733
  hypo
ccacacaggcctcctcgctgttcctccaacacgccaggcgtggtcctgccccg

SEQ ID NO: 84191 - DNA, 96 bp, Homo sapiens
  chr19:53211156-53211252
  hypo
tacaggtgtgagccactgcacctggtggcactttgtgacattaacgaatagtgcatgtcagttatattgcataccacataccgaaaagccatatgc

SEQ ID NO: 84192 - DNA, 30 bp, Homo sapiens; identical to SEQ ID NO: 46011
  chr19:53225425-53225455
  hypo

SEQ ID NO: 84193 - DNA, 16 bp, Homo sapiens
  chr19:53238443-53238459
  hyper
gcgtctctcagcctcg

SEQ ID NO: 84194 - DNA, 34 bp, Homo sapiens
  chr19:53240317-53240351
  hypo
gcagaaatattctttgcttcgctttttaaatgtt

SEQ ID NO: 84195 - DNA, 79 bp, Homo sapiens
  chr19:53289871-53289950
  hyper
tgaagggaagacaggcgagaatttccaggtccgtggggatcccacgtcccaggggcagaagcgccggggacctgggaag

SEQ ID NO: 84196 - DNA, 30 bp, Homo sapiens; identical to SEQ ID NO: 46012
  chr19:53299504-53299534
  hypo

SEQ ID NO: 84197 - DNA, 32 bp, Homo sapiens
  chr19:53324245-53324277
  hyper
agagctggagctgggcgggcaagaacaccccg

SEQ ID NO: 84198 - DNA, 30 bp, Homo sapiens
  chr19:53324547-53324577
  hyper
ttaaaaagagccgtgcggaaggagtcaaaa

SEQ ID NO: 84199 - DNA, 50 bp, Homo sapiens
  chr19:53324990-53325040
  hyper
ttgccctttagaacccgcagagggcggggccggagcgggacctgtgagtc

SEQ ID NO: 84200 - DNA, 27 bp, Homo sapiens
  chr19:53330844-53330871
  hypo
tgagatggagtcttgcggtgtctgctc

SEQ ID NO: 84201 - DNA, 111 bp, Homo sapiens; identical to SEQ ID NO: 37710
  chr19:53361072-53361183
  hyper

SEQ ID NO: 84202 - DNA, 30 bp, Homo sapiens
  chr19:53363084-53363114
  hypo
ttttattgcactacacgctaccagttacaa

SEQ ID NO: 84203 - DNA, 30 bp, Homo sapiens
  chr19:5336366-5336396
  hyper
ggctgccactctctgcgtgagacaacagcc

SEQ ID NO: 84204 - DNA, 105 bp, Homo sapiens
  chr19:5338746-5338851
  hyper
tgcaaatggcagattcgaccaagtccctgggccattaataaacgctccagcagctgccgctggtatcgcaggagcagaggagcgggatggcttccttctcccggg

SEQ ID NO: 84205 - DNA, 141 bp, Homo sapiens
  chr19:53387484-53387625
  hypo
agctacttcctttttcgtttattcttcagatcgagtcacgctcttatcacccaggctagagtgtactggcaggattctcctacctcaactgattctccctcctcagcccagagtctcactctgttgcccgggctggagtgc

SEQ ID NO: 84206 - DNA, 264 bp, Homo sapiens
  chr19:5338900-5339164
  hyper
cgtcaccctctgcaccccaaggacagcagcgatagggggccacccagaggaggccagaatcccagcagccaaagtccgggtggtggcggacgggagcccggagcgtgtgggtccctgtccttgggaccctaggggtctcttcctgcctcctccggcttctaggtatcatccctgctgctcagccgggactccgacacctcggacacccgcttcactagccgcggctgccgggatgtgtttttagggtctcggccagaggcagga

SEQ ID NO: 84207 - DNA, 30 bp, Homo sapiens; identical to SEQ ID NO: 37161
  chr19:5339394-5339424
  hyper

SEQ ID NO: 84208 - DNA, 41 bp, Homo sapiens
  chr19:5339625-5339666
  hyper
agaggtgaacttggccgcaacctggccgaaccctcgcaccc

SEQ ID NO: 84209 - DNA, 403 bp, Homo sapiens; identical to SEQ ID NO: 37711
  chr19:53400389-53400792
  hyper

SEQ ID NO: 84210 - DNA, 681 bp, Homo sapiens
  chr19:5340438-5341119
  hyper
cccccagcgcggccccggccctgtccctcggggcattgtccgggcgcagctaccggggcgcagcggctgggcgtgcaactggctgcagccgagcatcctccgagcacaatggccgtgcaggcttccccggcacaaagccggcgcgctgcccactcggctgcctccgagaccccccttggagcgcctgcatttttttttcctctaatccatgattttatttttttttttggctttacctggaggctggctgggctgggctcccccggctctgccccgcttcacatcgtggctgttgcatgggatccgagcggagcccgagcgccagcggctcgcggcgtgcgcgcgccggccgggctgccgggcgggcggcgcgaggacactcactgcggctcgcgctcccctagctcccgctcgcgcgcccccccagccggtgacgtcatcccttccgccagcgccgccgccgccgccgccgggtcgggggcagggccggcccgtgcgcgtcactgcgcagccgcgcggccgccacgccccccggccaatgggacggcgcagcgcggtcacgtggctccggggtgtttaaagggccgcgggagcacgtggggcgcggggcttcgcgggacacgtgggcggctggggtggtggtggtggtggcggctgcggcggcggcgggaagggcccctg

SEQ ID NO: 84211 - DNA, 30 bp, Homo sapiens; identical to SEQ ID NO: 46014
  chr19:53412458-53412488
  hypo

SEQ ID NO: 84212 - DNA, 30 bp, Homo sapiens
  chr19:53426134-53426164
  hyper
gggagcaacagggcccggcatgaggaggga

SEQ ID NO: 84213 - DNA, 359 bp, Homo sapiens
  chr19:53426510-53426869
  hyper
ttgaaggaagaagggcgagaatttccaggtctgtggagaccccacatcccaggtacagaattgccggggacctggaggcacagcctcaatacaacacagagcaaaactcaccgccgcagtgtgacttccagtccacgcgatccgcttcctggtccgggcgaatctacaagcacaggacagaagccaggcctccgtggagccaacgaggtgggcggggcctgggcgaggtaggggcggggcctgggcgaggtaggggcggggcgccaggcggagagacctgccctgtagaaccggcagacgcggggcgggggcggatctgtgcttctctcagccgcgtacctagccgctgtttttcgggt

SEQ ID NO: 84214 - DNA, 24 bp, Homo sapiens
  chr19:53429320-53429344
  hypo
ataagaagggacaatcggccaggt

SEQ ID NO: 84215 - DNA, 112 bp, Homo sapiens
  chr19:53445710-53445822
  hyper
tctatgaggaccccacgtcccaggtacagaagcgcctgggacccgggaagcgcagacttaacacaacacagagcaaaactcacccccgcggtgggaccgtcactccacgcga

SEQ ID NO: 84216 - DNA, 45 bp, Homo sapiens
  chr19:53446430-53446475
  hyper
tgggcgacaaagtaacaccgcctcccgcagcgctcccttccttgt

SEQ ID NO: 84217 - DNA, 652 bp, Homo sapiens
  chr19:53465861-53466513
  hyper
tgctaaggaaagtttcgcgacaggaggtgtctgcacggccccactgcagaaagaccggggacgggaccagcctcagggcaactttaaactcaaaaggaagcgactcacggactctcacccggacgtttcaatttgctctgggttgagaaaagaggggccggaacctgcaggtctgtggggaccccacgtcccctatatagcagcaccagacaactaggaaacgcacacgccgccgtgcaactttcagtccacgccatccgcttccgggtctgtgccaatcggcgcaggacagaagcgggacctgggccagatccccgagaggtgggcggggcctgggcgaggccggggcggggtgcaaaggacaaggggcccggcgcggaagagaagagtcttgggctgggaggagtccgcgggggcgggaaaggggcggggcctgagcttttctccatctcgctctccgcgcctctgttttcaaggttttagaggtgaaacccgccagtgaggctggagcagctcagcagtcagggaaatagtacctccctgagaagtcgccgtgtggcggtaattggatccgggaaagttccttgctattgaaatttattttagcaatttaattccaaagcctggaagttgtctacggcaggaatgcaaa

SEQ ID NO: 84218 - DNA, 246 bp, Homo sapiens
  chr19:53496159-53496405
  hyper
tcgggacgggggaggcggcgctgcgctccagggaccgacgagggtgagggtgggaggcgcccagggtgggaatccacctctcgggtgaggactttaaaaagcacggggtggagggagtcagaaaatagttacaaacaggaaaactacgagatacgaagtgtatacgttgccctatagcagaaagaccggggacgggtctagcctcagggcgactttaaacccaaaaggaagcgacttctggactct

SEQ ID NO: 84219 - DNA, 139 bp, Homo sapiens; identical to SEQ ID NO: 37715
  chr19:53496648-53496787
  hyper

SEQ ID NO: 84220 - DNA, 296 bp, Homo sapiens
  chr19:53496813-53497109
  hyper
cgggacatggcagggggtgggcggggcctgggcgaggtgggggcggggcgcgaggcggagagaccttcccctatagaaccggcagggggcggggcgcgaggcggagagaccttcccctatagaaccggcagggggcggggcgcgaggcggagagaccttcccctatagaaccggcagagggcggggcgggatctgtgagtctctcagcctcggcgtgtttttgggttttggagacgagacctgccaggaaagctgaggcatgattcaaaagccctggaactgtctggaaggggaat

SEQ ID NO: 84221 - DNA, 100 bp, Homo sapiens
  chr19:53497289-53497389
  hyper
gtgctcaggccagggaggagtgaggtcaccacctgctggttaaacacagcagagatgcgggcgcacaagggggcgtgggagggcgcggggtgggatcctg

SEQ ID NO: 84222 - DNA, 20 bp, Homo sapiens
  chr19:53497973-53497993
  hypo
gttaccgtgcctgtcccaag

SEQ ID NO: 84223 - DNA, 30 bp, Homo sapiens
  chr19:53507239-53507269
  hypo
ccgtccggacttccccgatcccagccttct

SEQ ID NO: 84224 - DNA, 28 bp, Homo sapiens
  chr19:53549226-53549254
  hypo
cattttggccgggcacggtggctcatgc

SEQ ID NO: 84225 - DNA, 472 bp, Homo sapiens
  chr19:53561353-53561825
  hyper
ggaccaggcggaggacgcggtctgcggcgctgcgctccagggccgacgacggagaggctgggaggcgctcaggacgggaatccacctcgcaggtgaggactttaaaaagcgcggggcgggaggaggggtcaggaaagggttttatgcgggaagaagacgcgaatggcaggggacagggactggtctcagagcgagttttacccacatggcgaggtccgtatttacctcgggtgaagggcgcgatgcggggattttaaggtcagcagagcgggtgtggaaaagcgggacggcgaatcgaaggcttaatctacacctaggcacactcttgctcggcggtgtcaccttcacacaccgcgatccgcttccgggactccaagaaactgcacgtgcgcgcagagcccgggtagcctggggcggagcccggggagaggcggggtctgcagagggaccgcgggggcggggcctgtgcagt

SEQ ID NO: 84226 - DNA, 142 bp, Homo sapiens
  chr19:53606212-53606354
  hyper
gatcccaggaccaggcggaggcgcggcctccccgggactgggtcggcggcgctgcgctccaggggccgacgagagcgaggctgggaggcgcccagggcaggcggtgaggactttaagcgatgcggggcgggaggaggagtca

SEQ ID NO: 84227 - DNA, 30 bp, Homo sapiens
  chr19:53606575-53606605
  hyper
tgtgcgaatgggggacggcgaggcgcaggt

SEQ ID NO: 84228 - DNA, 79 bp, Homo sapiens
  chr19:53607032-53607111
  hyper
atgcccacagcccagcgcccagagccatctgtagtgtcttgtggaacggcgtagatgtttcaaacggtttcaagttaaa

SEQ ID NO: 84229 - DNA, 132 bp, Homo sapiens
  chr19:53635472-53635604
  hyper
gctctctctgtccctcgatccctttggcccacacattcacaggacggtttggggtaagacgcctgcatcctggaggagcgcattttccacggggtggaggagggcaggcaagaacatcgggtgtcacaggac

SEQ ID NO: 84230 - DNA, 206 bp, Homo sapiens
  chr19:53635885-53636091
  hyper
ggaaaaggttttaagcgggaggaagaagcaaaaggccggggacggggagcagcctcaaagcgacttcaacccaaagggaagcgactccggacccacactgcgaggcctgtattcacctggggtggagtgtacggggattttaagggccgtatcgaccctggacatcggctgtggaaatgggaaacagggagcgcaggtttaatcta

SEQ ID NO: 84231 - DNA, 452 bp, Homo sapiens
  chr19:53661430-53661882
  hyper
cgggcacctccccagcgcgggctcaggagaagcggggactgcgaaggggaggcctggggagcagcagggcccggcacgaggaggagggaggtggcggggcgacggcgccttagaagaggggtggggtctgcaggatgccaggaccaggcagaggacgcggcctcgccggtaccggggctgaggagctgcgctccaggggccgacgagggcgaggctgggaggcacccagggcgggaatccacctcgcgggcgaggactttaaaaagcccggggcgggaggaggggtcaggaaagggttttaagcgggaggaagacgcgaaaggccggggacagggagaagcctcagagctacttcaacccaaagagaagcgactccgaacccacaccgcgagtcagctggggtggagggcgcggtgcggggatcttaaggtctgtagctgccgggcgcagtg

SEQ ID NO: 84232 - DNA, 452 bp, Homo sapiens
  chr19:53662182-53662634
  hyper
tctgtagcgagcccgggaactggctgcggaaacggggcacggcggttcgcaagtttaatccatactgagggacactcacgctcggcggcgtcacccgcacccaacacgatccgcttccggaactgcagaaaactgcgcgtgcgcggaaaagagcccgggcactctgggggcggggcctggggagaggcggggtctgcggacgaaacgctggggcggagctggggcggggtctgcgcttccctcagcctgcctagcccgcagtctcatttttcccggtttagaaacgctggagtgttcactatgtccccgggagcaccgttccaatttgaagcagttttaaggtgaaagaatagacttacgtggaccacttatgatagaaaccaaaatgatttcctcttaccaagttgaaaacggtttatgttaaaattgtttgccggcgggttggacccagt

SEQ ID NO: 84233 - DNA, 537 bp, Homo sapiens
  chr19:53696112-53696649
  hyper
gagggaggtggggggcgacggcgccttaggagaggggtggggtatgcaggatcccaggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcgacccccagagtctcgcggcaaagtctgaatttacatggaatggagggagccgtgcggggactttaagggctatacgaacccccggacatcgggtacggaggagcaggggactccgaaacgcaggtttaatctagatagagggaaactcacgcggcgactaacagccttcactccaagagatctgcttccgggtttgcaagaaactgcccgcgcagtaggcaaaggggcgggttgc

SEQ ID NO: 84234 - DNA, 96 bp, Homo sapiens
  chr19:53696650-53696746
  hyper
gtggggaaaggccaggcgttgggagggactgagagcatagggtgggcggggccggggcggggcctgaaccctggaggcggaggttgcaatgagccg

SEQ ID NO: 84235 - DNA, 94 bp, Homo sapiens
  chr19:53696806-53696900
  hyper
aaaaaaaaacaaaacttaggctatctaaaagtttaaccaatggccagtaatataagcaatcatgcatatgtaatgaaggcgccataacaaccca

SEQ ID NO: 84236 - DNA, 30 bp, Homo sapiens
  chr19:53700031-53700061
  hyper
ctgctccgcaggacacgaaatagacttgtg

SEQ ID NO: 84237 - DNA, 392 bp, Homo sapiens
  chr19:53700307-53700699
  hyper
tccccgcccccagaccgcccagtctccgctgcgagcggttttctgtagacccggaagcggatcgcggggagtgaaggctgcgccgccgagcctgagtttcgctctctctagattaaatctgcgcttcgcagtcccccttcttccatcccccgggtctggaggggtccctacagatcttaaaatgaccacaccgcgccctccaccccaggtaaattctgacgttgctgtgagaatgcggagatcgctttccctttgggttaaagtcgctctaagcctacttcctgaatctggtctttctgctttgcgctaggtaaacatggcctttcgtgtcttttgctgcctaaaatcctttaccgatttttcttcccgccacgcgggagggcacttttttt

SEQ ID NO: 84238 - DNA, 82 bp, Homo sapiens
  chr19:53701633-53701715
  hypo
ttctgacagcaaatgtgtgggagtttttttcccacacactaggcaattctccagtatacaccagttgcgtgtcctataattc

SEQ ID NO: 84239 - DNA, 33 bp, Homo sapiens
  chr19:53702028-53702061
  hypo
tatacagcaggtcctcgaataacgttgttttgt

SEQ ID NO: 84240 - DNA, 20 bp, Homo sapiens
  chr19:53704275-53704295
  hypo
gccaccgtgcccagcttgtt

SEQ ID NO: 84241 - DNA, 33 bp, Homo sapiens
  chr19:53728442-53728475
  hypo
ttaaagagatttaaacggaagaaatacgtttaa

SEQ ID NO: 84242 - DNA, 40 bp, Homo sapiens
  chr19:53733589-53733629
  hypo
ctgggattacaggcatgagccaccgcgcccagccctgact

SEQ ID NO: 84243 - DNA, 515 bp, Homo sapiens
  chr19:53757722-53758237
  hyper
ctccctggagaagggcgaagggtgtgtatccaccccgagtgagggctttaccagggggagggaagagggagtcagagaagagttttaagcagagaaacgacgcggtgggcggtcggtgtccacactgacctaaagcaaaaaggtcggggccagtacccacttcagaacgattttaatccgaaatggacgcagatctctagaccctctcggagcgacgggactgggaacgtcttagggccacgccgcgagaggaatgagcaggttcggggttttaacctacagggcgaccccaaaacccgacagcggagcgtgggaacctgtggcccgcgaggcgcaggcttgaacccgaaagacggagactcacccgagagcgccagtagccccgcgagatccgcttccgggtcggcaggaacctgcgcgtacgcgagtgcactggggcggcgcaaggggcaagggcaggggcagggcgcggacaactgtggggatgggcgggcaaatggcggggatgggcgggg

SEQ ID NO: 84244 - DNA, 107 bp, Homo sapiens
  chr19:53794273-53794380
  hypo
tgcaaagccagcaaacgtttttgatctattaatctcttctactaattcttcatcctcattgatgtctgcagacacatacgttttagatccttcgaaactgttcaaag

SEQ ID NO: 84245 - DNA, 76 bp, Homo sapiens
  chr19:53811828-53811904
  hyper
cgccaatgaggagttcggtggatttctaaccaagtcccatttcaccgagagcggagtcccgcggggaccaggaggt

SEQ ID NO: 84246 - DNA, 39 bp, Homo sapiens
  chr19:53836812-53836851
  hyper
ctcgaaaacaagaggcgctgggagcgaggttgagagacg

SEQ ID NO: 84247 - DNA, 722 bp, Homo sapiens
  chr19:53868628-53869350
  hyper
ttctattctctgggccgtcagcatgacattgtaagttctgcccaagcagggctttgcatttcacattctactttgcatccgcgtttcagacaattccagggcttttgaatcatggatcggccttcctggccatctcgcctccaaaacccaaaaacagaggcggtgggagggaggctgagagacgcacagatcccgccccagcccagccccgccccgccctctgccggtactaaagggcaaggtctctccgcctctacccctacctggcccaggccccgcccacctcctcgcaggccccgcccaggcctggcttctgtccttccccgctcagacgcgcgcaaacccggaagcagatcgcgtggagtgaaggtccctcagcggcgcgtgagtttcgctccatcttgtatgaagtctgctcttcccaggtccccggcgcttctgtccctgggacgtggggtccctacagacctggaaattctcacccgtcttccttcgcccagagcaaattgagacgtccccgtgagagcccgggggtcacttccttttgggtttaaagtctccctgaggctggtcccgttccggatctttctgctatagggcaatatatacactttctatcgcgtagttttcctgctctaaacctttttctgactcctcccgccccgcgctttttaaagtcctcacccgagaggtgaattcccgccctgggcgcctcccagcct

SEQ ID NO: 84248 - DNA, 32 bp, Homo sapiens
  chr19:53869376-53869408
  hyper
cgtcgcagctccggtcccggggaggccgagtt

SEQ ID NO: 84249 - DNA, 30 bp, Homo sapiens
  chr19:53886601-53886631
  hypo
caagcacacgttgcacgtcatcatagaatt

SEQ ID NO: 84250 - DNA, 38 bp, Homo sapiens
  chr19:53934719-53934757
  hyper
gggaactcaggctcccgcccccgcgcctgaatccttgc

SEQ ID NO: 84251 - DNA, 100 bp, Homo sapiens
  chr19:53935204-53935304
  hyper
ctggcttctgctctgcgcgcgcagattcgtgcagaccaggaagcggatagcgtggagtgacggtgccaccgcggcgcgtgagtttcgccctgtcttgtat

SEQ ID NO: 84252 - DNA, 38 bp, Homo sapiens; identical to SEQ ID NO: 46018
  chr19:53965321-53965359
  hypo

SEQ ID NO: 84253 - DNA, 28 bp, Homo sapiens
  chr19:53965595-53965623
  hypo
cagtgtcagcccacccgcaggtagacat

SEQ ID NO: 84254 - DNA, 113 bp, Homo sapiens
  chr19:53966611-53966724
  hyper
ggcagctttggaaaccgggcctggttagagggtgggggtggggcctggaatgggagtgggcggggcaagagggaggaggctgcctgggggccgggctggacagcaggaaaagg

SEQ ID NO: 84255 - DNA, 108 bp, Homo sapiens
  chr19:53966788-53966896
  hyper
cggggcctggagggggcgggtccggattcttttctcagctgggccgtggatgtcgcctgctctcatcctcttgccctccaggactgggtcctccgggttctgattggt

SEQ ID NO: 84256 - DNA, 38 bp, Homo sapiens
  chr19:53970358-53970396
  hyper
aaggaaaaaaagagacgaggaaggaagcgctgcgggag

SEQ ID NO: 84257 - DNA, 180 bp, Homo sapiens
  chr19:53970456-53970636
  hyper
ctgcttcctgagtagctgggacctcaggctcctgcccccgcgcgcgcatccctcccaccccggcgccccatccagcaggtggtcacctcactcctccctggcctgagcactccgtcccgcatccatggcggtggctttagggaaatctctgaagttgagcacggggtggacttgccctcc

SEQ ID NO: 84258 - DNA, 284 bp, Homo sapiens
  chr19:53970756-53971040
  hyper
tccagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagtgacggtcccacggcag

SEQ ID NO: 84259 - DNA, 464 bp, Homo sapiens
  chr19:53971109-53971573
  hyper
cgtggggtccccacaaacctggaaattctcagccgtcttccttcacccagagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagaccccacccttgtcttaaggcgccctcgcgcccccccccccccacctccctcctcctgccgggccctgctgcttcctaggtctcccctccgcagtcacggcttcccctgagcccacgttggggaggtgcc

SEQ ID NO: 84260 - DNA, 30 bp, Homo sapiens
  chr19:53982737-53982767
  hypo
ggctgaagtggcctccgtgaacggtaggat

SEQ ID NO: 84261 - DNA, 31 bp, Homo sapiens
  chr19:54005694-54005725
  hypo
attaaatgtcacctgcgtaaaatatagagac

SEQ ID NO: 84262 - DNA, 128 bp, Homo sapiens
  chr19:54023871-54023999
  hyper
cgaaaagcattctgacggccgcgcttccagcgctaaggattcccgcgtagtgagcatttcccagaggtctctggggcatggctccattagggccgtgtgcagttgcctgcagggaaacactgatgggc

SEQ ID NO: 84263 - DNA, 558 bp, Homo sapiens
  chr19:54024000-54024558
  hyper
cccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcgg

SEQ ID NO: 84264 - DNA, 266 bp, Homo sapiens
  chr19:54024618-54024884
  hyper
taagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctgg

SEQ ID NO: 84265 - DNA, 114 bp, Homo sapiens; identical to SEQ ID NO: 46019
  chr19:54033275-54033389
  hypo

SEQ ID NO: 84266 - DNA, 21 bp, Homo sapiens
  chr19:54039855-54039876
  hypo
tttaaaaattattctcgactg

SEQ ID NO: 84267 - DNA, 30 bp, Homo sapiens; identical to SEQ ID NO: 46021
  chr19:54046025-54046055
  hypo

SEQ ID NO: 84268 - DNA, 34 bp, Homo sapiens
  chr19:54074852-54074886
  hypo
ttcagggtttggtgacgttcgccgacgtagccat

SEQ ID NO: 84269 - DNA, 58 bp, Homo sapiens
  chr19:54109845-54109903
  hypo
gaagcagatgaagatcgaggtcacagtgcccaaggggatggagcggtgagggtggagg

SEQ ID NO: 84270 - DNA, 30 bp, Homo sapiens
  chr19:54162709-54162739
  hyper
acggctgcacaagggcggagtggtttgtag

SEQ ID NO: 84271 - DNA, 144 bp, Homo sapiens
  chr19:54224540-54224684
  hypo
ggtggcacctccaaccgagatctcttgggctcaagtggtgatctttttatttttgattttttgagatgcgctctcattccgtttcccaggctggagtgcagcggcaggatccctgttgaccggaaactccgcctcccagcttcc

SEQ ID NO: 84272 - DNA, 19 bp, Homo sapiens
  chr19:54232634-54232653
  hypo
caggcgtgagccaccgcgc

SEQ ID NO: 84273 - DNA, 47 bp, Homo sapiens
  chr19:54314338-54314385
  hypo
tagcctggtgtcccacggtcctcgcgtgtccccggcctgtgtccaga

SEQ ID NO: 84274 - DNA, 16 bp, Homo sapiens
  chr19:54347071-54347087
  hypo
tcggcaaagtcacagc

SEQ ID NO: 84275 - DNA, 37 bp, Homo sapiens
  chr19:54351799-54351836
  hypo
ggattacaggtatgagccaccacgcccggcctagagg

SEQ ID NO: 84276 - DNA, 45 bp, Homo sapiens
  chr19:5436734-5436779
  hyper
ccctgcaacccctcccgggtcccgggagctcgcgccctgctcccg

SEQ ID NO: 84277 - DNA, 284 bp, Homo sapiens
  chr19:5437029-5437313
  hyper
gactcctgcccccagcgacgcccagttcctcccataggagcaaaaaggacaaaagactcccccatgcctccagtagtcaaagacccccgagctgcccatcccagacactcgcgcaggtatggagcgcctactgtatgccagccccgagactcattggggatgcagcggtggcgacatcagccccgggtccctgtccccacggggctcccaggataatggggaagagaggcaggccaccagccacgtcctccccctcctagtcggtgctgcggatgaagggtgag

SEQ ID NO: 84278 - DNA, 66 bp, Homo sapiens
  chr19:54371989-54372055
  hyper
cgctgcgaggaatcccggaggggtgtttcctcaccctccagggtctggctgcgcattcctgagctc

SEQ ID NO: 84279 - DNA, 68 bp, Homo sapiens
  chr19:54372332-54372400
  hyper
cctcccaggtgctcccgcaagccccgaatggcgattagggaggccgtgggaggcgtagctgggcctcg

SEQ ID NO: 84280 - DNA, 139 bp, Homo sapiens
  chr19:54372963-54373102
  hyper
aggagcctgtccaaacggacgctaacggcctacctccccctcaggtgctcttacagcctgttccaagtgtggcttaatccgtctccaccaccagatctttctccgtggattcctctgctaagaccgctggtgagtaggc

SEQ ID NO: 84281 - DNA, 90 bp, Homo sapiens
  chr19:54382714-54382804
  hyper
ttctcggtcgtgtcccgagagtggctggtccgcaggctcggactaccagtcccagaatgcactgcgcccgcagcccggggcgggccgtgg

SEQ ID NO: 84282 - DNA, 30 bp, Homo sapiens
  chr19:54393087-54393117
  hyper
gtcttggcttgggggcggggcctgaggtgc

SEQ ID NO: 84283 - DNA, 34 bp, Homo sapiens
  chr19:54395866-54395900
  hypo
cggagctgctcaaggcgcccgtggatggctggtg

SEQ ID NO: 84284 - DNA, 54 bp, Homo sapiens
  chr19:54401772-54401826
  hyper
acgatgtggactgcacgctggtggagaaacgtgtgctggcgctggggggccggg

SEQ ID NO: 84285 - DNA, 30 bp, Homo sapiens
  chr19:54402455-54402485
  hyper
ggaggtgtcgtgaagcggttgagttccttg

SEQ ID NO: 84286 - DNA, 159 bp, Homo sapiens
  chr19:54403442-54403601
  hypo
tgggtagatggatcccgcctctaagcccatgcacttctccgcaggaccgcctgtatttcgtgatggagtacgtcaccgggggagacttgatgtaccacattcaacagctgggcaagtttaaggagccccatgcagcgtgagtctcggccaacagagaat

SEQ ID NO: 84287 - DNA, 435 bp, Homo sapiens
  chr19:54409951-54410386
  hyper
ctcccacagtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctga

SEQ ID NO: 84288 - DNA, 772 bp, Homo sapiens
  chr19:54411125-54411897
  hyper
gtggacagtgcacagcgagagaggggcacggagatcactgagagtgccaggtggcgacccccgcgcagagacccagcgcgtccgtgttcaccagagcagccacgcaagctcacatgcacccccaggctcagacaccggggagaagtccttcccaagcggggagatcacagtctggcctcttcttgagagacctagagacctgatcagaggaagagacccccacgccagagcaaccaaaaacagccagaacccgagagcctaggaatcggcgacggaggcacacggcaggcagacgcgccttctgggcctctttcccttgacccacttgagagtctggggagtgccggggaccgtgcagatggactacatttccccgcaggcctcgcggcagacccttcccccaagtgcggctccttgccgccagggctgatgggaaatgtagtctccggtcagggccagaccagtggagcggtgtgccttgtctgtgtgtttggaggggactgagccccaaagcttcgcagtcttccttgcggacccgggcacgtcttcttccctgcagtctcctgggtttccatgacccggtccgggtggatgctggggctgcccctctctccctcatcaccgccgcgacacccccatccagtgcccgcaggccccagcccccgctccgaccctcggcgggcggcctgcccctttaagagtggccccgctgacatcacggcggggggggggggtggcccggctcctggctccgcggcggctgcaggacccg

SEQ ID NO: 84289 - DNA, 101 bp, Homo sapiens
  chr19:54412648-54412749
  hyper
cgggggcggggggcgcgggcaccggcgaccccggtggcggcggcggcggccgggggaagcctcggggccggtcatgcggctgcggggcccgcggcccggag

SEQ ID NO: 84290 - DNA, 184 bp, Homo sapiens; identical to SEQ ID NO: 37744
  chr19:54412808-54412992
  hyper

SEQ ID NO: 84291 - DNA, 151 bp, Homo sapiens
  chr19:54413008-54413159
  hyper
cgagcgtgggctggggagggcagaggccgggtccctgaggaaggcgaggtacggggcgagggcggaggacccaggcccggccagagcaggatgtgggtctggaaaggggtcccagaaagggggagttacggtctcccgagagatggaggag

SEQ ID NO: 84292 - DNA, 239 bp, Homo sapiens
  chr19:54413373-54413612
  hyper
aatgtggagaagggacgaggtcccagctgagagtcagaggggcgaaagggggaagctgagatcggctacctgggatggaggcagccagggtggccagggtgatggtgcccgtttccgagcccacagggctgcgaggggaccaggcagctcgcggtcaaacccctgagccgccaggcgggggatgggaggaaaagctggccagagcgttccctgactccggatctcggaggcctccaaga

SEQ ID NO: 84293 - DNA, 53 bp, Homo sapiens
  chr19:5441350-5441403
  hypo
tttttattgctgagtcgtattccagcgcctgggtggaccgcagtctgtttacc

SEQ ID NO: 84294 - DNA, 187 bp, Homo sapiens
  chr19:54445558-54445745
  hyper
cggagctccccctgcctcctcctcctcctcgtcttaggggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccg

SEQ ID NO: 84295 - DNA, 268 bp, Homo sapiens
  chr19:54445948-54446216
  hyper
gctggagagcaggttcgggcagccgtcgggaataccgaccatcctcttctcccttctaacctgggcttcctttttccctgcctaatctcacctcctgacctgctgggtcctccggtgcagtgggagggccggcttgctccacccgcagccccggggtggcgtagggaagggggctggaagccacgggtacggttaacctggcccttccctccccatctcccctacttccctggaaggtcccattctttctcaccggctgggctctttt

SEQ ID NO: 84296 - DNA, 39 bp, Homo sapiens
  chr19:54446419-54446458
  hyper
gagggaattcccccacgccatctccgcacctgtgcccgc

SEQ ID NO: 84297 - DNA, 30 bp, Homo sapiens
  chr19:54461145-54461175
  hyper
ttgtccaaggtcacacgaagccttgggagc

SEQ ID NO: 84298 - DNA, 57 bp, Homo sapiens
  chr19:54461664-54461721
  hyper
ccctcccctcatttccggccgccgctgccagccttggctgggcgcctggatcctgtt

SEQ ID NO: 84299 - DNA, 52 bp, Homo sapiens
  chr19:54463017-54463069
  hyper
ccaacagggggggctcgacgtcccctcctccgtgcatcggagagttgaccta

SEQ ID NO: 84300 - DNA, 459 bp, Homo sapiens
  chr19:54465275-54465734
  hyper
agaccggagggggctcgcggaggttactcccacggaagtggtgctactcgggcttcttaagttgtggagacgctcagggaaaagttgggctgacagggaagggttctagcgggtggagaggtggggcttgcaggggaagagtggggagagctggtgggcgccgcatggtgatggggcgggggtcgctaaggaaggaagaacgcgacgggggctcctggggaggaggcggcggcgtggggcttggcatcatggcggggggtggcttcccatgcgatgaggatcgtggagccccctggggcggaggcggcgcgggctaggggcgagggctgtgagtgtgagcggtggtggggactcctccgagtggggttagtgggatggtgggacgactttcttgggcagaagacaggagtggagagagatttcatcttatttattaattattagcggtggtggggactc

SEQ ID NO: 84301 - DNA, 493 bp, Homo sapiens
  chr19:54466121-54466614
  hyper
ttgggggggggggggcggggactgggggaggtacctgtgccttcttctcctctaatgcgagatctcgctccttgccctccaccagccgccgaccatggccgcgctctgaccccctccccggccgcagcctcctcctcgccgcccccctccccagccccgccggccccgggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgc

SEQ ID NO: 84302 - DNA, 107 bp, Homo sapiens
  chr19:54481331-54481438
  hyper
tcagtggggttgccccgcccccaaccctgaagtatccgcccccaccactgccctccccgctcctccagggttgaaaagaggcgtctgcgtgaagatcaatcatttcc

SEQ ID NO: 84303 - DNA, 428 bp, Homo sapiens
  chr19:54481540-54481968
  hyper
cgtcggggtgggtgccgggaaaaggcactgggactccggcacttggatcgacacgccgaggttagcctcccagccaatccgagtccagatagtgagatcctctggtccccgattggctgactgatctcgttcccgccccctcctctcaccttggggcgggctgagggaggatcctgggcgctaattggccgctttgctctctttggccctcgcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 84304 - DNA, 371 bp, Homo sapiens; identical to SEQ ID NO: 37753
  chr19:54482817-54483188
  hyper

SEQ ID NO: 84305 - DNA, 117 bp, Homo sapiens; identical to SEQ ID NO: 37754
  chr19:54483189-54483306
  hyper

SEQ ID NO: 84306 - DNA, 168 bp, Homo sapiens; identical to SEQ ID NO: 37755
  chr19:54483364-54483532
  hyper

SEQ ID NO: 84307 - DNA, 197 bp, Homo sapiens; identical to SEQ ID NO: 37756
  chr19:54483533-54483730
  hyper

SEQ ID NO: 84308 - DNA, 123 bp, Homo sapiens
  chr19:54485524-54485647
  hyper
gcgcactgccagtctcgctcggacctgctcaaggccggcgggggcgcgggcggcagtggcgggagcggcccctcggccatcctccgtctgcccagttaccgcttccgctaccgccgccgctcc

SEQ ID NO: 84309 - DNA, 325 bp, Homo sapiens; identical to SEQ ID NO: 4694
  chr19:54485672-54485997
  hyper

SEQ ID NO: 84310 - DNA, 91 bp, Homo sapiens
  chr19:54486106-54486197
  hyper
cgcggcgggggagccgaggggcgtgtccggggcgcgtgcgcgggcgcgcgtgcatcgaggctgccggggtcgggggcgcccccgctttccc

SEQ ID NO: 84311 - DNA, 30 bp, Homo sapiens
  chr19:54487792-54487822
  hypo
acgggaggaagtgaacgagcatgatgtatt

SEQ ID NO: 84312 - DNA, 246 bp, Homo sapiens
  chr19:54494857-54495103
  hyper
gggtggggacgaggccgggcgcgggcggaggccaggccggtggcggtggcgggcacagccggacgcttcggaggcagcgcggagctggggtcggcgcggggccgaggcaggagagcgagaggggcccctgctcgggagtcgggggtgggagccccgagggggggccctggcctggggctgagcctggcgcgaacccgaccgggaaggccctgggagcccgggggagggagacggactgatcccgaa

SEQ ID NO: 84313 - DNA, 30 bp, Homo sapiens
  chr19:54523707-54523737
  hyper
gccttatcagtgttacgaaggcattttcca

SEQ ID NO: 84314 - DNA, 30 bp, Homo sapiens
  chr19:5456281-5456311
  hypo
taccctggccctggtcgtatcagccttctt

SEQ ID NO: 84315 - DNA, 30 bp, Homo sapiens
  chr19:547205-547235
  hypo
ctgggcaaggacagtcgcagcaggcagcag

SEQ ID NO: 84316 - DNA, 49 bp, Homo sapiens
  chr19:547453-547502
  hypo
cccaccccaggggtccggggaatccatccgacggcgcccattctctgca

SEQ ID NO: 84317 - DNA, 230 bp, Homo sapiens
  chr19:548473-548703
  hypo
cgggactgcatgtggcgggtcgtccacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaac

SEQ ID NO: 84318 - DNA, 737 bp, Homo sapiens
  chr19:549291-550028
  hypo
tcaggggctggggggcggggaagcactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctcagagcccgcctgagtcccagcccacctctgtccatgctggctgtggggcttccgacaaacctgtttccctcagcctcccgagtaactgggtctacaggcgcccgccacc

SEQ ID NO: 84319 - DNA, 134 bp, Homo sapiens
  chr19:550388-550522
  hypo
tctccctgtaaactgcgattcaggggcctttggtacctgcacagagctgggcaaccaccaccgtgacatgtcaccccagcaccccgaaaacaggcccgtccccagtcaccccagcaccccgaaaacaggcccgt

SEQ ID NO: 84320 - DNA, 42 bp, Homo sapiens
  chr19:550909-550951
  hypo
gtcaccccagcaccccgaaaacaggcccgtccccactgtcat

SEQ ID NO: 84321 - DNA, 105 bp, Homo sapiens
  chr19:553021-553126
  hypo
ctcacaaaccaggcacgcccctgttcccggcacctgggtccagacacaaccccctgccccgaagcccctccttagccaagtacccaagtccagtctctttttttt

SEQ ID NO: 84322 - DNA, 20 bp, Homo sapiens
  chr19:555505-555525
  hypo
gccaccgtacccagcggaag

SEQ ID NO: 84323 - DNA, 123 bp, Homo sapiens
  chr19:55597901-55598024
  hyper
gccggctgcggggagcggtccttatccttgctttccaggcagagaaacgggggctcagaaagagcaaagggactcccgtcccattctggggacgctggagcgcccccccgccccgccctctgg

SEQ ID NO: 84324 - DNA, 16 bp, Homo sapiens
  chr19:55643097-55643113
  hypo
attatgaaaaactagc

SEQ ID NO: 84325 - DNA, 76 bp, Homo sapiens
  chr19:55645710-55645786
  hypo
cactttctccacatccgagctggagctctcgcatttcccaaggggagagaagggtgtcatgattaagagaccaggc

SEQ ID NO: 84326 - DNA, 155 bp, Homo sapiens
  chr19:55648515-55648670
  hypo
cgctcggagaggatgcgcaccttcatctcccgccccgtctgccgcttaccacgcttctgttctgcctgagggtgggggaggcggaacagtaaactgggggccacatcccacagagcactgccgtgtcgggacccacacgtcggatcccacagacc

SEQ ID NO: 84327 - DNA, 30 bp, Homo sapiens
  chr19:55666172-55666202
  hypo
cgggcgtggagctgtcggcacaagtcctgg

SEQ ID NO: 84328 - DNA, 79 bp, Homo sapiens
  chr19:55673951-55674030
  hypo
tctaaaataaataaataaataaccacctagaagagggaattagagttgcagattccacactcaccgcagacagagaata

SEQ ID NO: 84329 - DNA, 219 bp, Homo sapiens
  chr19:5567484-5567703
  hyper
cacagacagagagcccgaaagcaagacctgacaccggcaaggccgggtcaggagagaggccgggcgggcagcgcgaggtgggaaagcagtgccggcccgggaggccgccttgggcgcccgcctcccccgccgctctccaggggtccccggccgccgcccccgccccaccccaccccgagccccgcggccacctggggtcgctgacgagcagcagcaccg

SEQ ID NO: 84330 - DNA, 146 bp, Homo sapiens
  chr19:55684817-55684963
  hyper
gagtccaggcttggccgggggcttggggtgggagtcagggcgcaggcagcagcctcactcggtccgggggccgcagcgagtgccactgggcaatgggccgccgcgggttggccagcatgtccgcccagtgccgcaggccagccccg

SEQ ID NO: 84331 - DNA, 135 bp, Homo sapiens
  chr19:55685225-55685360
  hyper
aggaggaggctctggcgcctttcttcctgcgcagccaggtttctaaggaaatgaaccctcaggactcggttgcggagcgggtgtgttcggcgcctcctgggggagcagcctcctaagagccgcaaagctgcagaa

SEQ ID NO: 84332 - DNA, 928 bp, Homo sapiens
  chr19:55690230-55691158
  hyper
tccagcccgcctgcccgagtacacccgtccgaatcccgcccctcggaatcctggccaggctttctctctgctcggccccccacccccgggtcttgctcacctgggccgtggctgatgcgactggagtcgggaggcgtgtcgggcgatggaggccccggggttgggggctccgggaacatggtggcggggtcctggagtcttttctgcagagacactcaagcaccctagtcccccattcccaccccagacgtcctttgagccccacgcacaacaaagaactccaactcccatgaggcctttgcgcgaacagccgcgcagaaaccggacagccaccgcgagtcatgctgggagttgtagtatcagcctccccgcacttgagagggggtgtccaggacctagttccatcctaaagggataccctcttcctccacggccccacaggcatcccgctgacttctgcctcgtcctcgcccctccgcagggtctgaaccggaagcgggcgaaggcagacgtgggaaccagcagaccgcgttgcccagagcaacagccgggctcctctcaagcggggtgagagcaaagctggttgcccgggcaacgggttgttgccaggacaacgggcggggctgacgcacagacgcggagtcccggcggggcaggctcgctccggggcccaccggtgcctgggaaccccccaatagcccgactgggatcctgaggtcccgcgaggtggggagcgggcagcctgtggtccgagcgcccacagccgactgctccctccgcacctggtcctgggagctgagacgcaggttccctcttccctctccccaattttgctggagggcgggtcgggggctgcccggtgcctgtgctgagccccctcatccttcttggcctgttggtctctccacgcatccgtgctgctctcgtg

SEQ ID NO: 84333 - DNA, 296 bp, Homo sapiens
  chr19:557059-557355
  hypo
agttttggggggcaccgttctccctgggaagacgcagacgcttgtcgtcccgtggtaaatgccagaaggcctcatctgatgcccacgtacgccctgaggtggggaagctgctgtcctcatccttgctgagcgtggggccccaggattctcaggcagctggatgagcctgtggagaggccggtgcccaggctcggtcccagaacaaagcgcagaggcacgatggtcgctgacaaagtgggggccccgggaccccaaacagaaaggtccacaaaggctgaggtcggggcaggggaatt

SEQ ID NO: 84334 - DNA, 30 bp, Homo sapiens
  chr19:55721224-55721254
  hypo
agacctcatgcccctcgtccctggagcacg

SEQ ID NO: 84335 - DNA, 30 bp, Homo sapiens
  chr19:55723238-55723268
  hypo
tgactccacacccaccgtcctaccacaccc

SEQ ID NO: 84336 - DNA, 16 bp, Homo sapiens
  chr19:55727832-55727848
  hypo
gcgattagatcattga

SEQ ID NO: 84337 - DNA, 78 bp, Homo sapiens
  chr19:55729117-55729195
  hypo
agaaaaaacaaaaacaaaacaaaacaaaacaaaaactatgagaaaattccatcccccattgttcggaacccaggaatc

SEQ ID NO: 84338 - DNA, 44 bp, Homo sapiens
  chr19:55752054-55752098
  hypo
gcacactcagctgctcgcaggtctgctcccgcccacccctagct

SEQ ID NO: 84339 - DNA, 224 bp, Homo sapiens
  chr19:55798440-55798664
  hypo
agaagctgtcggagtcggtgctgatgaaggtgtgtgcgcctgctgcagtgtgcctgcgggtgggggggcctccggggctgagggcaggggcggggccgtgctgacctcttttcccgtgtccccacccctcttgaccctcaggtggagcgggagatcgccatcctgaagctcatcgaacacccacatgtcctcaagctccacgacgtctacgagaacaagaaata

SEQ ID NO: 84340 - DNA, 24 bp, Homo sapiens
  chr19:558037-558061
  hypo
gatgccaaggtcaggcgccgtcgc

SEQ ID NO: 84341 - DNA, 58 bp, Homo sapiens; identical to SEQ ID NO: 46027
  chr19:55853009-55853067
  hypo

SEQ ID NO: 84342 - DNA, 83 bp, Homo sapiens
  chr19:55865272-55865355
  hyper
gtactcgcagggctgcgtgctcttcccgcggcgggtcctggtcttgaggcagcggtggtagtctgtggcgggcgggggtcacg

SEQ ID NO: 84343 - DNA, 261 bp, Homo sapiens
  chr19:55865785-55866046
  hyper
ttctggtagcagttacggatctggttctggctggggaagcgcgggtcgaagggcggcgtcgaccatttccccttggggggctcctgggcttccacatccaacatccacgaaggaggcaactcctgcgagacgggacgggacggggactccgtggggccgagggggcgccctcgctccgacccgtctccccatcctgacccccgcccctgaaccccacccgtcgtgccctcaccagcctgacgttggcggccactggatctg

SEQ ID NO: 84344 - DNA, 204 bp, Homo sapiens
  chr19:55868920-55869124
  hypo
aaacaaccccagctccgtgagggctccctagagcacctgggctgtggtgggggctgtcctgtgcactgtaggttgctcagcagcatccctggtctctacctgctagaagccaggagcacatcccaccaccaccagccccatggtcggacactgtatccccactgcctagaacaatgcctggcacagagtcggcactcactatat

SEQ ID NO: 84345 - DNA, 44 bp, Homo sapiens
  chr19:55870737-55870781
  hypo
ggggtggggcaggtacggctgaggcctttcggggagaagctgac

SEQ ID NO: 84346 - DNA, 918 bp, Homo sapiens
  chr19:5587305-5588223
  hypo
gggactctgctgccccggtcctggctggccactccgccaccttccagtccgccacctggcaccacgtggccctgggaatgtccaccttgtgcaaagccgcctcgcctaggaacaaagtcagacaatttttttccccttgaagtgctcagcgttttcatcgtaacatgggttcagtaacggtcccgcagcctttagagcgcttgggttttttttccaggtgagaaaaatcatcatcgcacattgtattccaggtaactcaagagcgttatttgcataaattgcaaagagctgctttttgctttgttttcataacatccaacccagccagctgatcaaacatgcaaaaaagggagaggaagtgaggagcaggagtgaaccaccgtcctccacggacgacacaccttaccccgccactccaccgcggcttgccatgtgccccggccccgagggcccagacaggcccctctcgccacctagaagagaagaagggtctgcaaacactccgttcctggggaagcccctggacacatgtgggggccacagccaccctcgtccctggagccagccccgtaccttgccacctggcgtgctcccggctagccgcgcctgcgtccatggcaccctgccaggcgcgtgcctggtgctcctctagccgctggttgtgctctccccagtcacggccacccctttgccaaaagaaaaagacatgcagccatctaatgagcctccagggttgtgtcggcagcaggcgcacccaccctgacctcagctgcatggtgggtcatgccacacaacaagggctgcatgtcaagtgggcaaatcaagggaagggacatttccccaaagacagatgtgctagtaagcacgtgagaaggtgctcaacgccacccagaaatgccaatccgagccacaccgaga

SEQ ID NO: 84347 - DNA, 24 bp, Homo sapiens
  chr19:55904166-55904190
  hypo
gattacaggcgtgagccaccgcgt

SEQ ID NO: 84348 - DNA, 98 bp, Homo sapiens
  chr19:55912265-55912363
  hypo
ccagaaccagacagacgaggcgagcctcatgccagactgctggcacctggccgtcctgagcaggaacaccactgccacaccaacgtggccattattct

SEQ ID NO: 84349 - DNA, 30 bp, Homo sapiens
  chr19:55917603-55917633
  hypo
taccaccatcaccaccgtggactagaccat

SEQ ID NO: 84350 - DNA, 30 bp, Homo sapiens; identical to SEQ ID NO: 46029
  chr19:55927698-55927728
  hypo

SEQ ID NO: 84351 - DNA, 30 bp, Homo sapiens
  chr19:559290-559320
  hypo
gctgggcccagccttcgccctggatggggt

SEQ ID NO: 84352 - DNA, 37 bp, Homo sapiens
  chr19:55944725-55944762
  hyper
acggtggcggcagcccgcgcagcggtgttgggggccc

SEQ ID NO: 84353 - DNA, 39 bp, Homo sapiens
  chr19:55951941-55951980
  hyper
agacggaggctgcgccggatcccacgttccactcaccga

SEQ ID NO: 84354 - DNA, 30 bp, Homo sapiens
  chr19:5595231-5595261
  hypo
gacccaggttaagcacgacacccgccagcc

SEQ ID NO: 84355 - DNA, 314 bp, Homo sapiens
  chr19:55952650-55952964
  hyper
ctcccaccctagccccgtacactccagtctcacgcgcagcccgcataatttaaaaaatggacagatggcatcacgcccgagctcaggaccctgcagtggccccatcacacttaggataaacccgggcccgcctacttctcctcacctcctgctgcccaccgccgccagctgcacgggcgcttccctgccctgcaggccaccgagggcctttgcacgcggttcccctgcccaaaacctctcgcccacagatctctgcgtggttcgctccctcccttcgggtctccgttcagaggccttttcggatcacttcctct

SEQ ID NO: 84356 - DNA, 1428 bp, Homo sapiens
  chr19:55953539-55954967
  hyper
ccgcccgagagcacacgcacctgggcacgttgatatcccggtgcgcccggggcgcacgggacgccttgctgaaggccactttggcgccgacgcccacggccagggcgaagctgatgaccccgcacacgacgtaggctgtgctgcccccggggccctcgcccccgcggcccccggcacccccagtccggcccccttccaaccacccggcctggccgggccctggccccccgcccgcacccccagcgcccccggcgcccccagctagcggcggcggcgtggtggcccagcgcggcgtgtcgtagttggagcaggaggcctgcgccaggcgcatgtgacggtgctcacagcagaagcggtagtggcaggtgccacagcagaagcggtaggagccggtgctgcagttgaaggtggcgtcgtactggcccatgacatcgtagtagccgtggcagagctcggcgggagggggcgcccgggccgccgcgcccgccccgcccgcggggccggtcctggtgccgttggcgcctgggctcgccgcgcccccgccgcccgtcagcgccccggtcaggcgccgcaggtgcgccagcagggcgggcagcgggcccgcgggctcggcgctcgtggcgttggacgggcgcgccctggcctggccggcgctagaggccaggagtacgaggagcaggagggccggcatggggcttgcagggggtcgcactgggccgccaggctgcggggagaacgagagcagaggttggagcgctgggcgggagagaaacggtcagagggtgagaaacgtagagatgggtgggcagagaggctggggagggcgggcggggggcggcagagtgtggggagcaacaggcgccaggaggcaggaagggcggagggagctgagctgcgtgggcccaagttggccgccccacgcgcggtgggcgacgatgggagagtaatggaaacgcgcccgggcacggctgggggagagaaatgagcatgggcggacagaaccgggatcaggcgagagatgaatgcgggagaagcgattgggagggtcgacagacaccagaggggtgtgcagacattaggacgaggagcgaggcgaggcgcgatgtaaggagaagaaacgggggcggcgaagaggagagggcaggggaggcagctggagggaggcgcgcgaaggggaggggagggtggcgaggggagtggggaccgcggagggagggaaggaagcgagacagatgaggggtgggtgggaaaggaggagtcagggagacggggaaggagggagaaaagaaggggaggaggaggagggggaggagagggagggaggaggagagagagaagttgagaatttgagtttatagaccaggcaagtgggaagaggcagtgcacggtttttcaacactgacattcggggaccgatgctgctttgtg

SEQ ID NO: 84357 - DNA, 178 bp, Homo sapiens
  chr19:55962347-55962525
  hyper
agacccagagagagacgcaaaagagacgggcggggggcgggagacaaatgctcagaggggacgcagcgtcctagagaagtggggttcagagaccctgagaggagagagagccagagaggggaggacctgacctaccgaggggacagacgcccgagagagtcggcgcctctggggtctc

SEQ ID NO: 84358 - DNA, 189 bp, Homo sapiens
  chr19:55963107-55963296
  hyper
ctctctccgtcccggcgcctgtgtcccgggctgtccccagctccgagcctcagttccctgcgcgcctccatttccctccttcccccgcccggtctccgtcacccctctgtctccacatcccgcttgtctctccttcctggctccacgtctctttctctgtcccaggtttgctgtcgtctgatctctgtc

SEQ ID NO: 84359 - DNA, 209 bp, Homo sapiens
  chr19:55963515-55963724
  hyper
ccggaaggcgggggccgggggcgccgccgcccggtcccaggggctcctcctagatccctggggagagggatgctgggcgctccgacgctgggggccaggggaccggaccttctgggaggggtctgggctcccagggtcggcggtgggggctccgattgcccaacgcggggcgggctgactgacagctctgacgccggtgtctctgagga

SEQ ID NO: 84360 - DNA, 77 bp, Homo sapiens
  chr19:559731-559808
  hypo
atttcatagacatgggatcacacagtgtgtgtccttctgtgtctggcgtctctcactgagtgcgacttcctcaaggt

SEQ ID NO: 84361 - DNA, 30 bp, Homo sapiens
  chr19:55974384-55974414
  hypo
ttattgtctgttccccgccaaaacacacac

SEQ ID NO: 84362 - DNA, 173 bp, Homo sapiens
  chr19:55976810-55976983
  hypo
ttggacccccaccctcgggggtctgctctgggaagccaggatgtttcccgaaattgatgtaacaaatgaccacggctcagtacctagaaccgcacgcgctgattctcctgcctgaagcagggatttaaacctgacatcatgagtttgcttcccaggcccgctcactggccagc

SEQ ID NO: 84363 - DNA, 30 bp, Homo sapiens; identical to SEQ ID NO: 46031
  chr19:55982821-55982851
  hypo

SEQ ID NO: 84364 - DNA, 30 bp, Homo sapiens
  chr19:55989384-55989414
  hypo
ccaggggcgacactgcggctaagactcgga

SEQ ID NO: 84365 - DNA, 53 bp, Homo sapiens; identical to SEQ ID NO: 37770
  chr19:56015184-56015237
  hyper

SEQ ID NO: 84366 - DNA, 68 bp, Homo sapiens
  chr19:56067053-56067121
  hypo
cacgccggactcaagcgttgctgcagcatctgggacacacctcaaagcgaagccgactccagccctcg

SEQ ID NO: 84367 - DNA, 30 bp, Homo sapiens
  chr19:56101733-56101763
  hypo
agggctcagatcaaacgccacctccgccga

SEQ ID NO: 84368 - DNA, 94 bp, Homo sapiens
  chr19:56156432-56156526
  hypo
gtgcactctggggaacgcccgtttcagtgtccacactgccctcgccgctttatggagcagaacacactgcagaaacacacgcggtggaagcatc

SEQ ID NO: 84369 - DNA, 220 bp, Homo sapiens
  chr19:56159449-56159669
  hyper
cctggcccgactgggcgagtccccgcgtccctgcccgttccgtcgctcagttccacgacacgctcccctgccgccccgcctgttcgcgggtgggtgggcgcttccctcggctccccgtgacactttgcagacgctccccggcgccgggcatgggcgccgccgccgtcggtccccgagccggattccgcgagcgggtgggtgagcgcggggggcctcggcc

SEQ ID NO: 84370 - DNA, 36 bp, Homo sapiens
  chr19:56159914-56159950
  hyper
aggtagaggaggcagcgcgcacgggctggacctcct

SEQ ID NO: 84371 - DNA, 33 bp, Homo sapiens
  chr19:56163910-56163943
  hypo
gctgaccacgcccatcgccgagctgctcattgt

SEQ ID NO: 84372 - DNA, 30 bp, Homo sapiens
  chr19:56164542-56164572
  hypo
ttcctaggagggggacgtgcctgggagggg

SEQ ID NO: 84373 - DNA, 39 bp, Homo sapiens; identical to SEQ ID NO: 46032
  chr19:56179648-56179687
  hypo

SEQ ID NO: 84374 - DNA, 145 bp, Homo sapiens
  chr19:56181784-56181929
  hypo
gaggtccctgctgtccgtgcaccctgctgtcccgtgcaccctgctgtcccgtgcaccctgctgtccgtgcaccctgctgtccgtgcaccctgctgtcccgtgcaccctgctgtccctgcaccctgctgtccgtgcagctgttaga

SEQ ID NO: 84375 - DNA, 202 bp, Homo sapiens
  chr19:56199417-56199619
  hypo
cagtggttgggagggcggggcaggagaggcagggtccgccctggggctttggaggctggggcaatggccctgtgctcggcgggcctagggcctggttggagcctgtcctctgcactgtggaggggggcaagggtccacaggccttgggggtggagagaacagtgtcaggacagagtttgagggtaggcggggttgctgagag

SEQ ID NO: 84376 - DNA, 100 bp, Homo sapiens; identical to SEQ ID NO: 46034
  chr19:56200496-56200596
  hypo

SEQ ID NO: 84377 - DNA, 53 bp, Homo sapiens
  chr19:56201665-56201718
  hypo
tctgtcacactttgtcgggcacctccttggtgccaggccgtgtgctgcacacc

SEQ ID NO: 84378 - DNA, 95 bp, Homo sapiens
  chr19:56205701-56205796
  hypo
tgtgtactcaaggagcgtctgagggcaggctcctctgagcctggaggcacctgtgaacacgcccccgctgccttcccccgcgggcctatagaccc

SEQ ID NO: 84379 - DNA, 30 bp, Homo sapiens
  chr19:56209262-56209292
  hypo
cccacagtgggatggcgagcttgttaaatg

SEQ ID NO: 84380 - DNA, 207 bp, Homo sapiens
  chr19:56230798-56231005
  hypo
gtgatccgccatgcccggcccggcccctggccaccttcagatctgtcttctccatcccgctcaaagggcaatgcatatgcaagtgtttatgcatggattgtttgctctccattgtgataattttttaaaagctcctcagtcttttgactttttattaattattgcatgcctgtatctaattatcttctgtgccgcatagaaagctcc

SEQ ID NO: 84381 - DNA, 210 bp, Homo sapiens
  chr19:56253382-56253592
  hypo
tactgttccattaaacgtatatgaggtacttaaagtggtcagaatcatagagacaaagtagaatgatggttgccgaggctgaagaagaaaatggagagctattgtttaatgaggacagtttcagttttacaagataaacagttatggagatggatgtgacgatgcttgtacaacattataagtgtatttagtaccactgaattatacact

SEQ ID NO: 84382 - DNA, 31 bp, Homo sapiens
  chr19:56256348-56256379
  hypo
gttttcattacaggccgggagcagtggctct

SEQ ID NO: 84383 - DNA, 196 bp, Homo sapiens
  chr19:56262254-56262450
  hypo
gatgcccagcaatcacggaatggatgaagaaactgtggtatatttcacttgttcatttcaccagtattgattcattgattctcatttcattctcaaggttatgttattgtaaatatttagtttggtattcaaattggtccacattcggcaagtgggacccacttcaatttcattttcatttcaagatccggtgaca

SEQ ID NO: 84384 - DNA, 30 bp, Homo sapiens
  chr19:56321275-56321305
  hypo
tgttgtccaagtcctcgaggatgaaaagga

SEQ ID NO: 84385 - DNA, 30 bp, Homo sapiens
  chr19:56346696-56346726
  hypo
gaaatctcgaccttgcgtctaaaaaactta

SEQ ID NO: 84386 - DNA, 30 bp, Homo sapiens
  chr19:56347904-56347934
  hypo
taaggaccaggaaggcgtggagcggtgagt

SEQ ID NO: 84387 - DNA, 196 bp, Homo sapiens
  chr19:56451612-56451808
  hypo
ctagggtgatcaagacgtgaccacagaaccaaatggagatgacagacttttatcttttaaaaatgtttacccgctagaatagctatgtttaaaatggaaaataatcagcgttggcaagaatgtggagaaaatgaaactttagtgcattgttgatggggatgggaaatggaaaatagtatggcgattcctcctgctg

SEQ ID NO: 84388 - DNA, 36 bp, Homo sapiens
  chr19:56477708-56477744
  hypo
gtgctgagatccccccggtgccgtctgcagtgtctc

SEQ ID NO: 84389 - DNA, 209 bp, Homo sapiens
  chr19:56538913-56539122
  hypo
cacttgctccttgagcgcgggattggtgagcatcagaagacacaagggttgcgtgcgatcatgaacaaccgtgagctgctcgaccagtgccaggtgcccgccgtgggctctctcatctgcgtggccctgcagctgcaggacgtggtgggggagagcgtcgcccccttcaaccaaacgctcacaggcctgcacgccgcttttgtgtttca

SEQ ID NO: 84390 - DNA, 30 bp, Homo sapiens; identical to SEQ ID NO: 46038
  chr19:56543855-56543885
  hypo

SEQ ID NO: 84391 - DNA, 30 bp, Homo sapiens
  chr19:56588880-56588910
  hypo
caaatgccaggcaggcgatgtgagggacca

SEQ ID NO: 84392 - DNA, 30 bp, Homo sapiens
  chr19:56602324-56602354
  hypo
aaggcagagagtattcgaatatggctcttg

SEQ ID NO: 84393 - DNA, 30 bp, Homo sapiens; identical to SEQ ID NO: 46039
  chr19:56603841-56603871
  hypo

SEQ ID NO: 84394 - DNA, 154 bp, Homo sapiens
  chr19:56617206-56617360
  hypo
caactccaaaaagcccgcgcgcccacggcagtcaccgcgcattcccccggccgcgcccacggcagtcaccgcgcattccgccctccgcgcccacggcagtcaccgcgcattcccccctccgcgcccacggcagtcaccgcgcattcccccctcc

SEQ ID NO: 84395 - DNA, 46 bp, Homo sapiens
  chr19:56638732-56638778
  hypo
gccccaggcctggcccgctgtctgggcttcgcggacctctttggtt

SEQ ID NO: 84396 - DNA, 30 bp, Homo sapiens
  chr19:5668242-5668272
  hypo
tttggaggccagagccgggggagcaggccc

SEQ ID NO: 84397 - DNA, 40 bp, Homo sapiens; identical to SEQ ID NO: 46041
  chr19:56686390-56686430
  hypo

SEQ ID NO: 84398 - DNA, 111 bp, Homo sapiens
  chr19:56688368-56688479
  hypo
ttcctctgtccttatcggaaatgcacctggcccccgcttcggaaaatgactggccgctctctccttgcagcgtgttccgcagctgtaggcacctgtcgtcctgccttcgat

SEQ ID NO: 84399 - DNA, 50 bp, Homo sapiens
  chr19:56709053-56709103
  hypo
cccgcatgccagctccgaaaccccacagccatcgccgctggacactcacc

SEQ ID NO: 84400 - DNA, 30 bp, Homo sapiens
  chr19:56709484-56709514
  hypo
agagctggttgacttcgcttattaaaacaa

SEQ ID NO: 84401 - DNA, 217 bp, Homo sapiens
  chr19:56727700-56727917
  hypo
atggtccccgccctccgctcgttatcgtgttgagaatgaaatgagaggacatgcttggcacctggagatgattggatattacagctgtgcgccataagggcaaatggttccattgtttgatgagccgtcctggcggtgggtgggtcggtcacttctaaacagataaggaatggctagaaagctcttgtaccaaaccagcttgaagcaacctcaccca

SEQ ID NO: 84402 - DNA, 134 bp, Homo sapiens
  chr19:56728469-56728603
  hyper
tgccaggaaacacaccgcgtggagacccagcatgactgctgactgattgcaagtccccaggagggctttatttttgcttttcaacatcctgttctgcaggttccttggctctttttgcccgtatgccgaagagc

SEQ ID NO: 84403 - DNA, 131 bp, Homo sapiens; identical to SEQ ID NO: 4695
  chr19:56728658-56728789
  hyper

SEQ ID NO: 84404 - DNA, 124 bp, Homo sapiens
  chr19:5676787-5676911
  hypo
gaactaagccacattcgtggagctgcaggacccggccgcctggatggaggggaggggccagaaagcagctgctcactggcctcgtccagtccttcccctctaacagtgacggtaacaggtgtga

SEQ ID NO: 84405 - DNA, 99 bp, Homo sapiens
  chr19:56806322-56806421
  hypo
gtggttgcctaggaccgcgggagaggggggtgagcccagagagatggggagtgactgctcaggggcaccaggtttggaggcaatggccaacgggtacac

SEQ ID NO: 84406 - DNA, 30 bp, Homo sapiens
  chr19:5681360-5681390
  hyper
aagaaggggccgatgcgttctgcagggctt

SEQ ID NO: 84407 - DNA, 38 bp, Homo sapiens
  chr19:56877841-56877879
  hypo
cattaattgggaggccattaggccgaggtggctccagt

SEQ ID NO: 84408 - DNA, 80 bp, Homo sapiens
  chr19:56879474-56879554
  hyper
cgcccccacggccgaactcacgcctacgtactcagtcaccagcggaaccctctccaccaggctccgcgtcgaggccctac

SEQ ID NO: 84409 - DNA, 90 bp, Homo sapiens; identical to SEQ ID NO: 1399
  chr19:56879555-56879645
  hyper

SEQ ID NO: 84410 - DNA, 345 bp, Homo sapiens; identical to SEQ ID NO: 37775
  chr19:56879646-56879991
  hyper

SEQ ID NO: 84411 - DNA, 30 bp, Homo sapiens; identical to SEQ ID NO: 45656
  chr19:5688079-5688109
  hypo

SEQ ID NO: 84412 - DNA, 30 bp, Homo sapiens
  chr19:56888933-56888963
  hypo
aaaaagaccttttgtcgtgtgatgcagttc

SEQ ID NO: 84413 - DNA, 34 bp, Homo sapiens
  chr19:56893758-56893792
  hypo
gaagtgctgggaggccgaggcgggtggatcacaa

SEQ ID NO: 84414 - DNA, 193 bp, Homo sapiens; identical to SEQ ID NO: 1401
  chr19:56904511-56904704
  hyper

SEQ ID NO: 84415 - DNA, 274 bp, Homo sapiens; identical to SEQ ID NO: 1402
  chr19:56904723-56904997
  hyper

SEQ ID NO: 84416 - DNA, 370 bp, Homo sapiens
  chr19:56904998-56905368
  hyper
taaaggcagcagcccggccttgaagccggatctcgcgatgtttcagggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagtt

SEQ ID NO: 84417 - DNA, 518 bp, Homo sapiens
  chr19:56915132-56915650
  hyper
tgtgcccagggcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 84418 - DNA, 284 bp, Homo sapiens; identical to SEQ ID NO: 37780
  chr19:56915651-56915935
  hyper

SEQ ID NO: 84419 - DNA, 30 bp, Homo sapiens
  chr19:56921699-56921729
  hypo
caatggagagaatgacgtctgtgaatcgat

SEQ ID NO: 84420 - DNA, 35 bp, Homo sapiens; identical to SEQ ID NO: 46044
  chr19:56987547-56987582
  hypo

SEQ ID NO: 84421 - DNA, 281 bp, Homo sapiens
  chr19:56988383-56988664
  hyper
cgcctcacacgcggcgccaacttcacacttgggcgcacaagccccgagaaccacagcagcgaagggcgcaaaccccacgccgtggcgggccgagaacccacgcaggcgcgagcccaccgcccacgcaagcacccgcgcagacgcccacgccatcgtggatgcgcaaacccacgcgcgccttggcaggaacgtccacgcagtggcgggcgcgccgcccacgccctcagacacacccacactctcgccagcccccttacctcggtcttcccgggctcagaccc

SEQ ID NO: 84422 - DNA, 138 bp, Homo sapiens; identical to SEQ ID NO: 37782
  chr19:56988963-56989101
  hyper

SEQ ID NO: 84423 - DNA, 179 bp, Homo sapiens
  chr19:56989173-56989352
  hyper
cggcctcacccgcggaggcggacaccgcccacccgcgcgtgcgcactacgcagtcatcctgcgacctccagaatccaccggggtgcagcgaggctgtggaaagtcccacccagaacgtgaggtgaagaaggcttgggctgcgctggttctgctctgtccgggtcggagatgaactgacc

SEQ ID NO: 84424 - DNA, 125 bp, Homo sapiens
  chr19:56989501-56989626
  hyper
cgcctgcgtagccggcgggctggcagtgagactgactgcgtcggggttgagactgggtggatgaggctcaccccggcggggagaagggacgaggaggggcggacagcggaaggtccgggagtgtc

SEQ ID NO: 84425 - DNA, 237 bp, Homo sapiens
  chr19:56989696-56989933
  hyper
cgtcccggtcatctgggcgtgcgggtcccgggttttgatcgcgcgtttgtgtaggtgagacccacattgtgttaccctgaacatgtgtgaggacgaacctttgtgttttcttatacgtgtgtctctgaggcgatttttgtggttttgtacgtggcggggggcactgattttgaatatgtgtgtatgttctggacatttgtttagcttctgcatccacttctgcggaagggcagagtt

SEQ ID NO: 84426 - DNA, 261 bp, Homo sapiens; identical to SEQ ID NO: 37784
  chr19:57018744-57019005
  hyper

SEQ ID NO: 84427 - DNA, 513 bp, Homo sapiens
  chr19:57019006-57019519
  hyper
caatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcgggaccactggagt

SEQ ID NO: 84428 - DNA, 41 bp, Homo sapiens
  chr19:57019931-57019972
  hyper
ggctcaatgagaggccggtgtgtgttcgagagagagaagaa

SEQ ID NO: 84429 - DNA, 146 bp, Homo sapiens
  chr19:57049841-57049987
  hyper
ggtgtgtagtcagagcggcctctgcttccggccacacccaggcccagcgttggccaccacttatgcggcggctgcggtccagggacaagtgagagcgacccgcagagggcaggacggacgggcgttgcataggcccggggccaaac

SEQ ID NO: 84430 - DNA, 48 bp, Homo sapiens
  chr19:57050064-57050112
  hyper
cgaggccacgcccggttccggcggcgctgcctgcgcactggaagtggg

SEQ ID NO: 84431 - DNA, 30 bp, Homo sapiens
  chr19:57050463-57050493
  hyper
gggcgggccgaggcccgactgtagggactc

SEQ ID NO: 84432 - DNA, 53 bp, Homo sapiens
  chr19:57051194-57051247
  hypo
gtttctatttcttcacgttctagtgaagtgatgggctacggggaaaagtttaa

SEQ ID NO: 84433 - DNA, 903 bp, Homo sapiens
  chr19:57078350-57079253
  hyper
tcctcacttttctatcgcgtaggccccgcccgcgccccaagccccgccctgtcatggttttcctctccagagggtagccgctacgccttaccgactgcgtttcagtgctgtcccactgctcctgcacaccccacgcctgcgaccctacccaccacggacaggcgctcctgcgagctggaagccagttctctgcgtcctgagcctggcagctgcatctgaacactcggagcctggcgatggcttccagaaacccctgcgccgtgggtcgcttcagtgaaggggcctgtacttcggcgacccagactccgggctgagaggcctcctaatccaaccaggaggaccaggagaggcccaaaaggggacacagggcagtgaccgccaggcttggagaggagccgctcctggcaaagccagcgccctatttctgaacgccgcctccgttccggactacacttcccaggggctattgcagcggaggacacgcccacttccggaaaggacccaaagccgggcgagtgcacgtcccgccggttgctgaggagaagggaggtctgggcggggcagcggccgaggctggactggggcgcggcgggggcggtgtcctggttcctgtgtgggcggcgggcgtgagcgtgcgcgtgtggcctggtggctgtgagtgcccatacgtggtgagcgtgcggtgctgtgctgaggaggggcgagcgcgcgcggggatggcggcccggtgtgtgactgtccggtgcgtggccgcgaatctgcgcctgcgtgcatggcccggcggcgtgcggaaggcggtgtgtgttggaatgagtgaagcactttaagtggccaagagcaggaaacccggccggaggaggcttaccccgttctcccctgtatcgactgcgtagagcccagtgt

SEQ ID NO: 84434 - DNA, 86 bp, Homo sapiens
  chr19:57106465-57106551
  hyper
ctcaatcctccctctcgccccagcctccttggccgcggagtcctctgtgagatggaggagctcagttggctccgctcggctccact

SEQ ID NO: 84435 - DNA, 321 bp, Homo sapiens
  chr19:57106588-57106909
  hyper
cgcgcgcgggtttctgggaagcgtagtccggcgcagtccgcgcaggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccaggtacggggagtgcagggctgggtgctggtccagggcgtgcgggcgcaggagagggcgtgcaggccgggaccgaggtgcgcctggagaggctgagcggccgaggagaggctgag

SEQ ID NO: 84436 - DNA, 272 bp, Homo sapiens; identical to SEQ ID NO: 37793
  chr19:57149347-57149619
  hyper

SEQ ID NO: 84437 - DNA, 875 bp, Homo sapiens
  chr19:57154182-57155057
  hyper
gctccttctcccttccgcccaccccggactcccggtttgcagactggagaaccacggggggcgtacgcaaagccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctgtgtaccctcgtggggcggcacgggcacgtgcgctcgtctcgctggggcttggtgtcgatgttcgctccccctggggtgttcagcgcacctgcccgagtgtgcacctgtgcgtgttcgcgttgtgtgtccgcctgggcccctgtggaccaccctgcaacggtgggagcgcagg

SEQ ID NO: 84438 - DNA, 22 bp, Homo sapiens
  chr19:57174105-57174127
  hypo
cagctggccaggcaccgtagct

SEQ ID NO: 84439 - DNA, 87 bp, Homo sapiens
  chr19:57174706-57174793
  hypo
taaaggccagccataggtgtttctgcaggtctacttgcccgtgccccatttataattttgcaccaggaagaccgcaggggagtctgg

SEQ ID NO: 84440 - DNA, 215 bp, Homo sapiens; identical to SEQ ID NO: 37795
  chr19:57182912-57183127
  hyper

SEQ ID NO: 84441 - DNA, 30 bp, Homo sapiens
  chr19:57189156-57189186
  hypo
tgattcaggcgtcaccgctccaacactgga

SEQ ID NO: 84442 - DNA, 35 bp, Homo sapiens
  chr19:5721426-5721461
  hypo
attgcaggcgtgagccaccgcgcccagccttaccc

SEQ ID NO: 84443 - DNA, 325 bp, Homo sapiens
  chr19:57276606-57276931
  hyper
aggcaggccgggtgccgggatgtagtgcgcctgcacgccgtctccagactacaactcccagaatgcgcggcgccccgagcgtatttccgcttccggtggcgttttagcgggagatccgagcgtctcggctggtggaaggggcgaggagctttgcagttgtgtgcgagtgtgtacaggtgagtttgtccgtacgcgtgattaagtgtgtgcgtgtgatcaagtgtgggggcgagtgttgcgtgagcaaacctgtgagagggtgagagtccgtccgtgtaggtgagggagctagcaagagtgtgagcgagtgcgaatgtccctacaa

SEQ ID NO: 84444 - DNA, 198 bp, Homo sapiens
  chr19:57334837-57335035
  hypo
gtgaagctgaccactcggggatggcgggtcatcttcatggaggccccaacccactgtgtctccatctggaagcatctggcagcgcctgcccatgggtgaccagtggggatgggtactcaccactgaaagaatggactgagtgaggtggtgaggactctcttctgttccgggtcatgtcgtcgtcgctggtcacgtcac

SEQ ID NO: 84445 - DNA, 30 bp, Homo sapiens
  chr19:57335688-57335718
  hypo
tccggcttttttgctcgcacccaaggcttg

SEQ ID NO: 84446 - DNA, 35 bp, Homo sapiens
  chr19:57399472-57399507
  hypo
ccaccgtgcctggcccaacccgtccttcttagaag

SEQ ID NO: 84447 - DNA, 159 bp, Homo sapiens
  chr19:57418761-57418920
  hypo
gtggaccgaggtctccgccttcttgtctcagttctcatattgtaaacaactgtccttttggccgtctatttagtgccacattttttgcactttggttggtgatttggctgttaaaaatggctcctaagcatcgtgctgatgtgccgtctggtgtccgta

SEQ ID NO: 84448 - DNA, 34 bp, Homo sapiens
  chr19:5746446-5746480
  hypo
cttttttttttgagacggagtctcactctgtcgc

SEQ ID NO: 84449 - DNA, 40 bp, Homo sapiens
  chr19:57477131-57477171
  hypo
agaggcgtgagctaccgcacccggccggattttcccttgc

SEQ ID NO: 84450 - DNA, 170 bp, Homo sapiens
  chr19:57491242-57491412
  hypo
tggatgggccaccctcgggggaggttctgtggtacggggtggtgcccaggacctccgatggatgggccaccctcaggggaggttctgtggtacagggtggtggccaggacctcacatggatgggccaccctcaggggcggttctgtaggccacctcgcgggactccatga

SEQ ID NO: 84451 - DNA, 180 bp, Homo sapiens
  chr19:5759631-5759811
  hypo
aatcccagctactcagggagatatttgcacacctgtgctcacagcagcgtgattcacaacagtcaaaaggcaaaaatcaacccaccggtccatcaccagatgaaaggatgaacacagcgtggtccatccgcacatcgcaatatgactcagacttaagaaggaagggagtcccgggccggg

SEQ ID NO: 84452 - DNA, 155 bp, Homo sapiens
  chr19:57610673-57610828
  hyper
tctgcacagtcagatcgcaggaacgcggcctagctgcttcagccacgttctcgcggcgccacctggtggccatggaccgccatcgccgctggacgtcagggccgccaggcccagcgagatgtcacctcctctgaggagccttccaggatcgcacc

SEQ ID NO: 84453 - DNA, 146 bp, Homo sapiens
  chr19:57610895-57611041
  hyper
cgctgtgtttcctgccgggtcgctaccgccatgatccgcacgtagtggtcaaggctgaggttgtatgaatgtggacgttataaccctggctccctctccctccctatgctgggctcccctcgatccccaggcggtggggtgcccct

SEQ ID NO: 84454 - DNA, 232 bp, Homo sapiens; identical to SEQ ID NO: 37798
  chr19:57617484-57617716
  hyper

SEQ ID NO: 84455 - DNA, 339 bp, Homo sapiens
  chr19:57617831-57618170
  hyper
cgaaaacggcctgggtccggcttcctcctcccctgaagcagcgaaggggcgtcactggcgcgctgttaaacgtcttcgccatcggttccctgcatcctccctcctgcctgggtagccagctcctgggcgcgcccaggcgcacacgcttccctcgctcctcctgcagccacaacgcccccaccccccccgcccgcccgccttgtgcggcagcggtgaccgccttctcctgctgccaccccctccaccccctgttcaaggtctgtcaccgtagggggcgggggggcgcgtggagccgctgggggttcggcccaccccgcgaaccgagctcccggccctgtg

SEQ ID NO: 84456 - DNA, 17 bp, Homo sapiens
  chr19:57618408-57618425
  hyper
cgcgttgggggattgtg

SEQ ID NO: 84457 - DNA, 25 bp, Homo sapiens
  chr19:57628160-57628185
  hypo
tgagacacggcgcctggccaatccc

SEQ ID NO: 84458 - DNA, 9 bp, Homo sapiens
  chr19:57683154-57683163
  hyper
ctctctgtg

SEQ ID NO: 84459 - DNA, 121 bp, Homo sapiens
  chr19:57683239-57683360
  hyper
cgtctgcccttttaccggcttgggtgcaggcaagggaaatgcgtccccgggccggggggcgcgagcgggggtccggggccgcgagctggggtccggggagcgcgagcgggggtccgggggg

SEQ ID NO: 84460 - DNA, 120 bp, Homo sapiens
  chr19:57683566-57683686
  hyper
cgagggggcggggcgcgcgagggggcggggcgcgccgggctcgtcctctccgcggcgctcagtggcagcagggagggccggtgagatgccagagcaaggtagggtcctgtatttggggac

SEQ ID NO: 84461 - DNA, 94 bp, Homo sapiens; identical to SEQ ID NO: 37803
  chr19:57683805-57683899
  hyper

SEQ ID NO: 84462 - DNA, 633 bp, Homo sapiens
  chr19:57702752-57703385
  hyper
aggctgtgcattatgcgtacggcgggagctgggccaacgacggcctaggacggggacgtttccgacggctcacgccggtgggggcgggacttccgggttgctcgctgcggacgccattttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgagtggacggtggcttcgcggttgccgcttccttgccagcgctgaggcggtttccgaagtgggtgggag

SEQ ID NO: 84463 - DNA, 23 bp, Homo sapiens
  chr19:57715571-57715594
  hypo
cgagactccgtctcaaaaaaaaa

SEQ ID NO: 84464 - DNA, 23 bp, Homo sapiens
  chr19:5774263-5774286
  hypo
actgcgcccggtcggctctgttg

SEQ ID NO: 84465 - DNA, 25 bp, Homo sapiens
  chr19:57751675-57751700
  hyper
ctgactcctggggctcgatttcctc

SEQ ID NO: 84466 - DNA, 33 bp, Homo sapiens
  chr19:57751722-57751755
  hyper
cgcttggtccctggcctccgagttgtgccccca

SEQ ID NO: 84467 - DNA, 374 bp, Homo sapiens
  chr19:57831613-57831987
  hyper
gtgcccatagtaaagcggcggccctaagacgacgcgggggtccttgtgcgcacttaaatggagtcggctgcgcttggtgagttcccacacccggtagatgtgagggaaaaactgccttactcagaaggcaccaccccttgcgtcggccgcggactctaggccaatgacgggccaggacacgggcgatttctgcgggccagggcggcggaggtgggacttccgcttcgtcgcgtgacgtcatctccgtgagcaggattggccctggaacagtgtggggcctggaccgctgggtaggcgcgtccagcggcctgagcaggggagggtaatgaggctgttacgcgccttctccgcatcttggcgggagcctgacgccc

SEQ ID NO: 84468 - DNA, 376 bp, Homo sapiens
  chr19:57832024-57832400
  hyper
cgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgagtggacgaggttttggccttgctgctgctctgctacttctggaggcctcgtgggcaggcagaagccaagacagccacaggatgtttctttgtcgccgtcgtttatttaagagaagtggccgtagcttgtcatttcctttatccgcagtcctgcaata

SEQ ID NO: 84469 - DNA, 29 bp, Homo sapiens
  chr19:57854360-57854389
  hypo
gctgggattacaggcgtgagccactgagc

SEQ ID NO: 84470 - DNA, 212 bp, Homo sapiens; identical to SEQ ID NO: 37806
  chr19:57862426-57862638
  hyper

SEQ ID NO: 84471 - DNA, 319 bp, Homo sapiens; identical to SEQ ID NO: 37807
  chr19:57862639-57862958
  hyper

SEQ ID NO: 84472 - DNA, 30 bp, Homo sapiens
  chr19:57866789-57866819
  hypo
tggttgggttcaaatcgaaccttcaacttg

SEQ ID NO: 84473 - DNA, 133 bp, Homo sapiens
  chr19:57874872-57875005
  hyper
accgaagtgacggagcggaaaagcgcgagaagcggcttggttccttgtacgcagaggcggtagtgacacaggcacaactgacagtggcagaagctcagctgacaaggactggggacggcggtgtccttgtctt

SEQ ID NO: 84474 - DNA, 30 bp, Homo sapiens
  chr19:57875222-57875252
  hyper
cctcagagctcccttcggggatctcaggtt

SEQ ID NO: 84475 - DNA, 30 bp, Homo sapiens
  chr19:57879906-57879936
  hypo
ttcagggtcccctggcgatggcagaaatga

SEQ ID NO: 84476 - DNA, 237 bp, Homo sapiens
  chr19:5789690-5789927
  hypo
agcggcagcgatcaccgaagaaacacttagcagccgactcctgcgaggaaacagggaagcagtgagggaggacagggagaccccggggcagcccagcagccagggttcaaactctagatcacccctcctggctcttgtgtccctgagcaagtcaggcacctcaccgtgcctctgcatctccatttatacaatgagaacaatgacaagccctacaatgtatcccgaggagaatgaaga

SEQ ID NO: 84477 - DNA, 67 bp, Homo sapiens
  chr19:57901622-57901689
  hyper
cagcctcagagctcccgttagggacctcaggttcagagcatggaggcgctgccgagtgggctgtgtt

SEQ ID NO: 84478 - DNA, 45 bp, Homo sapiens
  chr19:5790168-5790213
  hypo
ctctgctgcctcctccgtctgcccgtccgccgtctgtccatcctc

SEQ ID NO: 84479 - DNA, 70 bp, Homo sapiens
  chr19:5792712-5792782
  hypo
gatgcaattcaaacccgcgttgttcgcgggtcaactgtacataagtaaattaaaccgtaagtgagtaggt

SEQ ID NO: 84480 - DNA, 18 bp, Homo sapiens
  chr19:57989030-57989048
  hyper
accaacactagtaagcgg

SEQ ID NO: 84481 - DNA, 407 bp, Homo sapiens
  chr19:57998952-57999359
  hyper
tccaatctccatctccgaagttatgcccacttcctggaagtttggaggcacgggaactacattgcccaaaaggcgcagcgccgcgaggcggcgatccctgaccaatgaaaagaggtctgcccgagcgtgcgacacgcaatgggcgggacttccggcgtctcgtttggtattcactttcgcgactcaggtgaactaacctgcgagaagctggttgtgcgctgaggcgaccagcgccggaaggcacggtggcgactcacgctgttctcgccgctcagaggcgggtctgaggctcggtggcggcgcccagggtggcccgggccctttcctcggtcattgtctcccctccagctctactcacaggctccgatggcggcggccgccctgagggaccccgctcaggtgagcgc

SEQ ID NO: 84482 - DNA, 275 bp, Homo sapiens; identical to SEQ ID NO: 13572
  chr19:58011070-58011345
  hyper

SEQ ID NO: 84483 - DNA, 202 bp, Homo sapiens
  chr19:58011346-58011548
  hyper
cgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctcccccgaatcctaaagccctgtgagggccgcctgctcaggtcc

SEQ ID NO: 84484 - DNA, 30 bp, Homo sapiens
  chr19:58013681-58013711
  hypo
caacattagaaaatacgtggaggtaaggtt

SEQ ID NO: 84485 - DNA, 30 bp, Homo sapiens
  chr19:58019691-58019721
  hypo
attggctgcaccagtcgaatggagttttaa

SEQ ID NO: 84486 - DNA, 26 bp, Homo sapiens
  chr19:58032735-58032761
  hypo
gagagagactccgtctcaaaaaaaaa

SEQ ID NO: 84487 - DNA, 28 bp, Homo sapiens
  chr19:58038557-58038585
  hyper
attgagtcctcacagcgcggcggactgc

SEQ ID NO: 84488 - DNA, 344 bp, Homo sapiens
  chr19:58038923-58039267
  hyper
cgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaagggagagcgttgcgtaccgtgggggctgcacgcgcagagcctgggaggtgcgccggggtcgcgagcattcggaaacttgggggcggacctgtgtctgcagggagcagagagaatgaggagaagaaggcacggctgccatggcag

SEQ ID NO: 84489 - DNA, 176 bp, Homo sapiens
  chr19:58039797-58039973
  hypo
ggagacaggctggggcgtagactcaagccaagccttaaatttagacgggaaatcttaaggttttactttgagatgaagagagggagggctgaggctggaggctgggaaagtgtgggtcggccttggcgaagctgcctgcagataggagggccatggggttccgggggtacttccaa

SEQ ID NO: 84490 - DNA, 30 bp, Homo sapiens
  chr19:58043143-58043173
  hypo
tcttgggcagaacagcgtgggacagtgtaa

SEQ ID NO: 84491 - DNA, 166 bp, Homo sapiens
  chr19:58046095-58046261
  hypo
gttgcatttagcaagcgctgcctggatcccttgagcagagtggcatgtggagaagccaggtgaagtacctgtgtcatggatgctgagggcagtggagttcaaggtgtagcagtcacgatctggagatgtgttcccatgaatggtgtgcaaccggggagggagtatg

SEQ ID NO: 84492 - DNA, 937 bp, Homo sapiens
  chr19:58070569-58071506
  hyper
tgctgtgcactgagacggacacacacacatcacccagggagccgttcaagcttcctcaaccccgggggggggaagagtaaatatttctactttgcgcgcgcaaaaatgaaggacgaggacagtaacgggacttgttcaaggtcgcaggcccgagaaaggacatggttggaagagccacgaggaggactgcggtcgctcctctcacctgtgaggggttccgggaccctaaaagccctatttcataccacaacgccgcgcaccccagaaacggggacgctccccacgccaccgcgggcctgcattccggacccgggaccgcgcgacccccttctaggcctctaagaagcaacggcagggactgcactgaggacgaccctgaaacgccgtccttccgctcgtcgggcccgggacactgaggccgggtggccgcggggagccgagccagtctgctcacctgcgctgcgtccttcgtctccgccatccgaccgttggcaggacgaggccgcgtggggcagctcccacgggctcaaaaccctaccccgggtcctacaacggtgcggaggtgagccccagtcgccctaccatccttcccagcacagttctgagagcgcggaccaacacgccccaccacaaacgtccacgccagcgaggccggaagtcccgcccctgtgtcgcggtcgcctgccacgccttttcctgcgccggcccactgccttctaggtaatgtagtcttgtcccgtaagaggccaggcttggctctttttccttttttattatgcacaccatgtttctgtatatctcagatgatcttagcggagcaagtgtacacactggattgtaaatttttaaaacttcctattattcggatgcctcaacgtccctacaagcaggctgtgagcactcgcccaggcacccaggtaaacgagtttgataaagg

SEQ ID NO: 84493 - DNA, 507 bp, Homo sapiens; identical to SEQ ID NO: 37816
  chr19:58094961-58095468
  hyper

SEQ ID NO: 84494 - DNA, 370 bp, Homo sapiens
  chr19:58095469-58095839
  hyper
ctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtc

SEQ ID NO: 84495 - DNA, 179 bp, Homo sapiens; identical to SEQ ID NO: 46051
  chr19:58101908-58102087
  hypo

SEQ ID NO: 84496 - DNA, 752 bp, Homo sapiens
  chr19:58111112-58111864
  hyper
ggtccaggagaagggcgacctctgccagcccaagaagcggtgagaactacattacccagaggcccgtgagccaggttcttggcgtggagccaatgaggctcaggggagggacatttccgctctgtccaacttgtcggagcggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccaggtgagcgctgcgtcctcccggcctcctctgccctccccacccgaaactgagggacgcgtgaagggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagaggggcacggccccagtcacgcttctaaaagttt

SEQ ID NO: 84497 - DNA, 638 bp, Homo sapiens
  chr19:58125415-58126053
  hyper
ggcataatttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagccc

SEQ ID NO: 84498 - DNA, 135 bp, Homo sapiens
  chr19:58126054-58126189
  hyper
tagcagtcgggagcgtgtgtgaaccgtagtcaggcctgcaatgtcgaggggagaagttgctccttcattgcgaggacgataggagccatggcgggttttgaatggtggagggaagggatccgaaaaaggattttt

SEQ ID NO: 84499 - DNA, 375 bp, Homo sapiens
  chr19:58144370-58144745
  hyper
gacgcagcttcctagcgctcccagctgtctgcacacaaggcgccctccgtcgcagcctgggggagactacattacccagaaagccttgcgtcgagcggcagtactttgatccaatgaaaatccaagacaggggcatttccgtgtgggtctacccccgccccccccagggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagc

SEQ ID NO: 84500 - DNA, 33 bp, Homo sapiens
  chr19:58144954-58144987
  hyper
gacaagggacaggaccggcgcgtgcagggcttg

SEQ ID NO: 84501 - DNA, 30 bp, Homo sapiens
  chr19:58159508-58159538
  hypo
atttgagagaacttgcgacattccaatcag

SEQ ID NO: 84502 - DNA, 375 bp, Homo sapiens
  chr19:58175608-58175983
  hyper
atgaaagtgaggggtcgggggtcggggtcgggcgcggcgatgccgcagctgcggggctcggtggactcggcgagcaagagccccaggacgctgctggcggcgggcgaggagctggggcgcggcgcggggcggctctaggcgctgtggccgctcagcgtctgggacccagcgccgcccaggtcagggaatccttggtgttcccgccccgcagcacccggggcgggggaggagtcggcgcggtcgtgcggccgtggaggacagcgagacccggggctgcggctgcaggccgaggggcccctgggacagtgagaagcagcggcgggagctagtcacggggcagggagcgctcagcggtaaagacggcttcatctgact

SEQ ID NO: 84503 - DNA, 157 bp, Homo sapiens
  chr19:58177578-58177735
  hypo
aaacatgctaagcttcgatgcgccctggagaatttccacggggtgatccacgcacctccatgagatcctgcagcttgcttgtatgactggaagcattggataagcttcgcgtgctggctctccagttctttccttctctttacgactgttgtagctt

SEQ ID NO: 84504 - DNA, 148 bp, Homo sapiens
  chr19:58193437-58193585
  hyper
acgggacagagaagtcgcgaaagtgggccagaggttctgcgacaccacctcgggtgagctgcgccaggcccgggatagggactgttgtgttcgaatgcccgccccggtcggccgccgctccccgcctagtccacggagctcaatggcg

SEQ ID NO: 84505 - DNA, 32 bp, Homo sapiens
  chr19:58201272-58201304
  hypo
agagaaggatcattccgcggtccagggatgtg

SEQ ID NO: 84506 - DNA, 470 bp, Homo sapiens
  chr19:58219923-58220393
  hyper
agagcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcagactctgcgggtagagctgggccgggagcgacgggcgacattggtagggacc

SEQ ID NO: 84507 - DNA, 272 bp, Homo sapiens
  chr19:58220515-58220787
  hyper
cgctctgctatctctgatccggtgaacacacctcagagaagctaaaatggccgccacgaagaggcccccccaaaagtcccgtcctttctttttgtgactctcaaggaaagtcggttttctgagctcttactggcttagtagcgtggcgttcaacgcagagcattctaggtaatgtagttttcatagatcccgaggtgggtgccggggaccctttgcaccaacctcttggagtaaaagcgaagctccagggcgctgggcgatgagaaatggct

SEQ ID NO: 84508 - DNA, 61 bp, Homo sapiens
  chr19:58233532-58233593
  hypo
gaaatgatatatcttcgtgtcaagaacaggaaaggacagatagaaacgctgtgtggccact

SEQ ID NO: 84509 - DNA, 41 bp, Homo sapiens
  chr19:58237430-58237471
  hypo
cacggtgaacgtcccccccactcccccgcccccaccccacc

SEQ ID NO: 84510 - DNA, 413 bp, Homo sapiens; identical to SEQ ID NO: 1409
  chr19:58238326-58238739
  hyper

SEQ ID NO: 84511 - DNA, 25 bp, Homo sapiens
  chr19:58238987-58239012
  hyper
gctacaaggaggagccggaagtccc

SEQ ID NO: 84512 - DNA, 180 bp, Homo sapiens; identical to SEQ ID NO: 37828
  chr19:58239013-58239193
  hyper

SEQ ID NO: 84513 - DNA, 48 bp, Homo sapiens
  chr19:5825314-5825362
  hypo
tgacccctgtgcccacgcacatgtccatgcgtgcgcctgcgcgggcat

SEQ ID NO: 84514 - DNA, 35 bp, Homo sapiens
  chr19:5826174-5826209
  hypo
atatggaattcagatttagccgggcacctgtattg

SEQ ID NO: 84515 - DNA, 45 bp, Homo sapiens
  chr19:582760-582805
  hypo
acgctccctgctccacgtctgcgccgccgccggagtccactccca

SEQ ID NO: 84516 - DNA, 520 bp, Homo sapiens
  chr19:5827795-5828315
  hyper
agctgcgcgagctgacgccctgggctgggcggcccccaggtccgcgccgtcgggcggggccccggcggcggcgcgcgcgtgcgcggttgggggcgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtgtgaccctacctcactcggccggcgcggcggccactccccccgcctcgacggcaccactggccggccccgcgaaagactgcgcgtgcgtagagcacgccggcgcggccccgggactctcgcgataactgtactga

SEQ ID NO: 84517 - DNA, 460 bp, Homo sapiens
  chr19:58280911-58281371
  hyper
acattacccagaatccgccctgcgaaatggtaacgtggctgagccaatgaagcttcagagaagccgtgccattgccggggcacgtaaagtcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcctgctcaggtgagcgctgcgacctccgggccttacccaccctacccacccagaccctgaggcccctgatcgtgagggccgcctcctcgcgtccctgcagcccaggcctctgtcagggacggagaggcgccggc

SEQ ID NO: 84518 - DNA, 30 bp, Homo sapiens
  chr19:5829268-5829298
  hyper
cacgggggggatttacgacgagcccctgcg

SEQ ID NO: 84519 - DNA, 404 bp, Homo sapiens
  chr19:58361192-58361596
  hyper
cacgtaacgtaaggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaactcaggtaattgtggtgccttctgtgccctcaggtcaccccatcgtcacccaggtcctaaaccagcgagggagcggctcctgctcgtgggtctgtagccggtacccggcgtaggaacactgaggcgctcacaggaggcctctccttgtaaccgtccagtggg

SEQ ID NO: 84520 - DNA, 544 bp, Homo sapiens
  chr19:58400029-58400573
  hyper
cccaacgccggcgtccgggctgcagagccgtgaacaggcgctgctacctcgctgcttttgggtgacgatgaggtgacctgaggacacagaaggccccacaattacctgagcggagagcctcagcgtagccgcggcagccatcgaaccacgtggttttaagcagagtcgggaggatagggcgaccagccaggagatatgggcacgacggtccgtatcctggcccaggagtgggtcacgctgggcgccgtcacagagctccagagtagcctctgtgcagcggaggacaactgctccccgacttctgggttcagtcaccacagtgcggacctagcgctcaggagcctctcctacaaataaatccaacaccaatcaaaatggccgccaccagagggcgccggaagtccggacccattgtcacgtgcacacaggaaacgcctttattctgagccctcagaggtcttctacgctatcattcgaggctgagttttctgggtaatgtagttccctaggcaacaaggagggtaaagggcgcaattcccagagg

SEQ ID NO: 84521 - DNA, 102 bp, Homo sapiens
  chr19:58433214-58433316
  hypo
gagcgaaactccatctcaaaaaagaaagaaagaaagaaaatgagacatagggtttattgaggacttagatacagggcagtccaggagcggcaggctggacaa

SEQ ID NO: 84522 - DNA, 39 bp, Homo sapiens
  chr19:58438196-58438235
  hypo
tctccagtgtggcttcgctgatgctgaatgaggttgccc

SEQ ID NO: 84523 - DNA, 99 bp, Homo sapiens
  chr19:58438295-58438394
  hypo
cgctgatggttcctaaggtgtccctttcgactaaaagatttcccacattctccacactcataaggtcgttctctagtgtgaactcgatgatgttcagtt

SEQ ID NO: 84524 - DNA, 102 bp, Homo sapiens
  chr19:58445853-58445955
  hypo
gattacaggtgggagccaccttgcccgaccccctcagtgggttctttacgtgcttttgtagccaggagtgtctgaggggaaagcagacgttacaaaggggat

SEQ ID NO: 84525 - DNA, 45 bp, Homo sapiens
  chr19:58446296-58446341
  hyper
caggttccatcctcccgggtctgtcctccaggccatagcccgcgc

SEQ ID NO: 84526 - DNA, 423 bp, Homo sapiens
  chr19:58446423-58446846
  hyper
cgacgccgggtccgggctgcagacctgtgaacagtcgccgctctctcgctgcttcaggattcgggttaggatgaggtgacctgagggcagggaaggcacaattacctgagccgggagcctcagcgcggccgccgccatcccgagtacgcggggaaagcactgccgggagcggcgggcgccgttacggggcctaagatctgcctctgtgcagcaagaaggactcttcaccttctgggttcagacaccgcggttcggacccatagctccagcgcctctcacctcacaaaccgcagaaacacacccaacattaaccaaaatggtcgctaccagagaacgctgagaatcccgccactacgttacgtgcgcacacagaaacgcctttattctgagcccttactggttctgttgcgctgtcattcaatg

SEQ ID NO: 84527 - DNA, 79 bp, Homo sapiens
  chr19:58447418-58447497
  hypo
gcggctcaagaaccccgattacaatgttttttagggttttattaggttggtgcaaaagtaattgcggtttttgccatga

SEQ ID NO: 84528 - DNA, 45 bp, Homo sapiens
  chr19:58448051-58448096
  hypo
cctggagacactaggcgtatgttaaattatcgagcttgttatctt

SEQ ID NO: 84529 - DNA, 30 bp, Homo sapiens
  chr19:58455898-58455928
  hypo
gtagataacctgggccgggtgcagtggctc

SEQ ID NO: 84530 - DNA, 190 bp, Homo sapiens; identical to SEQ ID NO: 46056
  chr19:58457382-58457572
  hypo

SEQ ID NO: 84531 - DNA, 459 bp, Homo sapiens
  chr19:58458432-58458891
  hyper
ccctccccttcctggcgtagatttcataaccctttacagccaagggaaacgtagaaagagccaggcctcagagaagagcatctatggcggtattagatgggctcaagccaccccgtagccccatgcctggccttggagccgggtgccctcgcaatggctgtgtcacctctgtgccccagggctcagtggcgcctctcatcaggggctccttgccagtcgcgccctcccttccctagcacaccaggtgttggaaacgggagcccctccggcgagcccccgtgtcctgtcctgggcagcagggccgcgagcaagcgccctcgggggtgctaggactagcgtggggagggcggggaaggcccagaggacgcggcacatacctgggccggggccgtcagctcggccgccgccatctgactctgtgagcggagcggggccagagaggatgtccttattccgggc

SEQ ID NO: 84532 - DNA, 327 bp, Homo sapiens
  chr19:58458978-58459305
  hyper
cggatgatgctgacccagcgctccggggctttctaccaagtaatcagtccagacaaatgccaaaacgaccgccacaaggaggacaacggaagtcccgccgcgaccgcgcgtgcgcttacggaaacaccacctttcggaggcctcattggctgaaggtcgccgtcgcccaacgcaggccattctgggtaatgttcccacaggcgcacggcgggagagtgagggtcgcctccacctccttccggaagtaaaggccaaacccctgtagggggcgctgggaaatggacactccaggttggggcggaggcgaggcttcgttctttcttaaag

SEQ ID NO: 84533 - DNA, 30 bp, Homo sapiens; identical to SEQ ID NO: 46057
  chr19:58512170-58512200
  hypo

SEQ ID NO: 84534 - DNA, 1174 bp, Homo sapiens
  chr19:58513537-58514711
  hyper
atgtttaagggaacccggagctgtttccaacccaggtctgacgtccttcacagtgctttgtgtgaactggcagggggagaaacgacggctggggaacgaacggggttattcgtcccatcaatggcctcagaagcatccttatcacctgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctgggtaagtcgcggccccgcgggcctcggtttgcccatccgcaaaatggcgcctcgtggtaccgggtttcccgggaggagctcggcgagttctcagcgctctcgagggatccttccatttggcgttcgcaagattgtgagaaagtgactgctgttattctctttaagataaggaacctaattcgagctacccttctctgtgaagctcgacggctgagaacgtcagggctcgttcccaagtctctttccagaggccaggctttatgggagcatgggttaccagcgacgcaccctgtgagtt

SEQ ID NO: 84535 - DNA, 75 bp, Homo sapiens; identical to SEQ ID NO: 46058
  chr19:58517427-58517502
  hypo

SEQ ID NO: 84536 - DNA, 463 bp, Homo sapiens
  chr19:58520713-58521176
  hyper
cacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggc

SEQ ID NO: 84537 - DNA, 139 bp, Homo sapiens
  chr19:58521177-58521316
  hyper
ccgccctgatgtgtagtctccaggccgccccgaacaccagcccagcgggtcctggacccctaggtcatgtggctacagtggaatccaggcttggccgaatccaggacgaccaggccagacccaccggcagtaccttgcc

SEQ ID NO: 84538 - DNA, 102 bp, Homo sapiens
  chr19:58522940-58523042
  hypo
gtgctggattacaggcgtgagccaccatgccccacgaaagttcaacattttaagaaactctccatttgttttccaaagtgtttgtaccgtttcacattccca

SEQ ID NO: 84539 - DNA, 30 bp, Homo sapiens
  chr19:58524599-58524629
  hypo
accacaggtgtgtctcggtgcttcagaaca

SEQ ID NO: 84540 - DNA, 412 bp, Homo sapiens
  chr19:58536147-58536559
  hypo
tatgggaatgacacccgagggcctgagagtcaggaggccccagcggggcggggccgtgtggaggctggcggcacaagccctatggcctggactcaaaacccagcttcagcgccccagtgctgggtgagctgcaacgtgtcactgctagttccctcaatctcagtgtcctggtgaatgcagcagcgatcaccattctcttacagagaggtcatggtgagggggaggatggcgtcaggctgtagggcattggcggggagccaggaccctccgtggtagggcctcagcgtcacccccattgtggccaataccacagcaaatattaggggagggtacggctctgagtacttacctggagaaacctgtagagtcccaggagcctggccattggcatagacaacgccaagcatgtttc

SEQ ID NO: 84541 - DNA, 288 bp, Homo sapiens; identical to SEQ ID NO: 37839
  chr19:58545100-58545388
  hyper

SEQ ID NO: 84542 - DNA, 13 bp, Homo sapiens
  chr19:58545577-58545590
  hyper
cgggacgcccacc

SEQ ID NO: 84543 - DNA, 94 bp, Homo sapiens
  chr19:58545651-58545745
  hyper
gtcgggggaggcgggcccgggcccgggagggggcgggccgggccggggttccagagcccatcgggagtcctgaggtcgccgtaggggagggaag

SEQ ID NO: 84544 - DNA, 30 bp, Homo sapiens
  chr19:58551687-58551717
  hypo
agccactcttgcctgcgcctcaggggtgct

SEQ ID NO: 84545 - DNA, 45 bp, Homo sapiens
  chr19:58552006-58552051
  hypo
tgaggttgtccccagcgctcccaggaagcccggcctccaaactcc

SEQ ID NO: 84546 - DNA, 38 bp, Homo sapiens
  chr19:58559411-58559449
  hypo
ccaggaaagcagctgcgctcagacgatgccttctccat

SEQ ID NO: 84547 - DNA, 65 bp, Homo sapiens
  chr19:58565543-58565608
  hypo
acacaagctgtttctcggaagaccctggacacctgctccgaagccaagcacgggatggggcttcc

SEQ ID NO: 84548 - DNA, 145 bp, Homo sapiens
  chr19:58570949-58571094
  hyper
cgccccgcccctggccccacctctgccccacaccgggcactgggccgccacctttgttgatggaagagagaaactgaggcatagtgcccagggccaggggaccgcaaccacccggcccttgtcactgtagcgttaaggctcagag

SEQ ID NO: 84549 - DNA, 21 bp, Homo sapiens
  chr19:5857651-5857672
  hypo
gacgtgcgtgacacaatgttt

SEQ ID NO: 84550 - DNA, 18 bp, Homo sapiens
  chr19:58590342-58590360
  hypo
gagcgagactctgtctaa

SEQ ID NO: 84551 - DNA, 169 bp, Homo sapiens
  chr19:58597308-58597477
  hypo
aactaacaccactgccgtttccaccgaccaagtcttggggtggtctgtcatgcagcaagagaccatggacgtaactggattcctgcctcactcagacacggtggtgggagaatggtgaagcagtcaatgctgaggtctttgctggggctgatggcgctgggaggggccc

SEQ ID NO: 84552 - DNA, 30 bp, Homo sapiens
  chr19:58598247-58598277
  hypo
tgaccccgaggcaggcgactctcaccccac

SEQ ID NO: 84553 - DNA, 30 bp, Homo sapiens
  chr19:58598654-58598684
  hypo
cctcacccacctgctcgtgcccacccacct

SEQ ID NO: 84554 - DNA, 54 bp, Homo sapiens; identical to SEQ ID NO: 37843
  chr19:58609472-58609526
  hyper

SEQ ID NO: 84555 - DNA, 32 bp, Homo sapiens; identical to SEQ ID NO: 4715
  chr19:58609712-58609744
  hyper

SEQ ID NO: 84556 - DNA, 256 bp, Homo sapiens; identical to SEQ ID NO: 37845
  chr19:58609745-58610001
  hyper

SEQ ID NO: 84557 - DNA, 20 bp, Homo sapiens
  chr19:58622562-58622582
  hypo
gtaatcgctgctctgacctc

SEQ ID NO: 84558 - DNA, 76 bp, Homo sapiens
  chr19:58623655-58623731
  hypo
cctcccaaaatgtcccgattacaggtgtgagccattgcgtctagccccaacaccctggcatgattaaaaaacatac

SEQ ID NO: 84559 - DNA, 30 bp, Homo sapiens; identical to SEQ ID NO: 37846
  chr19:58629357-58629387
  hyper

SEQ ID NO: 84560 - DNA, 114 bp, Homo sapiens
  chr19:58629750-58629864
  hyper
cgactctccgcatgggcgcgcagagttcccggatgcgatattccggtgacaccggacgctgggggcggggcctagtgcgacgagggcggggccggggccggcccggggcggggc

SEQ ID NO: 84561 - DNA, 731 bp, Homo sapiens
  chr19:58661613-58662344
  hyper
gtgatctaacaccttcgagactcaaggggaagcggctcagcccactggctcacggccgccaattcagccggaggccgacccaagcctacactgcccctcacacctgacagaaaagctgcagactcgggggttacccccggagacggaccaggacacccagcaggcgtggcaaaacagtctctatgggagggcgggctagagatgcgagcgcggaactcacgggtgacgctaaggaaagagcgggggcgtccagaccagccccggagcgacctcgtcctcagaggagtgaccccaatcgccacggagcgtccccacccaccaggagaactacgcccctggccagaccctcgccctagcgggcccgacatgcccaccacccaggtgaaacccacccgcggacgcgcccctcgccgccccacaaggacccggcggacctccacccgccaagacttccctccgcaggaaacggaggcagcgcagggctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactttctcctatggtctcctctgatttttaacccgatgctatcattct

SEQ ID NO: 84562 - DNA, 48 bp, Homo sapiens
  chr19:58665878-58665926
  hyper
ggaggcattcgcgaacgccccagtggagccacacggtccatgcctctt

SEQ ID NO: 84563 - DNA, 354 bp, Homo sapiens
  chr19:58666141-58666495
  hyper
gcagtccgcgagaggcgaggaggatccttggactgtgggcaggatcgcaggcagcggaggccctgcccggaaggcgggatctggggacgatccccattcctcccagccgcagacgcggagcccacaggagtccccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 84564 - DNA, 183 bp, Homo sapiens; identical to SEQ ID NO: 13601
  chr19:58666550-58666733
  hyper

SEQ ID NO: 84565 - DNA, 738 bp, Homo sapiens
  chr19:58694552-58695290
  hyper
tagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccgggtgagtgccgcgcgaaacctgcgtccgtcgggggctgcgctgggcgggtccagaaccgttagttgggggcgagcgcggcctctgcattttccgccgagctcgggtaccctgagccggccgtgcctgcagtcctcccgccgctctgtgggatggggtcggtgacccggaaccccgaggggagacagtgctttcggggcgccgcggtggagagaacagatcgcctccggaagcgtggggtctgggccagggaggcgatcccctccgatgcgcgggacagaggaggctcggtgtcctctcggggaggggaaaactggtcctatccagtcctgtgggagtcctatgactcactctgggcgttttccagtttgggtggacttgtcatttcccgctgagggagccgttcctgggcggaggctgcggtagctccccagcggacaccttaagcctctccctcccctcccaacttcggtttcctcaggac

SEQ ID NO: 84566 - DNA, 32 bp, Homo sapiens
  chr19:58711048-58711080
  hypo
cagcctggcttatggtgcgagattccatctca

SEQ ID NO: 84567 - DNA, 30 bp, Homo sapiens
  chr19:58728930-58728960
  hypo
aactaaggctaagaccggttgggctacatt

SEQ ID NO: 84568 - DNA, 849 bp, Homo sapiens
  chr19:58739737-58740586
  hyper
cttccaccttccactcggaatgctccaagcagggcactcccggggctttgtttctatcactaggacgcgtccccacgcccaggctgtccctgagtccctgccacaggcgcagatgttggcgggcgcccttgcccctgagctcccggttaacggccttggactgttctcatggctcagtcttggtctctctccccagcagggcaaggcgccgggaaggcacccgagatgacagcgccgagccccataggcgctagtcccgccctggacgccgaccgccgcctccacagtctcggcttcggttgctggatgagaaccagcgtggcccgtttaagggggaggggacaggcgctgcaaggagcagagccgcgggaagcaactccctaagccacaatgctagtcgcgaacacaggaaaaagctcatcccgccgccgcggggccccatgctcccgccggcaatgactatgcctgtgggagcaacggctaccggcgcgcggccttctgggagttgtttgttgcgcggagcgcgggcacgtccgccggccaccggaagcaccgccattggccggtgcgtgcaggtgagtctggcggcctcaaggttggctcggaggtttcactgttagccgggtgcggccggagcgcaggaccaggccagagccgccccaagtgatctgggcgtgccggagaaacgagcagggcctgcgggggtccctcatgcggcgaggccgagcaagggcaggggcctgatgggatcgggatctctccggcctcagggacggggaaggccggtccagtcaggtttcccctgcaggagcgcccggctgggtctgagcttgtcgggaggctctcctg

SEQ ID NO: 84569 - DNA, 41 bp, Homo sapiens
  chr19:58749920-58749961
  hypo
tcactgctcagtacacgtgtgagcatcgatgtcacaggctt

SEQ ID NO: 84570 - DNA, 157 bp, Homo sapiens; identical to SEQ ID NO: 46060
  chr19:58836900-58837057
  hypo

SEQ ID NO: 84571 - DNA, 17 bp, Homo sapiens
  chr19:58855466-58855483
  hypo
gggcgcggtggctcacg

SEQ ID NO: 84572 - DNA, 120 bp, Homo sapiens
  chr19:58874833-58874953
  hypo
tctcaaaaaaaaaaaaaaaaaattgagtcgggatctcagaagctaagcagggtcgggcctggttagtacttgggagaccgtctgggaacaccgagtgctgttggctaaaataaataaata

SEQ ID NO: 84573 - DNA, 103 bp, Homo sapiens
  chr19:58891154-58891257
  hypo
catggaggttgcacacggcacaatgaggtcttatttgcccaagagaatgtgcagggaagtcgccaggcacggtggtgcatgcctgtaatcccagctactcggg

SEQ ID NO: 84574 - DNA, 41 bp, Homo sapiens
  chr19:58907596-58907637
  hyper
cggcagcccaggctccggccctatcctgccccccgcctccc

SEQ ID NO: 84575 - DNA, 30 bp, Homo sapiens
  chr19:58912378-58912408
  hyper
accaagggccaagagcggggcttcgccgga

SEQ ID NO: 84576 - DNA, 19 bp, Homo sapiens
  chr19:58915315-58915334
  hypo
actccgtctcaaaaaaaaa

SEQ ID NO: 84577 - DNA, 333 bp, Homo sapiens; identical to SEQ ID NO: 37852
  chr19:58951068-58951401
  hyper

SEQ ID NO: 84578 - DNA, 74 bp, Homo sapiens; identical to SEQ ID NO: 1413
  chr19:58951525-58951599
  hyper

SEQ ID NO: 84579 - DNA, 178 bp, Homo sapiens; identical to SEQ ID NO: 1414
  chr19:58951600-58951778
  hyper

SEQ ID NO: 84580 - DNA, 301 bp, Homo sapiens
  chr19:58951779-58952080
  hyper
gagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagc

SEQ ID NO: 84581 - DNA, 104 bp, Homo sapiens
  chr19:58964180-58964284
  hypo
atcaggggaggagttcggcaggtggctgaataggagagggtggcagcaatgtgggaaagaaattgcgggagcgctgagatcgagaccatcctggctcacacagt

SEQ ID NO: 84582 - DNA, 74 bp, Homo sapiens
  chr19:5896952-5897026
  hypo
ttcaaggaaggtgcccggaggattgagtgtgactctgtaggcagcggcggtcaggcctgcgagacagaggaggg

SEQ ID NO: 84583 - DNA, 181 bp, Homo sapiens
  chr19:5897577-5897758
  hypo
ctcctgctggcagctcgggcctgggctcgtcctgcacacctggctgtctggctgccgcccccgccacccagcctcgccactccggtcagcttttccatctctgccatttcccaggccgcctggcccctgacattggcttctatgcatgaggagcttgggccggggccgggcccagaactca

SEQ ID NO: 84584 - DNA, 150 bp, Homo sapiens
  chr19:58986525-58986675
  hypo
atccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagt

SEQ ID NO: 84585 - DNA, 30 bp, Homo sapiens
  chr19:58987127-58987157
  hypo
atctaggggctggcccggggaatggcgtgg

SEQ ID NO: 84586 - DNA, 74 bp, Homo sapiens
  chr19:59010888-59010962
  hyper
tagaggaagccttcgcggtccatggccagtacgtccccggtgttgtagtaaacgtcgcccgattgccgcacgtt

SEQ ID NO: 84587 - DNA, 16 bp, Homo sapiens
  chr19:5902541-5902557
  hypo
ccggattacaggtgtg

SEQ ID NO: 84588 - DNA, 30 bp, Homo sapiens
  chr19:59049735-59049765
  hyper
agccaggggccagggcgtcttcagggtggt

SEQ ID NO: 84589 - DNA, 33 bp, Homo sapiens; identical to SEQ ID NO: 45663
  chr19:5905436-5905469
  hypo

SEQ ID NO: 84590 - DNA, 43 bp, Homo sapiens
  chr19:59074323-59074366
  hyper
gaaaggctgttcgcccgtgtgcactctccgatgctcttccagg

SEQ ID NO: 84591 - DNA, 90 bp, Homo sapiens
  chr19:5910339-5910429
  hypo
aagcactctctacagcgattgcatctaatcttcgagtttccctgtagacacaggctttgtcctcattttacagctgtggaaagtgaggcc

SEQ ID NO: 84592 - DNA, 343 bp, Homo sapiens
  chr19:591245-591588
  hyper
tgtgcgtgctgtggccggagagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctcacacacgcgaccatggagggatgcgtgtgtgtttgtgtatccacgagtggggtgtgag

SEQ ID NO: 84593 - DNA, 406 bp, Homo sapiens
  chr19:5914724-5915130
  hypo
ctggaggagttccttcgggcgctgcgggtgagcccccacctcacagtcaaggcgtgtgccctgggcatggggcgacagaggatgctgagatgcggagacggggactcctccctaagagctgctgttaagaggcgcctgctggggcatacagccccagtgctctgcacagcgtcttgggggtttgggtgtgctacccaccacccccagtcaccacctcctgtcccagccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaac

SEQ ID NO: 84594 - DNA, 99 bp, Homo sapiens
  chr19:5915421-5915520
  hypo
agccacaccacagagcggggaggggcaggtgggggaatggaggctgcaggactggctagaccaggtccctgccggtccaccaggcggaggtgggacaaa

SEQ ID NO: 84595 - DNA, 44 bp, Homo sapiens
  chr19:5915925-5915969
  hypo
gctgggagctctgggcgggggcagaccggcggggccttgcagca

SEQ ID NO: 84596 - DNA, 192 bp, Homo sapiens
  chr19:592378-592570
  hypo
gcagatggctgatcccggggcttggggggaaggccggtggtaggagtgaagccctctcatccttccaccctccttgggcgtggtcgcctggaggcctgggcaggctgtggccccgctctgtgctctgaggcatagagggctcagaggcccctgtgtggaccaagtgcagccccaccccggcagatgagtgtt

SEQ ID NO: 84597 - DNA, 201 bp, Homo sapiens
  chr19:593124-593325
  hypo
ctgcccagctgtctccgccacgcccaagtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagt

SEQ ID NO: 84598 - DNA, 54 bp, Homo sapiens
  chr19:5957003-5957057
  hypo
gtgggactgctgcagcgggtatgaggtggggagtgccgccgctgggcatcagtg

SEQ ID NO: 84599 - DNA, 229 bp, Homo sapiens
  chr19:5960625-5960854
  hypo
agtgaaaatgtgaggcgaagacacttggtgccaggctagtaaggaagggctagaagagagagaaccatttggatgggagaggagtgcgcgctggtgttgagaaccgtgtcggtggatctgcaggtgcacggaagggactgcagctatttgagtaactatgggaggcctgggcaggctgtggtgccaaggtgctgcccggagccttctggacacacggcagggctgaggg

SEQ ID NO: 84600 - DNA, 218 bp, Homo sapiens
  chr19:5962237-5962455
  hyper
tcattctgtgcagggcgccacaggaagagtggagaacaggaagctgagggcagacgcttcaggagaaaacatctgactgaaagggaggggcgtgtttgcacttggtgaccaggcactgtggagccctggcactcccagaggggtgtgtggtgacagcatctacccctagatgtaagttctagaaagtggggcctcgtctgttccgtttctctctgtat

SEQ ID NO: 84601 - DNA, 267 bp, Homo sapiens
  chr19:599192-599459
  hypo
ctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtggggaccccggccatgataggga

SEQ ID NO: 84602 - DNA, 98 bp, Homo sapiens
  chr19:6007814-6007912
  hypo
taggaatgaagggaccggtgagacagacgggtgcgtgcgcccatcacgtgcactcagcacacgtcaagtgagcagccgtgatccgggctacagcgggg

SEQ ID NO: 84603 - DNA, 72 bp, Homo sapiens
  chr19:601680-601752
  hypo
ttttaaggagccacccgtgtttgctccgagtcgttttgattttcattttctcgatagcgaaagggttgggca

SEQ ID NO: 84604 - DNA, 30 bp, Homo sapiens
  chr19:6017660-6017690
  hypo
gtctaggctgagccccgcttccagagctcc

SEQ ID NO: 84605 - DNA, 237 bp, Homo sapiens
  chr19:6020825-6021062
  hypo
cacaaataagcagaacgctttccaaggaaatgtacatgtgtacccacatttgccacaatctgtcaggacagcacacttcttgatgaaatggatcaaatcattccttttaaggaaaaaaaatcccgaaatgccagcgcctccctctccccggccccccaacaaaggcctgtggttctgggctctttgcaggcacagcccctgtggacagatatcctcacctgccggtgggaaggcagg

SEQ ID NO: 84606 - DNA, 30 bp, Homo sapiens
  chr19:6023009-6023039
  hypo
taggtgggtttcccacgtcttccaccttct

SEQ ID NO: 84607 - DNA, 61 bp, Homo sapiens
  chr19:602546-602607
  hypo
ggcgtgagctgagcacggttcatttcccaccctggcttcccgccttcgctctccctgtgcg

SEQ ID NO: 84608 - DNA, 30 bp, Homo sapiens
  chr19:603816-603846
  hypo
ctacatcttccttatcgtggagaagggcat

SEQ ID NO: 84609 - DNA, 30 bp, Homo sapiens
  chr19:6042332-6042362
  hypo
cagttcagggagctgcgactgatccccaga

SEQ ID NO: 84610 - DNA, 185 bp, Homo sapiens
  chr19:6145786-6145971
  hypo
tgatctgggtgatgtcgctgtgacaggcaaccccctcaacaaccccctcaacaacctcaatggcttaacacaacacaagtgtgtttcttactcatgttgtgtgtctggcattgggggagaggggctacttcttcacatttgctccaccatttttgtgacaggacaatggacgatggggaattatg

SEQ ID NO: 84611 - DNA, 30 bp, Homo sapiens
  chr19:617617-617647
  hypo
ggctcgctgtgcaagcggacaaactgctcc

SEQ ID NO: 84612 - DNA, 30 bp, Homo sapiens
  chr19:6198569-6198599
  hypo
ttgcctgatgggatgcgggcatggagagca

SEQ ID NO: 84613 - DNA, 30 bp, Homo sapiens
  chr19:6237402-6237432
  hypo
gccaagcttgtccagcggctgctcagcatt

SEQ ID NO: 84614 - DNA, 52 bp, Homo sapiens
  chr19:623973-624025
  hypo
acaactaaagcctagcgctttgagaatcaaagacgcacgtccacataaaagc

SEQ ID NO: 84615 - DNA, 30 bp, Homo sapiens
  chr19:6280926-6280956
  hypo
gttttcagttagacacgaagaataagttct

SEQ ID NO: 84616 - DNA, 62 bp, Homo sapiens
  chr19:629547-629609
  hypo
cccagccaagcatcacggcgttgtacatgtccagcgtgagcagcttccgcttctgccgctgg

SEQ ID NO: 84617 - DNA, 321 bp, Homo sapiens
  chr19:6333454-6333775
  hypo
cacccacgcactcaccgtgttgtagaactcggccaccagctccgagtactggaagttgctctcacaccagtccacctcggagctctgataggcgaagatgctaggcatcttgtctcagtggccaccaccagccggctgcgcccggcagagagaaggcgagcttgggaaggctgggccctgatgaggcggggagaggacagcccggtgccccgcggcaggcagactgggaggaaaaacctgctgggccgctccccagttgcaccagggcagcctggctgtgcagtgacagcagccctgagcataagccgtgggactggcact

SEQ ID NO: 84618 - DNA, 84 bp, Homo sapiens; identical to SEQ ID NO: 45504
  chr19:634304-634388
  hypo

SEQ ID NO: 84619 - DNA, 18 bp, Homo sapiens
  chr19:6345197-6345215
  hypo
gcccggcctccgtgtgtt

SEQ ID NO: 84620 - DNA, 22 bp, Homo sapiens
  chr19:6351083-6351105
  hypo
atatgagttataggccgggtgt

SEQ ID NO: 84621 - DNA, 30 bp, Homo sapiens
  chr19:635350-635380
  hypo
cccagaacgaggactcgacctcactctgga

SEQ ID NO: 84622 - DNA, 215 bp, Homo sapiens; identical to SEQ ID NO: 45670
  chr19:6358251-6358466
  hypo

SEQ ID NO: 84623 - DNA, 94 bp, Homo sapiens
  chr19:638382-638476
  hypo
tggggccagtctcaccgctgtgggtcccatccccatcatttctcacaaggccctcagatcacccttccgcggtggggggcggacactctaagaa

SEQ ID NO: 84624 - DNA, 101 bp, Homo sapiens
  chr19:6393986-6394087
  hyper
gcagtaacacaactgcgcatgctcacggcgcaaccattcattgctccacttcgcaaatactccagcacctcctgggttcggggccccgcaaggtgaatctg

SEQ ID NO: 84625 - DNA, 241 bp, Homo sapiens
  chr19:639897-640138
  hyper
gagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggac

SEQ ID NO: 84626 - DNA, 94 bp, Homo sapiens
  chr19:640913-641007
  hypo
aggccctcattaggccgcacgtgacgagggcggacaggggactggctgggccggtccatccatggcgggcatggccaggcggggtggcctcggg

SEQ ID NO: 84627 - DNA, 30 bp, Homo sapiens
  chr19:6436032-6436062
  hypo
ttcaaaaaccaaaaccgaaaccaaacaaac

SEQ ID NO: 84628 - DNA, 15 bp, Homo sapiens
  chr19:6463907-6463922
  hypo
cgtgagccattgcgc

SEQ ID NO: 84629 - DNA, 145 bp, Homo sapiens
  chr19:6464334-6464479
  hyper
gagctaggtcaaagacgcccgggccaggtaggaaggcaggacgcaccgctaggcctgccccctcgcccgtccaccctgcccgtcccgtcccgtcccgtcccgtccccttcctttccccagcccaggaacgcgctcctgggagtta

SEQ ID NO: 84630 - DNA, 87 bp, Homo sapiens
  chr19:6501827-6501914
  hyper
agcacccagcggggccggctggtgccagcgcacccaggctgcagcccgggggaggcaccggggctctttgtgcgtgaggaggggaca

SEQ ID NO: 84631 - DNA, 93 bp, Homo sapiens
  chr19:6502684-6502777
  hyper
cttgcctcagtttctcggtccgcagccccccttctcattctatttagacctcattcgccagaatccttgcagtaaccgcgagccctcccagtg

SEQ ID NO: 84632 - DNA, 231 bp, Homo sapiens
  chr19:6531064-6531295
  hyper
cgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccgg

SEQ ID NO: 84633 - DNA, 556 bp, Homo sapiens
  chr19:6590325-6590881
  hyper
gcaggtctgaaccagcggggaacgtgaagtcgagaccttcaaaagaacttcttcgtttcccgaatcgttttcctggatgtcactgggcgcgagagcaccgcgcgcagcggactctctacgctgcaaaggcgcccggcgcggtccccaaagggacccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttttcttcccaacttttccatctcaactcaccccaagtgactcgagcggcagctgctgctg

SEQ ID NO: 84634 - DNA, 103 bp, Homo sapiens; identical to SEQ ID NO: 37096
  chr19:661158-661261
  hyper

SEQ ID NO: 84635 - DNA, 134 bp, Homo sapiens
  chr19:661586-661720
  hyper
tcctgggcctggccccgctctcccgccatgccccaactctagcactcgctcctcctctgtgacccagagacaggcggcttctcctgactccctccagccccttcctgggtctctactcccggggaactgcactg

SEQ ID NO: 84636 - DNA, 21 bp, Homo sapiens
  chr19:6623980-6624001
  hypo
accctaagggccaggcgtggt

SEQ ID NO: 84637 - DNA, 30 bp, Homo sapiens
  chr19:6664938-6664968
  hypo
acaccatgaaagccccgaagtaagaccggg

SEQ ID NO: 84638 - DNA, 35 bp, Homo sapiens
  chr19:676411-676446
  hyper
tctgcgttcgccatgcgtcccggggcgccagggcc

SEQ ID NO: 84639 - DNA, 111 bp, Homo sapiens
  chr19:6822252-6822363
  hypo
ggacctgtatgactgcgtggagaatgaggaggcggaaggcgacgagatctatgaggacctcatgcgctcggagcccgtgtccatgccggtgcgtgacgtggagggtcgggc

SEQ ID NO: 84640 - DNA, 21 bp, Homo sapiens
  chr19:6846939-6846960
  hypo
ttggagacagagtttcgcact

SEQ ID NO: 84641 - DNA, 71 bp, Homo sapiens
  chr19:6862981-6863052
  hyper
cgcaatctcccagagcgctggcattgcaggcgtgagccaacgtccgcagccaaacacgttcatattgttga

SEQ ID NO: 84642 - DNA, 48 bp, Homo sapiens
  chr19:689360-689408
  hypo
caaagacttgacaggcgtgaggggaaaggctcgcggtgtctggggaac

SEQ ID NO: 84643 - DNA, 180 bp, Homo sapiens
  chr19:696811-696991
  hypo
ctgagccaccgcgcccagcccggcaggtcttcacctttcagtgggagcgttcttagtggcaaagttcaggtcgtaaattgcagctcacacagccgggtgatggcgttcacggcagtggctagcagtggggtgctcgtcagcgcttaataatgaacaggctggggccgggtgcagtggctc

SEQ ID NO: 84644 - DNA, 30 bp, Homo sapiens
  chr19:6985326-6985356
  hypo
aggggaataaatatacggtaagttaacaca

SEQ ID NO: 84645 - DNA, 401 bp, Homo sapiens
  chr19:6986177-6986578
  hypo
tctgctgaagaggtacgggttttatttgggctatgggtttatgtgttttgggcagaggacacatggaacagaatagttatcactaatgagagattaaattaaaaccccgttaatatttttaccttcacacttctcagaggaatcatgaaagtatgtcctgccagacctggcccgaaagccatcttcacaagtacagtgggtgctgttgtggcagctggcatatttagggcatggaggacaggaagctgcagagaaacagaaatattcagtatgcatctaccacgtaccgatgctgcggtcagaagaatgtcatcttaggaatgcctctgttggcatccttttggcacccagcccattgctgaacacagtggcacacagtgcccagccgtgtcccacttctg

SEQ ID NO: 84646 - DNA, 30 bp, Homo sapiens
  chr19:7005228-7005258
  hypo
cagactccgggtgatcggggagcagctccc

SEQ ID NO: 84647 - DNA, 76 bp, Homo sapiens
  chr19:704330-704406
  hyper
ctgctccccacaggacgcggatgggcgctgcagtgcctgtgggtgggtgagcgcagtgaggcggtggaagtgaggg

SEQ ID NO: 84648 - DNA, 191 bp, Homo sapiens
  chr19:709228-709419
  hyper
gcgccccattgggggcgtcgctgcccccgcgaggagcaggaggcggcgcggggctgctggggccgcagcgcagccgggaagagactcgggctgggccgcgcctgccgggaggcctccccgctcccggaccccggctgcccacccaccggcgcgtggggacccgggcagcggcggctcgggccagtccagga

SEQ ID NO: 84649 - DNA, 94 bp, Homo sapiens
  chr19:709624-709718
  hyper
ggtgccccccacccccgcccttcccaagggcctccaggggtgtcctgagccccccgccactgcgcaggtcccgagttaccgctggagggagagg

SEQ ID NO: 84650 - DNA, 76 bp, Homo sapiens
  chr19:7116391-7116467
  hypo
tgcacacacatcagccgtgtctaatggacacacacacgtgcatacacacgtgagcacacgccgggaccacagaccc

SEQ ID NO: 84651 - DNA, 38 bp, Homo sapiens; identical to SEQ ID NO: 45673
  chr19:7168432-7168470
  hypo

SEQ ID NO: 84652 - DNA, 396 bp, Homo sapiens
  chr19:7184240-7184636
  hypo
cacagttttaacaagcggcatcgtcacaaccaaccccacgttccttctcctctcggctgccccccagacccacatccagaactcacttgctggaattcatcgtgtacccggagggacactcagggatgcacttgttgttgtgaatgacgtactggtggcagccctgcctccgcgagttcttgcatttgtggtgcaggtcctggcagaagctgaagttcacacagcgccagtcctggaagtggtagtacgggggcgggcaggtctccacacacctgccgtccaggtagaagttgcggcaggccacgcacttggtggggtcgtcgggctgagaacagttgcccaggcactcgctgtggcaacagaggccttcggcggtgcagccgtgtgacttacaga

SEQ ID NO: 84653 - DNA, 329 bp, Homo sapiens
  chr19:7197100-7197429
  hyper
aacttttgacagcttcgtggtcagcagcgacgaccgcaggagcgcgtgtccttgaagcggggaagcgccccttttccttgcctgacaataccgccccacacgcgatgacgcctttggaatagaactgcgcagctctttggagacatacggcgcatatagaggctagaaagggaacagagtaccagagggccttcccgcttcgggagccgcaggcttcttctcttcggagagagagtgagtgagtgagtaagcgagtgagtgagtgagtggggagggagtgagtccgtccacgggggcgggccctctccatgctgcggatctcttaggag

SEQ ID NO: 84654 - DNA, 30 bp, Homo sapiens
  chr19:724198-724228
  hypo
gggtggcgagggcttcggtttctggacctc

SEQ ID NO: 84655 - DNA, 44 bp, Homo sapiens
  chr19:7267703-7267747
  hypo
ggtccttcaggctctcgagcccatagacccggaagagcagcaag

SEQ ID NO: 84656 - DNA, 50 bp, Homo sapiens
  chr19:727011-727061
  hypo
agcggaagcggcaggcggagatcgagaacaagcgccggcagctggaggac

SEQ ID NO: 84657 - DNA, 219 bp, Homo sapiens
  chr19:7293527-7293746
  hyper
ctccagagaggagcccgcggcggggcgggcaccggggcaaggttcctcgggctcaggtcgggcacgcagggcgcggaggcgcgagcccgggcgggcaaaggccaaggtcagaggcttcccgctccccctacgcgatgcaggagctaccgtcctggccaccgccccccgcccctggggagggttctcagtccacaagcgggggctcgattttggcttggg

SEQ ID NO: 84658 - DNA, 30 bp, Homo sapiens
  chr19:743036-743066
  hypo
gtcctcaccagcgctcgtagcccattctcg

SEQ ID NO: 84659 - DNA, 309 bp, Homo sapiens
  chr19:748300-748609
  hypo
gaagcaaataaacagcgtgaacagccccagttcctggagttcttgcctttcaacctggcgaggaaggcgtggccaggccagggggtggggcctgccggcctttgagccattaaagggaggctgagcagggttgcggtgtgctggcttcacctgcctgcacccgctcaccctgagcgccttggggtggtgggaggcgctggaatccccactgtgcaggtaaggcctggctgtaaggggctgctgtgggggggcaggactggcttcccggggggccctcgggttctgcggccgccccgtcctgtcctttgt

SEQ ID NO: 84660 - DNA, 36 bp, Homo sapiens
  chr19:750921-750957
  hypo
gggtggaggggcagccggcagcgggcacggtgcccg

SEQ ID NO: 84661 - DNA, 278 bp, Homo sapiens
  chr19:752081-752359
  hypo
cacttgctctgtcatcgctgtgtgacctcagatgagcaggttctcctctctgggtcccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttggccgacacagtgaaaccccatctcta

SEQ ID NO: 84662 - DNA, 98 bp, Homo sapiens
  chr19:752539-752637
  hypo
ggcgggggtgggcactgaggcacaggcagcaggggagggggcccagtggccttgaacccaagagctggaccccaggccccacccgctggcttcagtga

SEQ ID NO: 84663 - DNA, 104 bp, Homo sapiens; identical to SEQ ID NO: 45675
  chr19:7542252-7542356
  hypo

SEQ ID NO: 84664 - DNA, 48 bp, Homo sapiens
  chr19:7543263-7543311
  hypo
tgcagcaccagagcccgagggaggatgccccggcggggagcaggaggg

SEQ ID NO: 84665 - DNA, 30 bp, Homo sapiens; identical to SEQ ID NO: 45676
  chr19:7543713-7543743
  hypo

SEQ ID NO: 84666 - DNA, 279 bp, Homo sapiens
  chr19:7565964-7566243
  hyper
tcccgccgccatccacgccgccgtgggagctgctgcaagcgcaggcgcgggaacgcacgctcgccatgcaggccggcaacctgcacctgcacgaggacgcgcacgccgggatcggcctctccaacgcgcacgccgcctacggctggcccgagctgccggcgcgcacccgagagcggatccgcggcgcgcgcctcatcttcgaccgcgactccctgcctcctggcgaccgcgacaagttgcgcatcccgcccaccacgcaccaggcgctctttccacccc

SEQ ID NO: 84667 - DNA, 165 bp, Homo sapiens
  chr19:7572022-7572187
  hypo
agcgggtaagggaggcggaggggagccacccatcattaggcaacccccacattggtgtagagttatctcaggacgactatgctgtcaccctgtctcagagttagtgatcacccaggctcgggggcatcttaatatcccttcagcctgaagatcatccctagcttg

SEQ ID NO: 84668 - DNA, 202 bp, Homo sapiens
  chr19:7627647-7627849
  hypo
ggttcatctgttggacgcttgagttgcttccaccttttggctatggggagtcatgctgctgtgaacacaggtgtacaactatctggatccctgctttcaacttccttggctagatgcccgggagtggaattgttgggttacatggagattctgtgttgaattgaagaaacgccaaacttttccatagcggctgcaccatttt

SEQ ID NO: 84669 - DNA, 30 bp, Homo sapiens
  chr19:7655702-7655732
  hypo
ctggaaatgcttccccgggccaggaacccc

SEQ ID NO: 84670 - DNA, 30 bp, Homo sapiens
  chr19:7657876-7657906
  hypo
aatattaaaaacatccggctgggcgcggtg

SEQ ID NO: 84671 - DNA, 391 bp, Homo sapiens
  chr19:7706453-7706844
  hypo
ggcctgcctccaattcggcaaagcaggcttcagggaccagggacggctcccaggaggtgcaggtggcggcagcgggaagcggggcaggtgtgcacctgcagcggcaaccctggtgcttctgtcccctcctcgcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagtggggaccccacccagccccaccccgatgccgacccccccttaaccgcgtgcaacacctaacctttaacctctcttgtgaccccagccccggccctaccctggc

SEQ ID NO: 84672 - DNA, 127 bp, Homo sapiens; identical to SEQ ID NO: 45679
  chr19:7727784-7727911
  hypo

SEQ ID NO: 84673 - DNA, 340 bp, Homo sapiens
  chr19:7752247-7752587
  hypo
gcctccggcatgggtcgaccttggccgagcgtgaggctggtgccacctcagcctcccagaccctgagtagggttaacacctccagacccgaaatggcctccggttgaccgggcccactccccatcagcctgtccagccagccagcacttactgagtgccttctgtgtactaagccctgctctgggtacttccatgagtcaactcacgccctcccggcctcagggtgatccaccgccttcccctacagtattccaaggggccattggacctcagaggcttcatgtcctgcacattctccgtgtcatagagcaggaaaaaataaaaacgggagatcgaattc

SEQ ID NO: 84674 - DNA, 30 bp, Homo sapiens
  chr19:7755197-7755227
  hypo
ccttccagcccacttcgagaggttgggtag

SEQ ID NO: 84675 - DNA, 556 bp, Homo sapiens
  chr19:7794710-7795266
  hyper
agctgagagagactccgtccacccactggtagccctgaaccttgcccagatggcgcacagccctcaggcccagccagtaaccacggccacgcgtgttccgagtgaggaagccctagaaaggaggggacatctgagcctgcagagtccgccccgccctgccccaccgcctgaccacgccccctccccctgcgcacctgctcatccaggcccccaacgatcaccaggtgcgcgctggcatctgcgcagtgatcctgcgccgccgcccacgtcgtctttggcacagagaaaaagtagcaggagccctcgaaggacagccacgacgtggggcacggctcgcaggagtctgcggggtggcgagggtcagagaggtcgcgtgcttccaggggcaacgcaccgagaggatgcagtgggtaggggttcggccccgcgggctcaggggtggagacacagaaccaggccaaggtccaggagtgacagggtccgcttacgccctcacagcccgcccccgaccccccgtctcgctcactgttctggagcctcacggcctccagcgccc

SEQ ID NO: 84676 - DNA, 179 bp, Homo sapiens
  chr19:7795513-7795692
  hyper
aaggtcagagtgcagcgtcagggtcaggacggggtgcatgatcggggtcgggggtcagcactcaggacggggtcggggtcgggggacgcggccagggctcagggccggggtcgcgtcgggccctcaccgcgctcacgcagttcccgcagggcgctctcctgctccatcagcttcgcctg

SEQ ID NO: 84677 - DNA, 78 bp, Homo sapiens
  chr19:7795734-7795812
  hyper
cgtccccgagcctgggagccgcagggtgagaggggcgagggcggcgaggatggggcgggacttcggagaccagccccc

SEQ ID NO: 84678 - DNA, 30 bp, Homo sapiens
  chr19:7815355-7815385
  hypo
taaggtggcaagaggcgcccgtcggtgata

SEQ ID NO: 84679 - DNA, 516 bp, Homo sapiens
  chr19:7852955-7853471
  hyper
ttgctcgcgtctgagcgtgagcagagtgtgtgtacatctttgggccgtttgcagtcacgcgtgtgcacatggcgtgcacgtatgtgtgcgagtccccacgcgtttgtctcccatcggcgtgtgtgcacatagtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgagtctggccacggggtgtggaagggagtcccctgagtcctcccaagtgacccggcgggcatgcgttttgggatgggggtcgttccagcctcgaagcagacggcgg

SEQ ID NO: 84680 - DNA, 255 bp, Homo sapiens
  chr19:7853543-7853798
  hyper
cgcaagggtggggtcttgtggccgggatgggaggggggccggaggcgaggcctgcggcgagtggggcggcggggggctggtctccgaagtcccgccccatcctcgcctccctcgcccctctcaccccgcggctcccaggctcggggacgcaggcgctgctgcagaccacgagcgcggagcttggggaggcgcaggcgaagctgatggagcaggagagagccctgcgggaactgcgtgagcgcggtgagggcccga

SEQ ID NO: 84681 - DNA, 151 bp, Homo sapiens
  chr19:7853832-7853983
  hyper
cgaccccgaccccgaccccgtcctgagtgctgacccctgacactgatcatgcaccccgtcctgaccctgacgctgcactctgaccttgactgccactcctagcgccggccacacccggaccctgcccaggtgtaaccgtccttgaccctgt

SEQ ID NO: 84682 - DNA, 175 bp, Homo sapiens
  chr19:7854218-7854393
  hyper
taagtggaccctgcccgtgtgcgtcgccggaccccctctttgaccttggcctggtcctgtggctccacccctgagcccgtggggccaaacccctaccccctgcatcctcttggtgcgctctccctggaagcactcgacctctctgacccttgccaccctacaggttcctgtgagc

SEQ ID NO: 84683 - DNA, 43 bp, Homo sapiens
  chr19:7854456-7854499
  hyper
cgtgggcagaggcgcagggccactgcgccgatgccagcgcaca

SEQ ID NO: 84684 - DNA, 232 bp, Homo sapiens
  chr19:7914950-7915182
  hypo
caaacccagcatggccgagctcgggctctgcatctatcagttcgagtacatgctgcaggtgagcagggccgcaggagagcagggctgcaggagggcagggccacaggtgggcagggccgcaagggagcaggatcgcagaagggcagggctggcaccctagaccatacccgggcacctcttggactgaaaattccaagcctgtgaaatcacacctggacgttccaactccaaa

SEQ ID NO: 84685 - DNA, 74 bp, Homo sapiens
  chr19:7926897-7926971
  hyper
ctggcaggtgagggccgggtgggcgccggcgggcagagcgccccctagggccatcccctcggggttcttgggcg

SEQ ID NO: 84686 - DNA, 120 bp, Homo sapiens
  chr19:7927433-7927553
  hyper
cggccccgccctgcccgtggcaccgcccccggacgcgcccctacatgaggccccgcccccaatccgcctctgccggcgtcctgcctcccgatctgcccctgcccgcggtcctcccgcccc

SEQ ID NO: 84687 - DNA, 82 bp, Homo sapiens
  chr19:7934175-7934257
  hyper
tcagcaggtgctgcacgacgctcgcctgcagcgcccccagtggcagctcgcccaggcgcgcctgcttcgggctccgcgagga

SEQ ID NO: 84688 - DNA, 122 bp, Homo sapiens
  chr19:793725-793847
  hypo
cctcactcccccccccgtttctcctgccaggctcagagtatcattttcaaaatggtaaccagcaaaccaacgtgattctcgcacaaaggcaaggtgagcctgttcctcgctcaccctgaatc

SEQ ID NO: 84689 - DNA, 79 bp, Homo sapiens
  chr19:7939141-7939220
  hyper
gcctctccacctgctcgcgtcgcgctcacctccgcctccggcctccggccgctcctcacagagtcgcctggggtggggc

SEQ ID NO: 84690 - DNA, 35 bp, Homo sapiens
  chr19:7939421-7939456
  hyper
agggtggcttctctgcggtccgggggaagcctgtt

SEQ ID NO: 84691 - DNA, 114 bp, Homo sapiens
  chr19:7953384-7953498
  hyper
gccctgactcaccctcgcggcccgcccgggaactctgcgggagtcgcggcagctccgctcccagagacccaggagttgggcccagcgtccctcccggaacggtgagtaggtggc

SEQ ID NO: 84692 - DNA, 30 bp, Homo sapiens
  chr19:7969667-7969697
  hypo
tccagaaatgcacatcgacccccagccagc

SEQ ID NO: 84693 - DNA, 30 bp, Homo sapiens
  chr19:7969931-7969961
  hypo
ccatatctagtctcccggctttttccccaa

SEQ ID NO: 84694 - DNA, 48 bp, Homo sapiens; identical to SEQ ID NO: 45682
  chr19:7970450-7970498
  hypo

SEQ ID NO: 84695 - DNA, 64 bp, Homo sapiens
  chr19:7981019-7981083
  hyper
gggcttcgccagcttcggaggcttctctaggggcgcatggctctgcaaccggctcagttgctgg

SEQ ID NO: 84696 - DNA, 30 bp, Homo sapiens
  chr19:7982356-7982386
  hyper
gtgtctgcctcaggacgaggcgtgcgccga

SEQ ID NO: 84697 - DNA, 184 bp, Homo sapiens
  chr19:7982589-7982773
  hyper
gcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcaggtaccgacgacctccgccaagccgggccc

SEQ ID NO: 84698 - DNA, 144 bp, Homo sapiens
  chr19:8009493-8009637
  hypo
ctgggattacaggcgtgagctaccgcacccggtctttttgcattactaacctgtgatatgggtttatgggacttcattatttcaaagggaggcagcttggccccggagagcatgcattcctggcttctgcgatggatagacttg

SEQ ID NO: 84699 - DNA, 30 bp, Homo sapiens
  chr19:803736-803766
  hypo
ggggcccatggtccacgctacagacccagg

SEQ ID NO: 84700 - DNA, 75 bp, Homo sapiens
  chr19:8053017-8053092
  hypo
tgagagccaaggacacgcctagatttctgagcagagctaccaagtggatggtggtgccatcggctaaggtgggga

SEQ ID NO: 84701 - DNA, 99 bp, Homo sapiens
  chr19:8057697-8057796
  hypo
taataatgggtgtggcggcgccatcacagctcacagcagccaaggctcctgggagatcctcaagcgatcctcacacctcagcctcctgagtagctggga

SEQ ID NO: 84702 - DNA, 30 bp, Homo sapiens
  chr19:8067340-8067370
  hyper
gttcagaggagggagcgagcctcacttccc

SEQ ID NO: 84703 - DNA, 82 bp, Homo sapiens
  chr19:807376-807458
  hypo
gagcccctccagcagcgctgtctctgccggcatgtgagtgaaggtgcttctcttaccgtgtgcccgtcgaggtaaacctgta

SEQ ID NO: 84704 - DNA, 42 bp, Homo sapiens
  chr19:8082518-8082560
  hypo
tccagacagagggaccgacaggagtaacggcacaaatttgtc

SEQ ID NO: 84705 - DNA, 46 bp, Homo sapiens
  chr19:8091663-8091709
  hypo
agtggtagtggctcccgggccctgggccaagcgctgtactgatgcc

SEQ ID NO: 84706 - DNA, 366 bp, Homo sapiens
  chr19:8115235-8115601
  hyper
aagtctgggtaacaccgtcttggccgcggcccgcgggttgggaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctctggtggggcggggctgaccgtgcaagccccgccccagtctaagcccctcctacaaagcccggccccttaccataagcgccatctgtcaggctccgcccactgtcttaa

SEQ ID NO: 84707 - DNA, 38 bp, Homo sapiens
  chr19:811976-812014
  hypo
ctaggatcccctttccgtaaaagcgtgtaacaagggtg

SEQ ID NO: 84708 - DNA, 60 bp, Homo sapiens
  chr19:8124525-8124585
  hypo
tctggttggatcattcgatagaacagctcacaggactcatggaagcgctctacttgtgtt

SEQ ID NO: 84709 - DNA, 134 bp, Homo sapiens
  chr19:813696-813830
  hypo
tcttctcgcgggccacgggccggggcgcgccctccagccgccctgggggccccagctcgtcggtgctcaccgacttattctgctgataaaccgagtcgtggccccgctgcgtcagggcccgcagcgcgtccttg

SEQ ID NO: 84710 - DNA, 312 bp, Homo sapiens
  chr19:814429-814741
  hypo
tcaccaggtaggcagcgatgcccgccccgatgaggaagccggcatacacgtccacagggtggctgcggtactgcgtgatctgcgtgagcccgcatacgcccgcggcgatggcaaaggcgaagaccaggatgggcttcagcagcttggtggtgtccgagatgaccgagttgaagtacatctggggcatgggggttggggtcagggagggctccccacgggtcagcaagagggcctgggaagggcagtgaggggccggactcaccgacacatagaccgcggcgaaggctgacagcgtggcgtgctgggacggga

SEQ ID NO: 84711 - DNA, 98 bp, Homo sapiens
  chr19:8148225-8148323
  hypo
aggtgagcaagcatacggcattcatctacatctgggaaaaagtagggtgcaaatggggctggctggctgcttcgcgcctccaccgaggaatgtctcct

SEQ ID NO: 84712 - DNA, 120 bp, Homo sapiens
  chr19:8151687-8151807
  hypo
cactctgtcgtccaggctggagtgcagcggcactgtcctcccactgcctgtcacctccactacctgtccctcccactgcctgtccccccccactgcctgtccctcccattcattgaagcc

SEQ ID NO: 84713 - DNA, 89 bp, Homo sapiens
  chr19:815479-815568
  hypo
ggctggcacaggccccggtgtggatgttcaccgaggtggcagtggctgcggtgcccacaggctggcacaggccccggtgtggatgttca

SEQ ID NO: 84714 - DNA, 30 bp, Homo sapiens
  chr19:8191057-8191087
  hypo
aacgtctgtccccatcgcaaaagactccag

SEQ ID NO: 84715 - DNA, 34 bp, Homo sapiens; identical to SEQ ID NO: 45686
  chr19:8194085-8194119
  hypo

SEQ ID NO: 84716 - DNA, 70 bp, Homo sapiens
  chr19:8196678-8196748
  hypo
cacgcagatgccgggcgtctggcactcgtcaatgtctgcagaagcagtggcggcacggggatgggttcca

SEQ ID NO: 84717 - DNA, 71 bp, Homo sapiens
  chr19:8214391-8214462
  hyper
cagggcgggctcctgcggcgccggggacccggggcgggaacgcaaagccgagaggccgaccccgccgcgtt

SEQ ID NO: 84718 - DNA, 32 bp, Homo sapiens
  chr19:821453-821485
  hyper
tcccccgggccccagcgcgacccccacccacc

SEQ ID NO: 84719 - DNA, 214 bp, Homo sapiens
  chr19:821728-821942
  hyper
ccagcacgcggcttccgggcgcccctacacccgggatcggggggtcggggccgggatcgccgaggagggcggggggtctccgggcgggagccagtccccgcgtggtggtggggggcatccgggagaactggggttccgggcggcggaggagactgggtccgcgcccccagccccacagcccctcacctggcgcggccggcgcccagcacaaagc

SEQ ID NO: 84720 - DNA, 401 bp, Homo sapiens
  chr19:822301-822702
  hyper
cgggggttggggtttcggggtctctgactgtctccgtgtctctcacggtctctcgccggctccgactgcccccgccccgcgcctccgcccgcccctccgcggagcccgccgctcgctggtgcgcgtttccatggcgaggctcccagggcgcccggagcatcggagacaaaagagctgggggagggggactggggggtctcccggtgcctccctcccttccccccgcactcaccctcgccccctccgccgcgccggggtccaccctccgcctggccgcagccgctcggtgcgcacggcgggattgcggggcgcggggctgggggctgggggctgcgggatgcgggcagggccctcgggacccgcactcgggcagtgcctgctgtctgcgtgcatttcctcct

SEQ ID NO: 84721 - DNA, 180 bp, Homo sapiens
  chr19:8253645-8253825
  hypo
cgcttctaagggaatatttggcaatgtctagcgatgttttgcgttgtcagaaccgaagggaggagtgttactgtcacgctgtgagtagaggcctgggatgccgctaaatacatacaatgtgtaggaacaaagattattcagctccaaatgtcaacagcagttgagaaaccttgctatacc

SEQ ID NO: 84722 - DNA, 30 bp, Homo sapiens
  chr19:8407763-8407793
  hyper
ccacacccagcccagcgcgaggggctggct

SEQ ID NO: 84723 - DNA, 644 bp, Homo sapiens
  chr19:8428713-8429357
  hyper
gtgcgccctctccgccactgggtaaggcgggggcggaatagggggcttgcaatttcacactagaggcgggcaccgtgggggaaagaagagtcacgtctcccacggttcgtagaggaaggcctgcctgagcctggagcgggggcgggagagccacagtttggcatccccagggcatcccccagcccgcagactaccaggcctccagaggacaggaccccacccccggccacaggccctgcccccagcactccccgcaccccgcctccaagactcctccgcccactccgcacccaacttataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagct

SEQ ID NO: 84724 - DNA, 32 bp, Homo sapiens
  chr19:8432333-8432365
  hyper
cactggtggtttggccgcgtgcccatccttac

SEQ ID NO: 84725 - DNA, 30 bp, Homo sapiens
  chr19:8461662-8461692
  hyper
ggaaggtgggggccacggagggttgtctgc

SEQ ID NO: 84726 - DNA, 83 bp, Homo sapiens
  chr19:8475442-8475525
  hypo
tggttgctattatggtaataactgactcaggcaagggtcatcaattgatattaagctcttggaaacggcgtgtgttgaggaac

SEQ ID NO: 84727 - DNA, 37 bp, Homo sapiens
  chr19:850004-850041
  hypo
tcttagctaagaactttatgaacgtgaatttatttca

SEQ ID NO: 84728 - DNA, 30 bp, Homo sapiens
  chr19:851519-851549
  hypo
ataaacagaggcaggcgacacagctgcatg

SEQ ID NO: 84729 - DNA, 30 bp, Homo sapiens
  chr19:8528381-8528411
  hypo
gatgtgcgtaagtatcgtctagttacttat

SEQ ID NO: 84730 - DNA, 341 bp, Homo sapiens
  chr19:8576789-8577130
  hypo
caggtgcttgaagagcgagcggtgcgtgcggaagcgcaggaggcagttctcacacctggaggtgggcagagggctgggctgggctgggcctccaggggcaccagggagagtgtcctgtgcaatgccacccgcccttcgagcgtgggaacggagcctgggcactaatcacctccccgctcctgtacaactgtggcagcgacccttcctgaccacttcgggtgggaacctggggaaacccggaaagaagtctcaattttaagttaggcggccggttttccacttgggaggtaaagcctggctgggtggggccacgcccacgtatgccccgccccatccaggga

SEQ ID NO: 84731 - DNA, 30 bp, Homo sapiens
  chr19:8601272-8601302
  hypo
tggcatacctgagggcggagggctggggtg

SEQ ID NO: 84732 - DNA, 46 bp, Homo sapiens
  chr19:869220-869266
  hypo
cacagggacgagggtcggtccgccacgtgcccggggagcctgaggt

SEQ ID NO: 84733 - DNA, 51 bp, Homo sapiens
  chr19:870952-871003
  hypo
ggagccgtgtggattcgggggtcccggggcaggacacggaggaaggagtcc

SEQ ID NO: 84734 - DNA, 30 bp, Homo sapiens
  chr19:877065-877095
  hypo
cccaccagtcgtagccggtcaccatgcagt

SEQ ID NO: 84735 - DNA, 729 bp, Homo sapiens
  chr19:883582-884311
  hypo
ggcatgtgtgtgagacgtggctctcgggcgggtaacagctgggccagcaggtgaggacggctgcaggagacgaggaggagtgtcggagcccaggactgcccagtggcttggctgtgggcagatggtagacacagacgtgcccagcgggggcaccgggcagtgaaggtgcaggtctgtgcagccacacggggtggcgccaggtgctgctgcaggagccagcgcagcccaaactgcctggtgactcaccacgaggcccaggggaaggaatgaggcccaacaaggccctggggaccgggcgaaggaacgagccctgggagaaggaatggcagcagccctcttcacctgcctggtgactcactacaagccctgggggaaggaatggcagtggccctcttcacctttactgcctctgcggccacaatgggcagttgacataaccacctgcaggccccgggagccatcggggcctcttgacacgtgctcattagtggcttctgaggagcgcctgccccacctgccccacgtgcccccacgtctggccactccagggtccattagcgctaatcggcaaatgcctgtgctctcatctaccgggaaaacatctcccttctccagagcggaggccagcctaaaaaccaggcccgcagcctccgaggctctgaaaaccaagcggctgttctggtccccggtcatagcaggcgggcgtccctgcttcgctccagccccagg

SEQ ID NO: 84736 - DNA, 60 bp, Homo sapiens
  chr19:885052-885112
  hypo
tggccacgccaccaccggagcctgagctgcgggaccctggggccacgcactgctgggcct

SEQ ID NO: 84737 - DNA, 100 bp, Homo sapiens
  chr19:891516-891616
  hypo
acactagctctctcccgaaggaagagcccgcagacaggcaagcggtggggcggctccctgtagccgaggcggggctgagtgacagggaacacctgtggcc

SEQ ID NO: 84738 - DNA, 30 bp, Homo sapiens
  chr19:892049-892079
  hypo
cacctgtggccgaggcgggggctgagtgtc

SEQ ID NO: 84739 - DNA, 41 bp, Homo sapiens; identical to SEQ ID NO: 45518
  chr19:893910-893951
  hypo

SEQ ID NO: 84740 - DNA, 258 bp, Homo sapiens
  chr19:900808-901066
  hypo
cgccccagccaggcccgcacctctcctccggtcctccccacggccagggcccctcctccgcgccttgctcctgccctcatcctccaggtagcgaagaacccgctcctgctcctccccggagcggttcatgaaatcgttccagacctggaagagaggcagggaggcaggcttgccatgaaacactggggctgcgctgacatccccgggcaaatgggcacggtaaggccgccaagcacgtggacgcgctcctgcggtcac

SEQ ID NO: 84741 - DNA, 30 bp, Homo sapiens
  chr19:911544-911574
  hypo
gtaacccccaccactcggagaagaggccac

SEQ ID NO: 84742 - DNA, 116 bp, Homo sapiens
  chr19:9129113-9129229
  hypo
aacgctgcagcctggcgttgaaggcccaccttgagccgggacccggcctgcattggactaacgtatgacttcgcttctcaccccgaagcctttgcctcggccgttccctgtgccgg

SEQ ID NO: 84743 - DNA, 30 bp, Homo sapiens
  chr19:919561-919591
  hyper
ttgcgcgccctgcaccgccgcacgccccgc

SEQ ID NO: 84744 - DNA, 30 bp, Homo sapiens
  chr19:920788-920818
  hyper
ggactgctggaacagcggctattcttctgt

SEQ ID NO: 84745 - DNA, 111 bp, Homo sapiens
  chr19:9261611-9261722
  hypo
acttgagaataattccgggaggttgtgaggattaaataggagtggccctggaaagactcaggagaatgtctcataccttgtaaacactacacatgtcgttatttgtagaat

SEQ ID NO: 84746 - DNA, 22 bp, Homo sapiens
  chr19:939412-939434
  hypo
ggcctctcgatacacttttggt

SEQ ID NO: 84747 - DNA, 158 bp, Homo sapiens
  chr19:9434811-9434969
  hyper
tggtcctagcctttgcgcgtgcgcggcgtgtctgcgtgggcgcatgcgcataacggccgccatcttaacagcgcgttcccgttggcgtctgaggtaagtttttgtttctgggcggcgttcggtggtgtcccggtgcagccacgcgagagtagaagggt

SEQ ID NO: 84748 - DNA, 30 bp, Homo sapiens
  chr19:9435206-9435236
  hyper
gcctgtcattcccagcgctttgggcggatt

SEQ ID NO: 84749 - DNA, 113 bp, Homo sapiens; identical to SEQ ID NO: 45520
  chr19:945999-946112
  hypo

SEQ ID NO: 84750 - DNA, 118 bp, Homo sapiens; identical to SEQ ID NO: 1354
  chr19:9473938-9474056
  hyper

SEQ ID NO: 84751 - DNA, 228 bp, Homo sapiens
  chr19:9517563-9517791
  hyper
gaagaagtgcggtgtcggcaggaagtcccagcgcgacgtccgggaaagccacaggaggaggcgacctgcaggaggctaccctttgaccccaaccctactctccagtcctcctagtctggtgggagcaaccttagactggttgatgtggaaggaggcgggcctgcacgcggagtacggcattcacttccgtttccgggagcgcacttccgtttccaggcatgagggcaa

SEQ ID NO: 84752 - DNA, 106 bp, Homo sapiens; identical to SEQ ID NO: 37189
  chr19:9517879-9517985
  hyper

SEQ ID NO: 84753 - DNA, 30 bp, Homo sapiens
  chr19:9545256-9545286
  hypo
catgaaacttggatacgtaatagatcccaa

SEQ ID NO: 84754 - DNA, 919 bp, Homo sapiens
  chr19:955719-956638
  hypo
aggcagggtagaccccgtaataccgggtcagaatctcagaggagaggaccttccgctcgccctggaagggcccaaggtgtgctggcctctacgtgcggttcttagccggggggctgcgtaacgaaggacctcaaaccgcgggcgtaaaacaaacgaaacctgttctccctccgtcctggagcccagagtccaaaatcgaggcgtccgcagggctgcgctccctccaggggctgcaggaggagccttccgcctctcccagctcctgggggctccaggagtcccttgacatgtggccggcctctgtctctgtgcgaccgtctccagtgcccaccggccttcactgtgactttttctcaatttgatcacgtctgcaaaggccctttttccaaataacgtctcgttctgaggttctgggccgatgtgaatttgggtgggggatggcgttcaccccaggacagccccagcggtgaagtcctccccattccagtacctgctgcctcaggcgtttccctggcaagctcgtcctgtccccctctccgccctgtccccctctccgccctgcccggctcacttttgcagctgagaaaatcaaggttcaagtaacgagcatttattaggcaactgctgtgtgctcggctgattccagactctgggaacaaaacagactaaaccccagatacactcctagatccgtgactcggtgatggacggggtctcggaggaagaacgtggaggggagggggcggcagccgggccggggtcagaggacgaggccgggcgtgtggccatgtgtgcgtgcctgtgctcatgggacccaccggcccggccagccgggtctacctgagggccccacacccctcaggcagctgaaggggaaagggcctccccggccaccataaatcagcgcaggaatgcaggc

SEQ ID NO: 84755 - DNA, 30 bp, Homo sapiens
  chr19:956878-956908
  hypo
gcagcaggggctgggcgtgggtctccttct

SEQ ID NO: 84756 - DNA, 235 bp, Homo sapiens
  chr19:957166-957401
  hypo
ttcccctctggaagacgttccggggcctggtgatcttcttcctccccagccaccaccctggcaggcagaggcggtcggtggctcatttcatagctggaggctgagactccaggctccaggtgcggggaagccagcaggagacaggaggaccgggatgggaagcagggcggggctctgggccaagtccccagcagcccccaggctctggtcccgcactcgccgctgtgtctcagtt

SEQ ID NO: 84757 - DNA, 215 bp, Homo sapiens
  chr19:959587-959802
  hypo
tctgggctccgggaccgcgggagaatagatttctgttgctttaagctgcaacgtgtggctgtaagggagttaaggatcgatttgagatgaggtggccctaaaaccagcaggctggtgtcctgagaagaggagagagagacggggagacggtcttgtggagacggaggcagagactggagcgctgcggccacaagccaggacgcaccttgatctgg

SEQ ID NO: 84758 - DNA, 585 bp, Homo sapiens
  chr19:9608851-9609436
  hyper
acggagtcaatcgaacgcgaacggcaaaattcttttccctctgaaacacaattcacaaacgttgccttggagacttattttttaaggcctcagaacgcttggacacttttgaagacgggaacacacggctgaaaacagccctcggacgcgcccatactgcacttcccacccggctcctctaggggaccgaaggtcccaatggcctcttcgacgtggcctcacccgatggctccgcgactcctgcggactcctgtggagtggtccaggcctctgtaaggaggttcctcgattaccctgggtcgattgtgacctctgccaccccccgaaacaccgcccaacccactagtccacacgagcctcaccaaagtagtgaacgaccagacaacacaaaggaaaaagtggctctgaggaaacaggcgccagcgaccaaaagagagaactggcgcgccgcaacgtcacttccgtttggggcattggaaggggcgtggctcgttgtgtgggcagttggacaggatggaactcttcaggattctagtttccctccgcgtgggtgcggaggtatcaaggggtcggctcagtgcctgg

SEQ ID NO: 84759 - DNA, 131 bp, Homo sapiens
  chr19:963944-964075
  hypo
cgggcgtctcccgcacgtccctcctctcagtaaccctcctcccgagggctgcgctgtccctaagcccaggttactggtggataaaccgaggcagagctgccccctctgcaccctctcgagcagaggttccc

SEQ ID NO: 84760 - DNA, 259 bp, Homo sapiens
  chr19:9649131-9649390
  hyper
gacggtccgagcggacgctagcgggcccagcagacacgagcagagcgggccaggcctctctaacgtccgggccaaacccgtccttcaccccaaaaccagttcatctcctcggaactcacccaggccagtgaggccttaactctgaaaggcaaaaagactctcaggcgctcacagccggcgtcacaaaaggaacggcgcaccgctgacgtcatttacgctctccgcctcgggccaggcggggtttcgggactagggtttc

SEQ ID NO: 84761 - DNA, 67 bp, Homo sapiens
  chr19:977345-977412
  hypo
tccatcctctgcagccgacacacagtccccgcctgcccatgacaggagggtgcggcccctcgggtgg

SEQ ID NO: 84762 - DNA, 92 bp, Homo sapiens
  chr19:9786287-9786379
  hypo
gcccaggcctgtgcccggctcgaccctgtctctattaaaatatatatataaggccaagcgccagtggttcacgcctgtaatccctgcacttt

SEQ ID NO: 84763 - DNA, 429 bp, Homo sapiens
  chr19:9903599-9904028
  hyper
gaagccccacctggtcgcaaaggctggtgcaggggaaaccgttggttcagctgcggttcctgggaagggggtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatggagggagtctgttgggcgggacctcgaaatgcctctgctcgctttcctctgcattcatgcggcttgtacgaggatgcgctgtttcctggtggtttgttatacggcagtagataact

SEQ ID NO: 84764 - DNA, 30 bp, Homo sapiens
  chr19:991396-991426
  hypo
agccagcaggagctccgggcttggcttggg

SEQ ID NO: 84765 - DNA, 158 bp, Homo sapiens; identical to SEQ ID NO: 45692
  chr19:9937353-9937511
  hypo

SEQ ID NO: 84766 - DNA, 35 bp, Homo sapiens
  chr19:9957583-9957618
  hypo
aggccttagggtacacggggcgggtgcagttcacc

SEQ ID NO: 84767 - DNA, 51 bp, Homo sapiens
  chr19:996004-996055
  hypo
tggctggtgccagggcggggtgagggtgcgcagagccgtagagggacagct

SEQ ID NO: 84768 - DNA, 72 bp, Homo sapiens
  chr2:100107653-100107725
  hypo
caacttcagtattctcgtcgctaatccaacgaatttagattgcatacttttcaaagacgtcataatttaaaa

SEQ ID NO: 84769 - DNA, 162 bp, Homo sapiens; identical to SEQ ID NO: 39613
  chr2:100108060-100108222
  hypo

SEQ ID NO: 84770 - DNA, 88 bp, Homo sapiens
  chr2:100196908-100196996
  hypo
caagttgacaatgcccggagacatttttagttgtcaccactgcgagtgggtgctcatagcatctactgggtggaggccagggatgctg

SEQ ID NO: 84771 - DNA, 178 bp, Homo sapiens
  chr2:100339611-100339789
  hypo
gcttttgtgtgtgcacgcatgttaagattaaatcgctcctttcattgccctgaatgctcataggatcactaaataatatatattgaaggattactcgggtgttgtccagactgtgtcatactgccaagcattgaccatctgaaaccaatcatgatcgatctcccgtttttaaaggagg

SEQ ID NO: 84772 - DNA, 104 bp, Homo sapiens
  chr2:100381776-100381880
  hypo
ttacattcttggccacgttttccacacaacccattcctgaacccctttccacagacaatttggaaatgtgcattcaataaaacccctgtcgcaattgcagagaa

SEQ ID NO: 84773 - DNA, 63 bp, Homo sapiens
  chr2:100403903-100403966
  hypo
tctgagaaagcctcacggtttggctctttggtgcatgaggctttaaggcgatgtgccccctgc

SEQ ID NO: 84774 - DNA, 186 bp, Homo sapiens
  chr2:100422787-100422973
  hypo
atatgcaacacagagcggaaaatagcccctgctctcatggaattcatgttccaggaaaagggcagacacgtaaacaagcctaacactgcaaatgctcagctctgcgatgggagtgtgtgccaggaccccaggagcatggaggaggatgaggacccctgaacaaattcaatgcgatgcaccaggaat

SEQ ID NO: 84775 - DNA, 210 bp, Homo sapiens
  chr2:100616138-100616348
  hypo
ctatgtgccagccaccgtgctaagcactgtaagtactaactcatctaacagtcataaaaatgctatcaggaggttctaccatgattctgtcacagatgaggcaactgaggcaccaggccatctggccagcaaatggagtgaagaaactcagacattccagctctagaacccacactcctcgctctgctctagaaccgggccaattacagc

SEQ ID NO: 84776 - DNA, 73 bp, Homo sapiens
  chr2:100623015-100623088
  hypo
tggaaactgaattcacgagggtcaaattgtcacttgtaactatgcagttgcatgtgaacggtgctgataaaga

SEQ ID NO: 84777 - DNA, 541 bp, Homo sapiens
  chr2:100720888-100721429
  hyper
ggagcagggctaagtcgaagctgtccatggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacccccaggtcggggctcccgacgccccccgcccccgactccgggccggccgggctggctgcagcggccggcgcactcacccgctccccggcttgcgcgcaggcacactcaagagagagcagcgagctcgccgcgccgccgccgccccccgcccccggccctgcgcccgcccctcctcccctccctcgcggcggcccggcccgctgctgcagccgccgccgccgccgccgccgccgcggtgctctgcgcccgcccgcccgcctctttctcctccgggaggcgcgtgtgcgcgggcgaggccgaggcgcgcgcgcaccgtgagccccgcgccgcgcccgccccgcgcgcccctgtactccccgcgccgctcctcggggtcc

SEQ ID NO: 84778 - DNA, 30 bp, Homo sapiens
  chr2:100820254-100820284
  hypo
gcttttccaactgtccgtcttgcctctgcc

SEQ ID NO: 84779 - DNA, 421 bp, Homo sapiens
  chr2:100937789-100938210
  hyper
aagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctc

SEQ ID NO: 84780 - DNA, 216 bp, Homo sapiens; identical to SEQ ID NO: 6285
  chr2:100938329-100938545
  hyper

SEQ ID NO: 84781 - DNA, 225 bp, Homo sapiens; identical to SEQ ID NO: 6286
  chr2:100938574-100938799
  hyper

SEQ ID NO: 84782 - DNA, 10 bp, Homo sapiens
  chr2:100938800-100938810
  hyper
ggacaggcac

SEQ ID NO: 84783 - DNA, 192 bp, Homo sapiens; identical to SEQ ID NO: 27375
  chr2:100938984-100939176
  hyper

SEQ ID NO: 84784 - DNA, 30 bp, Homo sapiens
  chr2:100993554-100993584
  hypo
cgttctcgacccaatcgcttttcaggtttc

SEQ ID NO: 84785 - DNA, 30 bp, Homo sapiens
  chr2:100995355-100995385
  hypo
atggtgctatgaacacgggccaccacaatt

SEQ ID NO: 84786 - DNA, 30 bp, Homo sapiens
  chr2:101007539-101007569
  hypo
tcttggaggcagggtcgctgtttgtttctc

SEQ ID NO: 84787 - DNA, 175 bp, Homo sapiens
  chr2:101009822-101009997
  hypo
tggttctgttatacacggtaatgcccggagggatagtcgggtatgacaccaggtggtcaatgccagcctcttttaagatgtatggggcatcgtcctccagggtctcgtggtgtccaatcacactgtacattatctcacagggagcacagagctctacatacgtcacccagtgaat

SEQ ID NO: 84788 - DNA, 42 bp, Homo sapiens
  chr2:101033591-101033633
  hyper
caatatcaataattccgcgggtcacagcatcccgcacaagga

SEQ ID NO: 84789 - DNA, 578 bp, Homo sapiens
  chr2:101033731-101034309
  hyper
cgccaggacaaaacccgcgggttccccggtttttccgtgcgccccgcggcggggagaggggcccaggcgctgaaacccacccgcctgcgcgtccccgagctcaccctactggagcggcgctcgtccgggtccttaggctcctcccctggccctgggggcgccgcgcgggtcgggcttcgccgggcctgtgggcgaagcgcgcggggtcctgggagctcgggaggcccgccccaccttgccccgaggcctccgcgccgcggcccgtcgggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttctgccgctgcaaaagcgttctttctgaccgagacctgcggccggaacaagtcccgctgggcctccatc

SEQ ID NO: 84790 - DNA, 125 bp, Homo sapiens
  chr2:101056687-101056812
  hypo
ggctgcacccgcgcgcgacacctgactcactaccggtcttcctactacttcacttccagcctcacacacgtgcctcccatggccacacagaaaggggaattctagccatacggcttaactacttt

SEQ ID NO: 84791 - DNA, 24 bp, Homo sapiens
  chr2:10115715-10115739
  hypo
taaacacaggccgggcgcggtggc

SEQ ID NO: 84792 - DNA, 30 bp, Homo sapiens
  chr2:101228276-101228306
  hypo
cttgttacctccatgcgtggaggaaggcac

SEQ ID NO: 84793 - DNA, 429 bp, Homo sapiens
  chr2:101435684-101436113
  hyper
aggagaggagggcagcggaggaggggagggagaggcagagtggagctccaagtgcccgctcctggccgcagccccacaccccacgtgcccctgccggggaggggggcaattagccggttcctttccatccttgacccattttccggaccagctacgttcgccttaggacaggcactggttattcctccccagcagtcgctgctgtcctccgccgaccaccgctcgcccgcatcttccccgacccccgcctcccacctgcccccgggccgcacccccgccgctcattgagaaatcgcagtggtccccgcagagacgcgctttgtgccctgggtcgagacctgcgcgcaaccctgcccctggaggacagtgtggagggggtgacagtcgcgtgctcgtcccccttcatcccctgcgcgggacagcagggtg

SEQ ID NO: 84794 - DNA, 30 bp, Homo sapiens
  chr2:101436712-101436742
  hyper
cggcggcggcggcggcggcagcagctagag

SEQ ID NO: 84795 - DNA, 120 bp, Homo sapiens
  chr2:10151722-10151842
  hypo
tacgggcgggtcagatggacaggatcgcgtacgggcgggtcaggtggacagtattggcgtgcatacgggcaggtcagatggacaggatcgcgtacaggcgggtcaggtggacaggcatgc

SEQ ID NO: 84796 - DNA, 120 bp, Homo sapiens
  chr2:10151902-10152022
  hypo
acaggcgggtcaggtgggcaggcatgtgtgtgggagagtcaggtggacaggattgagtacgggccggtcaggtggacaggattgcgtacgggcgggtcaggtgagcaggcgtgcgtactg

SEQ ID NO: 84797 - DNA, 183 bp, Homo sapiens
  chr2:101520526-101520709
  hypo
ctaagggaggaactgcggattacactcctttggggctgattcttccaggccacttgtcagaggagcttgtgtggtttgaatggacagataaacactctcctttaggatgtcataggccactggggtcctgcaagcaggagtgaacaaggcccgctgtggtgtcgctaacggatcccaggcagg

SEQ ID NO: 84798 - DNA, 120 bp, Homo sapiens
  chr2:10153048-10153168
  hypo
gcttatgggcaggtcaggtgggcaggtgtgcatgtgggagagtcaggtggacaggattgaatatgggcgggtcaggtgcgcagacatgcgtatggccgggtcacgtgggcaggcgtgcgt

SEQ ID NO: 84799 - DNA, 240 bp, Homo sapiens
  chr2:10153228-10153468
  hypo
gggtgagtaagatggacaggcatgtgtgtgggagagtcaggtgaacaggattgcttatgggctagtcaggtggacaggtgtgcgtatgggtgtgcctatgggagagtcaggtggacaggattgcgtatagccggatcaggtgggcaggcatgcgtatgagcgagtcaggtgggcagacatgcgtatgggcgggtcaggtggacaggcgtgtgtataggcaggtcaggtggacaggcgtgc

SEQ ID NO: 84800 - DNA, 300 bp, Homo sapiens
  chr2:10153888-10154188
  hypo
gagtcaggtggacacgcgtgcgtatgggcaagtcaggtgggcaggcatgcgtatgggagagtcaggtggacagccctgcgtatgagcgagtcaggtggacaggattgcgtatgggcaagtcaggtggacaggcgtgcgtatgagtgagtcaggtggacaggattgcgtatgggagagtcaggtggacagccctgcgtatgagcgagtcaggtggacaggattgcttatgggcaagtcaggtggacaggcgtgcgtatgagcgagtcaggtggacaggattgcgtatgggagagtcaggtg

SEQ ID NO: 84801 - DNA, 120 bp, Homo sapiens
  chr2:10154908-10155028
  hypo
catacgggcaggtcaggtgtgcaggtgtttgtatgggcgggtcaggtgggcaggcgttcgtatggtcaggtcaggtgggcaggtgttcctatggtcaggtcaggtggacaggcgtgcgta

SEQ ID NO: 84802 - DNA, 120 bp, Homo sapiens
  chr2:10155268-10155388
  hypo
aggattgcgtatgatcgggtcaggtgggcaggcatgtgtatgggcaggtcaggtggacaggattgaatatgggggggtcaggtgggcaggcgtgcgtatggtcgggtcatgtgggcaggc

SEQ ID NO: 84803 - DNA, 316 bp, Homo sapiens
  chr2:10156333-10156649
  hypo
caggtggaccactgtgtgtacgggcgagtcaggtggaccggcgtgcatatgggcaggtcaggtgggtaggcgtgtgtatggatgtgcatatgggcgggtcaggtggacaggtgtgtatatgggtgtacatgtgtgcacaggtgctactttactctgtgttcaacacgtgttcgtggacgtgctccaggcccaaggcgaaggaataggatgtagcaggggcagggtctccgccccatactcagagtccttgggctccgggaagacacaaccgataagtggttacggggatgcctgggagctacgggcacacacagac

SEQ ID NO: 84804 - DNA, 344 bp, Homo sapiens
  chr2:10182780-10183124
  hyper
aaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaagga

SEQ ID NO: 84805 - DNA, 89 bp, Homo sapiens
  chr2:10183213-10183302
  hyper
cgatggattcagccggtggggctgcaggaggttcctataagcgtggtcccctctccccgcaccgagtccggccccggccctgggatttc

SEQ ID NO: 84806 - DNA, 41 bp, Homo sapiens; identical to SEQ ID NO: 39616
  chr2:101835056-101835097
  hypo

SEQ ID NO: 84807 - DNA, 30 bp, Homo sapiens; identical to SEQ ID NO: 39617
  chr2:101893777-101893807
  hypo

SEQ ID NO: 84808 - DNA, 184 bp, Homo sapiens
  chr2:1019337-1019521
  hypo
ccttgcaaggacactcgcgttgcccagccctggctccgtcactgtgccactgtcagcacatctgcaccccgcgtagtctggggacatttagacagccttaggctcaatgtcaagtggatccagaacctcggcagtctgcaaggagagttgtgtgtgtgccatcgatgtccgcttacaccaggtc

SEQ ID NO: 84809 - DNA, 35 bp, Homo sapiens
  chr2:101959293-101959328
  hypo
ttatcccattttacacgggacgaaactgagattcg

SEQ ID NO: 84810 - DNA, 48 bp, Homo sapiens
  chr2:101997524-101997572
  hypo
atcgtaagacatgggcgctttcttgaatctccccgctcctgtgggaga

SEQ ID NO: 84811 - DNA, 108 bp, Homo sapiens
  chr2:102003501-102003609
  hyper
ccaggcagccccagacgctggcatgggccagggagcgggcggtggcggcgcgcagtctagggcccgggggcgcactggccgtctggccgccctcgcgccggtaggaga

SEQ ID NO: 84812 - DNA, 320 bp, Homo sapiens
  chr2:102003834-102004154
  hyper
ccggggacagcagggcgctgcagcacagcagccaggagaggcgggtccccggccgcgccggccgccggccgcggcgcacggacatcttgcaggcagcacgcccggccgccggggccgccagcagcgctagtgccggggagcccggcagcgccccactgcggcggaagcaaggagcccgagcccccttcccgcccctgcaggatccccgggcgcggtcccccgcgcgagtcccggcgaatccctgcagccgcgcgcgaagctcagaagtccaggctcgcagaagaccaggttccacgcacacgccgcgcatcctgcggagt

SEQ ID NO: 84813 - DNA, 879 bp, Homo sapiens
  chr2:102090355-102091234
  hyper
gcagggtccaaccaacgggtccccgcggggcagaccggatggctttccgcgggaagggtgacaacggggaagtcacagatgggaagcccggccccatcgccgattcgggcccggggcttttacgcgtgtgcgtgcatggcaggtccctccgcgctgcggcgggcgagcatcagaaagcgctgggcctggggccgctcctcacacccggctttgacccggcgtcccgagggcagccgtagcgggaaccacgcttcccctccccggccccacctcctccatcccagcgtcccaggcgcctggcggctcaccactggatgacgccgctgtgcgggccccggctaccctcgccgctcgacggcgaggccggcaccccctcggccatggctcggccccgggcctgcagcaccgaggcaggcagcgagcggcggccgtgggcggcgctgggttgcaccggtcctgctaccgccgctcctcggtgtttactttagaaaggagcgcgcggggggcgcgcggggcgcggggcgggagcccagtcctccaggcccgagcccgggggcgcggaaggcgcgcggcgagtacgggaggccacagctccccaacccccgcgccccgccgaggatgcgcggaccccgccctgcatcctgcggtgtgggctggagctgcctcccgctctcacccagcgcccttcccaccggcgtagcaaccagtcaaacagggacgcgaacaacaagcaccaacttacaccttttccaatctggtcgcggtgttgagtccgtgggtgtccttgacttgcttgagcgttggagttattcaggcagttttcaaaaatattgataccccggctgccgctccccatcccagccccgccccaccccaccc

SEQ ID NO: 84814 - DNA, 30 bp, Homo sapiens
  chr2:10219664-10219694
  hyper
gcgcttctgagccaccgtctggctgccgtg

SEQ ID NO: 84815 - DNA, 181 bp, Homo sapiens
  chr2:10220760-10220941
  hyper
accctgcggggggcccggctgagtttgttcatttatggaaacgctccccagacgacgctcgccgggcccgtgggaggccgcgggagcttggggggacttcccaaagcctgagccccctagcgatgcgcggggtgggcgggggaaagaccctgagggctgcgcgcgctgcgttcgcgaggtc

SEQ ID NO: 84816 - DNA, 49 bp, Homo sapiens; identical to SEQ ID NO: 27045
  chr2:10220958-10221007
  hyper

SEQ ID NO: 84817 - DNA, 212 bp, Homo sapiens
  chr2:102246999-102247211
  hypo
accgtcttgtgtttgcgccacactgcctgtgaggttggaacaggggacaatggctcacaggggtctttccaccctgccagccaatgcctccttctctgcctagcttgtcctcaccccgaaagtgcctgcttctgacctcttcttggtccacccgggctggcccgtgattggcattctagaaatgctgctcgagggaccgggcctccatgctc

SEQ ID NO: 84818 - DNA, 30 bp, Homo sapiens; identical to SEQ ID NO: 39451
  chr2:10238076-10238106
  hypo

SEQ ID NO: 84819 - DNA, 29 bp, Homo sapiens
  chr2:10257577-10257606
  hypo
gctgggattacaggcgtgagccactgcgc

SEQ ID NO: 84820 - DNA, 30 bp, Homo sapiens; identical to SEQ ID NO: 39452
  chr2:10278078-10278108
  hypo

SEQ ID NO: 84821 - DNA, 68 bp, Homo sapiens
  chr2:10281126-10281194
  hypo
gctcctgtgaactggcggctggggctgcatctcgcccacgtcgctgtcatgtgcggggcccacgttgt

SEQ ID NO: 84822 - DNA, 30 bp, Homo sapiens
  chr2:10303018-10303048
  hypo
cccccggggcatggccgtccactgcaggtc

SEQ ID NO: 84823 - DNA, 70 bp, Homo sapiens
  chr2:10306845-10306915
  hypo
gcttggatgctcccacgcagcagtgccttgtcatcacattctatttgctgagcggcgatggaacaggccc

SEQ ID NO: 84824 - DNA, 262 bp, Homo sapiens
  chr2:103235936-103236198
  hyper
gccctgcggcttgggcgccgcgcccgccccgcccccgcccgcgggccgccctgggcagggcctgccgctgcggctggagagcagcgcaccggcatgggcaggcggccggcggcggagggcggctgagggctgctgagggtacgcgcagcggcctctcgtcgccctgcacgtgcctcgccaggcagtgcgcctgctcgcagcgaggacctagccctctggttgcagagacccggtgccgcagcagcggcgggtggctgtcgct

SEQ ID NO: 84825 - DNA, 49 bp, Homo sapiens
  chr2:10337316-10337365
  hypo
caacatccctgcctccgagggctggtgtgcggatcgagggaagtcacag

SEQ ID NO: 84826 - DNA, 217 bp, Homo sapiens
  chr2:10344641-10344858
  hypo
cactggctgtgaccccgccagccctgctcagcgctgtgcccagccctgggtgcagggaggtgcggtttgctctcagaggagcagctagctgggagcatccgaggccattagggacaggacgctaatgcatcggcgccccattgattctgcctggcttttgtgaacacgtctgcgctgactaatttgtttaattactcattgccgcatctgttctcaa

SEQ ID NO: 84827 - DNA, 30 bp, Homo sapiens
  chr2:103510419-103510449
  hypo
ccaatgccaatcgaacgctccagagcaggg

SEQ ID NO: 84828 - DNA, 22 bp, Homo sapiens
  chr2:10368174-10368196
  hypo
ccgtgcccggccagagctgcct

SEQ ID NO: 84829 - DNA, 91 bp, Homo sapiens; identical to SEQ ID NO: 39619
  chr2:104014594-104014685
  hypo

SEQ ID NO: 84830 - DNA, 30 bp, Homo sapiens; identical to SEQ ID NO: 39455
  chr2:10408242-10408272
  hypo

SEQ ID NO: 84831 - DNA, 40 bp, Homo sapiens
  chr2:104275911-104275951
  hypo
aaagaatattagggccgggcgcagtggctcacgcctgtaa

SEQ ID NO: 84832 - DNA, 316 bp, Homo sapiens
  chr2:10444358-10444674
  hyper
gggaggcagcgactgcggagttgagaaccctttggttcaacaagttcctagtccgggaggatgcagctcagctcgtggagtccgagagtcacggcgtaaaattggcgcttcccgcacatgcagatctcgggctcccggggtgtcccggccgccaaaggccacccctttcctcctggctgaccccaattccaccagaggaggatgtttgccagggacgccgagtccagctgctggcctcggcattagacaacccccagccccagcccctgccatccctgctcccttgcagccagcctcatgccgggggtgccacatg

SEQ ID NO: 84833 - DNA, 225 bp, Homo sapiens
  chr2:104726683-104726908
  hypo
agagagagatttcaacgcaattttaaattactttttaaaccatttctaaaatgtattttcttagtcatatgtgggtacagttggtggctccccaaaacaactacagacataccttgtttgatcatgtctggctttattgcaactcacggatattacatttcttacataccggagatttgtggcaacccctgcatccagcaagcctatcagcgtcacctgtttcaa

SEQ ID NO: 84834 - DNA, 28 bp, Homo sapiens
  chr2:104963628-104963656
  hypo
cacggtggctcacgccgactgtaatccc

SEQ ID NO: 84835 - DNA, 165 bp, Homo sapiens
  chr2:104984754-104984919
  hypo
gaaaggcgtaggtggcgctgctgttggaaggaggaataggagcccaggagaagtccgagcttatttgaggaacaaaacacaaggagaggctgcagaagtaattcacatactaacgaacaaaaagcaatcagtttgtcatttggctaaatttttgtttgtttgttt

SEQ ID NO: 84836 - DNA, 30 bp, Homo sapiens
  chr2:10505694-10505724
  hypo
ccccttcagccctggcgttatgatgtcccg

SEQ ID NO: 84837 - DNA, 30 bp, Homo sapiens
  chr2:105147581-105147611
  hypo
tgtggaaaagcagcacgtcagccatccatt

SEQ ID NO: 84838 - DNA, 30 bp, Homo sapiens; identical to SEQ ID NO: 39456
  chr2:10526275-10526305
  hypo

SEQ ID NO: 84839 - DNA, 195 bp, Homo sapiens; identical to SEQ ID NO: 27382
  chr2:105458957-105459152
  hyper

SEQ ID NO: 84840 - DNA, 361 bp, Homo sapiens; identical to SEQ ID NO: 193
  chr2:105459902-105460263
  hyper

SEQ ID NO: 84841 - DNA, 247 bp, Homo sapiens; identical to SEQ ID NO: 194
  chr2:105460264-105460511
  hyper

SEQ ID NO: 84842 - DNA, 144 bp, Homo sapiens; identical to SEQ ID NO: 27385
  chr2:105460921-105461065
  hyper

SEQ ID NO: 84843 - DNA, 251 bp, Homo sapiens; identical to SEQ ID NO: 27386
  chr2:105461163-105461414
  hyper

SEQ ID NO: 84844 - DNA, 113 bp, Homo sapiens; identical to SEQ ID NO: 2022
  chr2:105461555-105461668
  hyper

SEQ ID NO: 84845 - DNA, 653 bp, Homo sapiens
  chr2:105461699-105462352
  hyper
cgcgcaccgaatcagtgacaaaggcaagcgggcggcgccgagctccaagccggcgctcctacggcttggcgggaaggaggcccagaagatggggtgcgatttgcacccggattttcctgggctgcagcatctcgctcctgtgtacccaatgacctgttagggtgactcagcgtttatctcttcgcctccctgctgccccatctcctctcttgtcctcttctgtccccagtctccttcaccgctccctgcatgttttaatccacctcactccttgtaccttacccgcttctcactttgccctatttacctctttccctttttctttcccatagaaaagcaatgctaattcgacttctgaaggccgctctagatgttcaaataacagtctgaaagaccttgctgggcagtgctcagagagaaaaggggagtaatgggatccttttaattttattatgcaaactgtgccctaaataaaataaaacgccgttagaatgcgatctaaggaagccgagcttagccctggggcccccaaaatggccggagattcgggagaagtcgcttctcgtgcccacaaatcacaggaatgttgggggtgggggtgagaggaggacctcgccgctgtggaatggggacctcagcgctggagactccaa

SEQ ID NO: 84846 - DNA, 1294 bp, Homo sapiens; identical to SEQ ID NO: 27390
  chr2:105468563-105469857
  hyper

SEQ ID NO: 84847 - DNA, 681 bp, Homo sapiens; identical to SEQ ID NO: 2025
  chr2:105469880-105470561
  hyper

SEQ ID NO: 84848 - DNA, 507 bp, Homo sapiens
  chr2:105470562-105471069
  hyper
gagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaa

SEQ ID NO: 84849 - DNA, 326 bp, Homo sapiens
  chr2:105471422-105471748
  hyper
cacttagcaggtggacggagccccgcgaccgggcagagtccgggctcgcccgaggacaggaggaggagcgggagcccgcgcgtcccgggagagcgccccgagtgcaggtccccgccccgcccggcgagccccgctggagcgagcccagcgcgccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggg

SEQ ID NO: 84850 - DNA, 240 bp, Homo sapiens
  chr2:105471808-105472048
  hyper
gcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggc

SEQ ID NO: 84851 - DNA, 318 bp, Homo sapiens
  chr2:105472108-105472426
  hyper
gggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgc

SEQ ID NO: 84852 - DNA, 1102 bp, Homo sapiens
  chr2:105472712-105473814
  hyper
ggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagg

SEQ ID NO: 84853 - DNA, 311 bp, Homo sapiens
  chr2:105474435-105474746
  hyper
cgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaatt

SEQ ID NO: 84854 - DNA, 30 bp, Homo sapiens
  chr2:105477283-105477313
  hyper
cgttattgatcttagcgattccctttgctg

SEQ ID NO: 84855 - DNA, 428 bp, Homo sapiens
  chr2:105478626-105479054
  hyper
ctatgatgtcactgccggccagaggcggccgcctggccttctggcgggctgtgcgctgcgttcttgatgagtccggtcttcctcaaggaagagttggctctggaagtgacctcagaggggtctgggaagagggcaacagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggc

SEQ ID NO: 84856 - DNA, 256 bp, Homo sapiens
  chr2:105479055-105479311
  hyper
gccgggtccctgctcggcccggcacggccgggcggccagactgtggcagctgctgtgggtcccacaagttgttttcctcgtggcgaccattcagcaaaacgcacgaacctttctcaaagatttaaatttcgcggatgaattaccatacacccgttgcttagcaactaaattcaagcagggctaagaatatgcaagctttttgtattctcattaataaaaatgccactctgacacagcaacccgactttggatcact

SEQ ID NO: 84857 - DNA, 321 bp, Homo sapiens
  chr2:105479678-105479999
  hyper
ggcctgtggagccctagagactaaagggcagtcagcagagtaatgagcaaacctgggggctggagaaagtccaaggaattgaggagcgaaggaaagggaaacttctgaaagtttccctggaaggttgagggagttgctggaggctggagtcggctcaggttccagaggttctggcgataactttctgcagggcttgtggaaggaaaggtagaaatgcctgtgggtctctgcgcgacgtttgcggattttccgttctgggggtgcagcctcctcccaggagaattgagttgccgcccacgctgctgacggtggagttcagag

SEQ ID NO: 84858 - DNA, 8 bp, Homo sapiens
  chr2:105480629-105480637
  hyper
cgggcgcc

SEQ ID NO: 84859 - DNA, 216 bp, Homo sapiens
  chr2:105483624-105483840
  hyper
ccccaatactgcaggcggggcgaaccgtgtttatctgccccaggcacggaggggagattgtaaccaaaggaaaagaatctcgcagaaggggatctggaagagggcagttgatcctgggcagatcccctgcgccgggccctctccgctgggggcgagcccggagggaaccgaggggcccgggagggggagctgctgaaggcgcgcaggctgacaaag

SEQ ID NO: 84860 - DNA, 337 bp, Homo sapiens
  chr2:105484041-105484378
  hyper
gtaggggtaggtgcccgcgcctgggcccgcggggctttggtcatggctgttccccgggaggctcagttaggcagcagccttgctgggcaacaggccccgcccttggttaatccgggaaggtcgcgggctgcaatctggcctgacgaggcaggccctgaagtctccccgctgggcgatcagaagagcgttcgagaagccgggagctggtggggttggcagggcgtctgagtcacccgagctgcagaacggacgcccccacgacgcgctgtgggcactcacagcggctagttgggcatttcccagcagccaaggctgcgcactccgcccccgctgaggt

SEQ ID NO: 84861 - DNA, 997 bp, Homo sapiens
  chr2:105488281-105489278
  hyper
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacctgccagaccttcccacgcgcgggccgcctgggttctggggctttcgtgacgtcttccctcatcgcgctccccacccccgaacacacacacacagacacacacacacacacactcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaagggcgaggagacgcatcccttcttgacagtgcgcctccagactggc

SEQ ID NO: 84862 - DNA, 366 bp, Homo sapiens
  chr2:105489615-105489981
  hyper
ttaaaaacagggcagcggctgtgagcgctgggccggtaagtaagggcagagaaaggggctgtcgtgtgcgtcccagctctccgacccgcacgtccgggacccctttccgcccgcgcaccgcggtcacttgcagccggcgctggctgcttgagcccgcggccgggtcgcccggcttctctccgggagagtggccagggcctaggcgctcgctcaagagggagagcgaagggaaaagaagaaagttctccgccggccgcgcgcagctcctcccgtgagcgcgccccagccctgggccggcccgacccgacccgcgacggggccacgcgtagtgccaggcaactcctgtgccctgtggccagccccgcg

SEQ ID NO: 84863 - DNA, 30 bp, Homo sapiens
  chr2:105515638-105515668
  hypo
ccagcacataagcgacggatcggcagtatg

SEQ ID NO: 84864 - DNA, 35 bp, Homo sapiens
  chr2:105719619-105719654
  hypo
agacaccagaggggtcggctcgggtttcaggtgtt

SEQ ID NO: 84865 - DNA, 441 bp, Homo sapiens
  chr2:105760563-105761004
  hyper
agcagccggcggcgccgcggccgcgcagcctttgtctcgggccgccgggcgcgcggggcccagcgcaggcgtaagtgaccggtggccgggccgcggggggtcggcggggagcgggctgggggtcgcgggcgctccctgcagtggggaggccgggccggccagatcctcccgccacgcgtgtcccgggatgctcgggcggtgccggcgcgcgggggcgcgaggagagccgagcggggccaccgcccgggagggcgcgggacgcagagaggggctcggggcccgccgggccgcggggtcgggggagggggtgcaggctcgcggggcgccgcagcttggcgcccacagacgtgcggcttgggtgcaaatcctgtttctctgggcagaggccacgcggggacggaggaggcagagaggacgggctgtgatggagaaacgggagag

SEQ ID NO: 84866 - DNA, 20 bp, Homo sapiens
  chr2:105761064-105761084
  hyper
actgtcgcccatcccagctc

SEQ ID NO: 84867 - DNA, 30 bp, Homo sapiens; identical to SEQ ID NO: 39457
  chr2:10577316-10577346
  hypo

SEQ ID NO: 84868 - DNA, 30 bp, Homo sapiens
  chr2:105840269-105840299
  hypo
ccacacagggccacacgggagagcaccagg

SEQ ID NO: 84869 - DNA, 30 bp, Homo sapiens
  chr2:105840502-105840532
  hypo
tgcttggagtgtgggcgctggattgtttgg

SEQ ID NO: 84870 - DNA, 84 bp, Homo sapiens
  chr2:105858316-105858400
  hypo
tggcctgcaacagcacgtcccttgaggcttacacatacctgctgctgaacaccagcaacgcctcagactcggggtccacccagt

SEQ ID NO: 84871 - DNA, 126 bp, Homo sapiens
  chr2:10589172-10589298
  hyper
atgggtcctggcctgcggaggtagtttcccctgtgaagccagggactcagccaggagcgtgaggggacccggatcctgagtctccaagccgcccactaccctctgctttaccggatggaactcatc

SEQ ID NO: 84872 - DNA, 162 bp, Homo sapiens
  chr2:105972350-105972512
  hypo
gccagcaaaccaatgcgtaaatgaacatacatggctgtgtttgaataaaacttttttgttaagaaaacagaccaggtgtgatgactcatgctggtaatcccagcgttttggaatgccaagatggggggaatcgcttgagcccaggagtttgagaccagccta

SEQ ID NO: 84873 - DNA, 172 bp, Homo sapiens
  chr2:10600641-10600813
  hypo
gtagataaaaccagacgggtcagattccctcagactggattgtggtctgagggcgccccaggcactggagctaacgtgggaggctggggatggaaaccagtcgttggagtcagccacgatgaacggcgtgcgggctgatgcgggagccacacaagcccgtatgcacagaaaa

SEQ ID NO: 84874 - DNA, 171 bp, Homo sapiens; identical to SEQ ID NO: 27406
  chr2:106014945-106015116
  hyper

SEQ ID NO: 84875 - DNA, 131 bp, Homo sapiens
  chr2:106015416-106015547
  hyper
aggtactcacggcaccgcagcgggccggggactcccggacggggctggagggcgcgggcggctggtggctgcggctccgctgccggccgagtggagcgctgcgcagctcccgccctcgagaaaccccgccg

SEQ ID NO: 84876 - DNA, 279 bp, Homo sapiens
  chr2:106016119-106016398
  hypo
aaagtgagctgggagcgtgcctcccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtggaccacaaaggcgtcctcggcactttgggggcaggtgtattatttttaacattcggggcagctcatag

SEQ ID NO: 84877 - DNA, 177 bp, Homo sapiens; identical to SEQ ID NO: 14440
  chr2:106060615-106060792
  hypo

SEQ ID NO: 84878 - DNA, 156 bp, Homo sapiens
  chr2:106111050-106111206
  hypo
catttttctgccagtcgactgcctgcgggcacgccagtgcctgtcagtgtgctaccaacctcctctcgacagccagccgcttgcgtgttcctccgccagtgtgtttctcttgacatccagctgcttgtgtcttctttccaccgatccgctcctctc

SEQ ID NO: 84879 - DNA, 68 bp, Homo sapiens
  chr2:106143101-106143169
  hypo
ttgccaccctgctcccggcttgcccttgacaagcgtgggatctggatcggtagcgtgagccaatcaca

SEQ ID NO: 84880 - DNA, 41 bp, Homo sapiens
  chr2:106231824-106231865
  hypo
gctgctttctttgcccgaatccaggccggctcagcggctgc

SEQ ID NO: 84881 - DNA, 48 bp, Homo sapiens
  chr2:106305501-106305549
  hypo
ccctgattggctcagcgccagccccagcacccccgctctcccaacctc

SEQ ID NO: 84882 - DNA, 30 bp, Homo sapiens
  chr2:10634441-10634471
  hypo
cagaacccaggtcttcggacctgatgttgg

SEQ ID NO: 84883 - DNA, 147 bp, Homo sapiens
  chr2:106560596-106560743
  hypo
cccctagagaagccacgtgccgctgaggctcagaagcagatggcccagccaaacccagcccagatcagccacgccccagccaacctggaggctcccgggctgaggaaccgctgactgctgcgtgtccaaccccgaggctcctagcta

SEQ ID NO: 84884 - DNA, 30 bp, Homo sapiens
  chr2:106571234-106571264
  hypo
tttgtttctccctgtcgttgagtgtttatt

SEQ ID NO: 84885 - DNA, 30 bp, Homo sapiens
  chr2:106578646-106578676
  hypo
ggattctgtgagatccgcaaaggcaggtac

SEQ ID NO: 84886 - DNA, 30 bp, Homo sapiens; identical to SEQ ID NO: 14441
  chr2:106672847-106672877
  hypo

SEQ ID NO: 84887 - DNA, 261 bp, Homo sapiens
  chr2:106681722-106681983
  hyper
taaggggaacagtggcgcggctggggcgggcggaggaagtgggggagccaaggagacaccccagcgctgggatccggcaagtcctccctctgagtggccagggggcctcgtcccttctcccgatgccttctgcccttccttgggtctccggaacccagcttgtcctaaccgctttcgctgcgggcagcgctggccacgcggcccccgccgccggcggttctccgtggccaagcatccttggccttggagcccaggggctgc

SEQ ID NO: 84888 - DNA, 300 bp, Homo sapiens
  chr2:106681984-106682284
  hyper
ttccccttggggccggggcgggagagaggacctcggtggtactcgcccgtgcgctgggcgcagccgcttggccctcagccctctggcgcggcgcccacccgctgggtcccgccccggcagcgacgcagggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcc

SEQ ID NO: 84889 - DNA, 30 bp, Homo sapiens
  chr2:106730211-106730241
  hypo
ctctgcttctcactgcgcccatgtgtccgc

SEQ ID NO: 84890 - DNA, 30 bp, Homo sapiens
  chr2:106778483-106778513
  hypo
gaaaagtaagctagacggagttccatcaat

SEQ ID NO: 84891 - DNA, 133 bp, Homo sapiens
  chr2:10688798-10688931
  hyper
tttccttgctccaggcgccctcagtgcttgcagcctggccgcgtgtgcgcctctgctgggatgacccggtcctgttgccccggggccccatcggaaggccggctttccccaccttgagcggctcggcatctgc

SEQ ID NO: 84892 - DNA, 45 bp, Homo sapiens
  chr2:10689017-10689062
  hyper
cgggcagcagatgccttaagcagccactgccgggtggatgtccca

SEQ ID NO: 84893 - DNA, 456 bp, Homo sapiens
  chr2:106959159-106959615
  hypo
ctctgctgcgggtggcgaggggcggctggaacagcatacttcagtcgttccgtgtcagcctccacccctggtagcaccagagcctcccaggcgtccccgcagtccgagccagccttagcacccagcgctttcttgctgtcgcctggttgttcccgcggcggccgagctcagcacctctcacactccctgcctctcgaggactctgcttgttcctcatcacagcacggttgctctcgcacccaaggcggtgtccccccagcgcctcaccacgatcgcggcagagatctcctgcagggcgtccgggccttgggaaggcatcgccatctcccgcagcgccctcccggactagcgcagcaggctggcatcgcttcctgaggtttggccccaagttttacggcttaatgaggcacataaatagataaattgtcttcatcacgtcagcgattgctttcactt

SEQ ID NO: 84894 - DNA, 143 bp, Homo sapiens
  chr2:106959900-106960043
  hypo
gcctaggccctgctgcgggctctggatccagcggtcacggtttcactgagagggcgcctcccaggggctgctccggcccagggcagggcattgcaggggtgatgggacagccctgcttttgagaggcgcggcactctgccaag

SEQ ID NO: 84895 - DNA, 324 bp, Homo sapiens
  chr2:107103816-107104140
  hyper
ctcacccaccccagccgcgactgtctccgccgagcccccggggccaggtgtcccgggcgcgccccgatgcggccgcggctgtggctcctcctggccgcgcagctgacaggtaaggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttggcaggcagggtccctaagggtggaaataaaatacccccatatcgcattaccccgggggaccggagagcccctgac

SEQ ID NO: 84896 - DNA, 21 bp, Homo sapiens
  chr2:107278930-107278951
  hypo
ccaccgcgcctggcctatttt

SEQ ID NO: 84897 - DNA, 30 bp, Homo sapiens
  chr2:107459415-107459445
  hypo
gcgctcagaaagaaccggcccccagggaca

SEQ ID NO: 84898 - DNA, 386 bp, Homo sapiens
  chr2:107460030-107460416
  hypo
cagcaaaaaagtagtcgtcatcctccgggtagaaagcactttgagattttctccccacctgggatgaaaaaaactctttatgttcaaacccatcttgggactgggcccatttctgcaggtctccaggccccgcatgaaaggaaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatgaaaatcagcaaaaagaggagcccccaagcgaatattccgaaaagcattcgttgtctccattgc

SEQ ID NO: 84899 - DNA, 59 bp, Homo sapiens
  chr2:107502427-107502486
  hyper
aacattccccacacacgggtctcgctcctaaacacggagtgtaactccgcgcacagcag

SEQ ID NO: 84900 - DNA, 212 bp, Homo sapiens
  chr2:107502518-107502730
  hyper
cgccaacccttacccagtgccctcccttaccagccttcttcccacgccgcgcctcgaagcgcacgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggc

SEQ ID NO: 84901 - DNA, 43 bp, Homo sapiens; identical to SEQ ID NO: 2030
  chr2:107502865-107502908
  hyper

SEQ ID NO: 84902 - DNA, 241 bp, Homo sapiens; identical to SEQ ID NO: 27413
  chr2:107503421-107503662
  hyper

SEQ ID NO: 84903 - DNA, 469 bp, Homo sapiens
  chr2:107503663-107504132
  hyper
caggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaaccccaagagggacggaaagttcttggggtagaagccggcgggacaagtggttgaagcagcctccggagccagtgggcggctgcgagctgggcagctggagcctgcgggcggggccgcggggaggtgcccatcgagtgtcggtctggtcgcgtgcggaatgtccacttgtcaccgcggcccttgcgttttctcgagacggcggcagctggtcctaggaccccaaaccgcgccgccctttgtttgct

SEQ ID NO: 84904 - DNA, 173 bp, Homo sapiens
  chr2:1075449-1075622
  hypo
atggtgagtggtcagcgtgatgaattagttggaagttaatatcctatgtgagtgtggactttacatcaagatataacatcgatcaatatcacatctttttgatgtgaactaaaaactgttcttgtcctgaataacgagagcagagcaagcccttcctccgaaggcggctgcac

SEQ ID NO: 84905 - DNA, 30 bp, Homo sapiens
  chr2:107872048-107872078
  hypo
gaaacctttacctcgcgaatcttggaatcc

SEQ ID NO: 84906 - DNA, 24 bp, Homo sapiens
  chr2:108104796-108104820
  hypo
tttttttttttgagacggagtccc

SEQ ID NO: 84907 - DNA, 47 bp, Homo sapiens; identical to SEQ ID NO: 39632
  chr2:108160878-108160925
  hypo

SEQ ID NO: 84908 - DNA, 39 bp, Homo sapiens
  chr2:108310877-108310916
  hypo
attacaggcatgatccaccacgcccgatggactcccctc

SEQ ID NO: 84909 - DNA, 63 bp, Homo sapiens
  chr2:108602842-108602905
  hyper
cacacccaccctcctcgcgagggcagcgtccctagcacacgccctagcaccactctcctctga

SEQ ID NO: 84910 - DNA, 401 bp, Homo sapiens
  chr2:108603014-108603415
  hyper
cggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccaggtaggagcggagcgggcattcctgcgcctacgggcccgcaccctcggaaacgccttgggcaccgagcccgggcggttttagaggggagggacgcggcgtttttccctctcggtgggatgcgagggcgggtttgctgtctggcaccgttgctgtcagggtgcaagaggctacaaagtctgggcgcaggaaatgggta

SEQ ID NO: 84911 - DNA, 44 bp, Homo sapiens; identical to SEQ ID NO: 27049
  chr2:10861191-10861235
  hyper

SEQ ID NO: 84912 - DNA, 56 bp, Homo sapiens
  chr2:10862045-10862101
  hyper
catgggcagtcaaggcggaaaggagctgcgttgggtctgcgcggggttaggagaga

SEQ ID NO: 84913 - DNA, 30 bp, Homo sapiens; identical to SEQ ID NO: 39459
  chr2:10911393-10911423
  hypo

SEQ ID NO: 84914 - DNA, 30 bp, Homo sapiens
  chr2:10916525-10916555
  hypo
ctgaggacgaggagccgagctggagctggg

SEQ ID NO: 84915 - DNA, 226 bp, Homo sapiens; identical to SEQ ID NO: 39460
  chr2:10924927-10925153
  hypo

SEQ ID NO: 84916 - DNA, 82 bp, Homo sapiens
  chr2:109335084-109335166
  hypo
aaccacagcgcccggcggaatgcgtggattttggcataagacggtggttctggaaccaatcccccgccgagatgactgttta

SEQ ID NO: 84917 - DNA, 30 bp, Homo sapiens
  chr2:109524351-109524381
  hypo
ggccaggtgaaccagcgacagcaggcacag

SEQ ID NO: 84918 - DNA, 425 bp, Homo sapiens
  chr2:109648039-109648464
  hyper
gtgcggcgaggagggcgcagtgaagttctgctgtgtgcaccccctgcagctcggccgggaagcgcccgctggaggaacggagagcgccgcttcagcgtcggccacgtgggccgggctctgccggtggcaacctggacgcgctgcgggcgccggcgagacctgcgccaacgcctacctccgggccacaggcgggataaagctgccccactttgcccccagcgaagagaaccctccttcctctaagtattttcttcagcaactaagcttttctgtttgctcaatttcttgtcccgtgagcgctaccacccaccccccgccaccttcttcccctccccccacatccgttcactctctttgaccttttgccaaaactctgaacgctcgctgccctccctcccatttcctcaccgcgtttcaggagctgt

SEQ ID NO: 84919 - DNA, 1640 bp, Homo sapiens
  chr2:109744748-109746388
  hyper
attcaccctcctctgcgcctccgtaggaaaaaattggagcgggggttcacgagactgcgccgcggcgggcgctagagcccctcgcacagcgtcgccaagggtgcggcgtggagccgggcgcctggcgccagggtgctggtcggcgggcagcggcgccagcctccgacccgcgactccggcgagccaaggctgcgccgggaggagtcggcgcgggccccggggtgcccccttcaactggagcgccttcccctcctgccttgcggcgcatccccacacctacaccggaacgaagctccggggctgtcacttctgcgcgcttctcggaaaggagtctgaactgggagcgctccggggggtcgtcggggaggatgcccgggcgtcggctgtgtccccaagctgctcgccggcgctggcgaggaaggcagtcgggataacgccgcccaaactttccttcgcagcagcgttggcaggaaacgtccctctctgaggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccc

SEQ ID NO: 84920 - DNA, 39 bp, Homo sapiens; identical to SEQ ID NO: 27420
  chr2:109746462-109746501
  hyper

SEQ ID NO: 84921 - DNA, 44 bp, Homo sapiens
  chr2:110015320-110015364
  hypo
gttgatcagctccagcgatccccgagccgcggccaggattggag

SEQ ID NO: 84922 - DNA, 30 bp, Homo sapiens
  chr2:11018229-11018259
  hypo
gagcggcacacccaccgcctctgtcctcaa

SEQ ID NO: 84923 - DNA, 114 bp, Homo sapiens
  chr2:110371704-110371818
  hyper
gggactccaggaagacggcgcgaggaatgcaggcgggaactgcggagcagtgattgcggccctcgcgaggccggaagtgggcgggccttgaggcgaggccgccctaggtaggtg

SEQ ID NO: 84924 - DNA, 30 bp, Homo sapiens
  chr2:110433828-110433858
  hypo
gggagccgggctctccgttagcacctccat

SEQ ID NO: 84925 - DNA, 67 bp, Homo sapiens
  chr2:110518226-110518293
  hyper
agcgcgcgggcggcccgagcttcggcggcggcggcggtagcggcggcggcgacgctgacacctccca

SEQ ID NO: 84926 - DNA, 289 bp, Homo sapiens
  chr2:11051843-11052132
  hyper
agagagaatgcctgccgcttcaagccaggtcgcaacccctcggtgacccgctgcgcccgaggaggggccggcggtgcgcggtggtggcggcgggcgcggcagctgtgcccgtctgcccaagggttaatccgtcccctgcagctgccgcgcgtgccttgcagaatttcaccagaagagggtacagtttgaaaagctcctgacgtcaggctggaattcctattgtgtttagaaaaggctcgggcaaagccagcccaagttcgctctctgcacacctcgagcacctcgcgga

SEQ ID NO: 84927 - DNA, 332 bp, Homo sapiens; identical to SEQ ID NO: 27051
  chr2:11052361-11052693
  hyper

SEQ ID NO: 84928 - DNA, 54 bp, Homo sapiens
  chr2:111438469-111438523
  hypo
tcaagagccacttgacgatacagaataaagagctgttcacgctagaaggaggtt

SEQ ID NO: 84929 - DNA, 193 bp, Homo sapiens
  chr2:111462929-111463122
  hypo
tgaggctgtcagtgacgggctaattttcaagtctgggggatttagcattggccgactatcagatacttcagctgtccttgatttgccaatgttcacgagcttggctactggagggaggctgtcactgattggctaattttcagagcacctgtactaattttaagttaccactaatcagcggtgatttcttatt

SEQ ID NO: 84930 - DNA, 30 bp, Homo sapiens
  chr2:111483271-111483301
  hypo
gtgtgactgaagagtcgtgtgagcctgggt

SEQ ID NO: 84931 - DNA, 373 bp, Homo sapiens
  chr2:111490316-111490689
  hyper
cggactcctcggcggcgcccgctcttccggcaaaggtaccgcgctgcggccgtcgcccctgcccgcgcccccgaagccgccgagcgtgtcccctcggtccccggagcgtcgctgcggacaacgccctggcgagggcgaggtggggtgtgcgccgcgcctgagaggcgggtccctgcctcgccgcaggtgacgggctcccctccccaggtgtgtgggcgcagccggccgccgccgacctcttcggccccctgagaggtgccctctcctcccgagctccctcccccacgaagagtcgggtgcagggctgggccccgcggtgacaggcgcggtgtctacgaagaccgtgtggctggaagatcggccttgctggttt

SEQ ID NO: 84932 - DNA, 101 bp, Homo sapiens
  chr2:111874886-111874987
  hyper
ctcagaccttggtctcgagttcccggctaatttgggggcaaagccgaccgaccccacgtccacgcccacccccttacgggaaaagccggggtttccactgg

SEQ ID NO: 84933 - DNA, 39 bp, Homo sapiens
  chr2:111875378-111875417
  hyper
ggagccaagctctaacgggtgtggcgggaagtgtggtgg

SEQ ID NO: 84934 - DNA, 66 bp, Homo sapiens
  chr2:111898079-111898145
  hypo
attttctcttaggcacgtgcatctgcgaaggtgtctgaggtgagccaagctcgataacctgatttg

SEQ ID NO: 84935 - DNA, 75 bp, Homo sapiens
  chr2:111912943-111913018
  hypo
ggttcatctgctggacgcagtgccagcaagtgtagattgcgaccctctgtagatgtgggccggaggtactggaag

SEQ ID NO: 84936 - DNA, 18 bp, Homo sapiens
  chr2:111928152-111928170
  hypo
atagtcccagctactcgg

SEQ ID NO: 84937 - DNA, 515 bp, Homo sapiens
  chr2:112656577-112657092
  hyper
acccagcctggcttgcgggtgcgcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaacagaacttacagtgctcggcagcgtttacgtttatctggattcagcgaagtgttgttaca

SEQ ID NO: 84938 - DNA, 315 bp, Homo sapiens
  chr2:11269903-11270218
  hyper
gggtggtaaagccaacgttttcatccaaaaagcagaggcttacgggacaaaggggacggaaaatatcccctgcaaattaaaaaatgcagacacacatttcccctgccttcgcctcccacggacccgccccttcagctccttccctcgcgctcccaagctccggggcccctgagccctgcgccggcggaacggggcggagctcgcgaccctccctcgtccgccgacccgggaaggggcgggggcctacaggaagtgggcggggctggctcgcagggcggagcctcgcctcgctctgtgcatcgcaggtgtgcttgc

SEQ ID NO: 84939 - DNA, 49 bp, Homo sapiens
  chr2:112779046-112779095
  hypo
gaagatttacagtggcgattattaccgccaaggccgcattgctaagatg

SEQ ID NO: 84940 - DNA, 98 bp, Homo sapiens
  chr2:112896008-112896106
  hyper
gcgggcagctgcgggcgcacctggaccctcgcaaggcccgggcggcgccgatccccgcgggacgcgctgcgctcggggcctcccgcctccccccctgc

SEQ ID NO: 84941 - DNA, 158 bp, Homo sapiens
  chr2:113013159-113013317
  hypo
cagcccagaatttttaaaattagttgttaggattctgctttcaccttggtgaaaactcttccatcaaaatcacagtatttctaagggatggtagtaacagctaacatttatctgagcactccactactattccttagaaatagcgtttcacatgttag

SEQ ID NO: 84942 - DNA, 185 bp, Homo sapiens
  chr2:113103246-113103431
  hypo
gctggaggaaataaacgacgttactgttaggcattggataataggccatgaaagatacggatctattaaaaaaagaaaactaatcaggtaagctctgcaatcgccccagctttttccctgtagttccattcttgaccacagagcagggcatcccgggcagagcgcagctgcgcagcaatcttgct

SEQ ID NO: 84943 - DNA, 32 bp, Homo sapiens
  chr2:11312055-11312087
  hypo
atgtactttcatcagcgcggccagtaagtttg

SEQ ID NO: 84944 - DNA, 126 bp, Homo sapiens
  chr2:113190911-113191037
  hyper
gccgcccggccgggtcgaggccgccgctctcttccagacccactcacctgtcgaggcgacggggtgagacccagcaccgaggcgacgtaccgctccacatcggccttgctgcgcctcatcgcgccg

SEQ ID NO: 84945 - DNA, 61 bp, Homo sapiens
  chr2:113195104-113195165
  hypo
cccaggctcctcccccgcccacggggggcgaggtgcacagcactgacgggcccctgggcca

SEQ ID NO: 84946 - DNA, 42 bp, Homo sapiens
  chr2:113341856-113341898
  hyper
tctgaggctcaatcccgtcaggtgccgcgcaactcagcggcg

SEQ ID NO: 84947 - DNA, 36 bp, Homo sapiens
  chr2:113494765-113494801
  hypo
gattacaggtgtgagtcactgcgcccagctggtgat

SEQ ID NO: 84948 - DNA, 30 bp, Homo sapiens
  chr2:113555815-113555845
  hypo
ggcagatgagggccccgggaagcagaagcc

SEQ ID NO: 84949 - DNA, 15 bp, Homo sapiens
  chr2:114034462-114034477
  hyper
gcttggcatgggcac

SEQ ID NO: 84950 - DNA, 260 bp, Homo sapiens
  chr2:114256928-114257188
  hyper
ggaggaagatgaagacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatgg

SEQ ID NO: 84951 - DNA, 36 bp, Homo sapiens
  chr2:114260005-114260041
  hyper
ggtcaggccccttcccggaaccgcctccaagctcct

SEQ ID NO: 84952 - DNA, 745 bp, Homo sapiens
  chr2:114260750-114261495
  hyper
tcccctgctccgggtcggccaggcaccgggtcctccttcagcactcgcagcacgcactgaagaagacgctacggaactctccgttttccagactcgggggaattaggaaactcgcccggcgaccctcgcgcagtagcaccgggccaggtttgctttcggaaccgctgactgcactcgccgcctttcccgcctgggcctctcgcgggtcgcaggggtggaagcccgacctgggccagggcccggatttcttcctcccggcctctgcgccaccgcccccggtgcaggacgcgctttgctctcgccgagacccagacgcgctgaaagcctcgcgcgggcagttccccgccccacgccccgggctgcgcgttctcccgcaaagcctctgccgagtgcgcgcaacggcgccgccggactccccgggaccgcgctcccgcgcacgcctgaccggagcaccccgcttcacgggggcgttctgcgcgtccttcctccccggtgcgatttccattctttttcctctcgcggtccccaggagcccaggcacccctcgactccccgggactccctgcgggcccgaagccgccttcccgaggcggcggagttgggcagctccgggccccgcgccgccccgcagagccggagtttctctccggagtctggatacagctctccgcttcgtcgccgcgcactggaccccggtagcgtggagcctgcccgggaagctgggctgcgccggcctggggcgaag

SEQ ID NO: 84953 - DNA, 81 bp, Homo sapiens
  chr2:114394608-114394689
  hypo
ccatagcatttagacacccacctttctagccctacctcccacttagtgattgtctgtaaatacgcacggccttaccttggc

SEQ ID NO: 84954 - DNA, 17 bp, Homo sapiens
  chr2:114469902-114469919
  hypo
tttttttttttgagacg

SEQ ID NO: 84955 - DNA, 265 bp, Homo sapiens; identical to SEQ ID NO: 39640
  chr2:114515303-114515568
  hypo

SEQ ID NO: 84956 - DNA, 24 bp, Homo sapiens
  chr2:114515808-114515832
  hypo
gcgagactccgtctcaaaataaat

SEQ ID NO: 84957 - DNA, 26 bp, Homo sapiens
  chr2:114634729-114634755
  hypo
tttttttttttgagacggagtctcgc

SEQ ID NO: 84958 - DNA, 85 bp, Homo sapiens
  chr2:114634995-114635080
  hypo
ttcaggtgtgaggcatcgtgcccggcctctctttccaaagtatgttattatttttcccaagaccctttgacggatcctcatttcc

SEQ ID NO: 84959 - DNA, 30 bp, Homo sapiens
  chr2:114737714-114737744
  hypo
gtgcctgggtttttgcgttgaaatatcttt

SEQ ID NO: 84960 - DNA, 62 bp, Homo sapiens
  chr2:11485462-11485524
  hyper
tctccttttggggggcggaagaggggtggttatcgggaccgttccgccgcattcctgccctc

SEQ ID NO: 84961 - DNA, 176 bp, Homo sapiens
  chr2:114869802-114869978
  hypo
ggctttcagagacttcgggcattccttggctcatgactgttttcttccatcttcaagtccagcagcagtggtttgagtgcttctcatgcggccgtctgtctggatctctctcttctgccttcctcttctatttataaggacccttgtgattacatcgggcccgctgattaatgccg

SEQ ID NO: 84962 - DNA, 30 bp, Homo sapiens
  chr2:11487939-11487969
  hypo
cgtttacattctcagcgtgagtagaagaaa

SEQ ID NO: 84963 - DNA, 30 bp, Homo sapiens
  chr2:115099730-115099760
  hypo
atttatttactcattcggtcattcacttcc

SEQ ID NO: 84964 - DNA, 150 bp, Homo sapiens
  chr2:115141250-115141400
  hypo
accctactagcaccccgccctgaatcctctcactctcgggggtactgtctattctgcacctaactttcaaaatattgtttctcctttgcaatatgtagtgacatatttttatttagcagttttgaaacactctttttgtagaatccgcat

SEQ ID NO: 84965 - DNA, 30 bp, Homo sapiens
  chr2:115159137-115159167
  hypo
tcagtgagtgtacttcgcagcgtggttcac

SEQ ID NO: 84966 - DNA, 67 bp, Homo sapiens
  chr2:11537219-11537286
  hypo
ggcatggccttgctccgggcccccaggagcctgtgttgtgatgctcccatggcggcttgtcattagc

SEQ ID NO: 84967 - DNA, 93 bp, Homo sapiens
  chr2:11538637-11538730
  hypo
cagtcaatagttctccgttctggaaaccgactccagtcaggggctgtgtctcatgcctgtaatcccagctactcggcaggctgagttgggaga

SEQ ID NO: 84968 - DNA, 32 bp, Homo sapiens
  chr2:11538910-11538942
  hypo
gcagtccacgtatgggccgcccctcactagca

SEQ ID NO: 84969 - DNA, 232 bp, Homo sapiens
  chr2:115918661-115918893
  hyper
cttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctgggg

SEQ ID NO: 84970 - DNA, 88 bp, Homo sapiens; identical to SEQ ID NO: 6332
  chr2:115919337-115919425
  hyper

SEQ ID NO: 84971 - DNA, 782 bp, Homo sapiens
  chr2:115919830-115920612
  hyper
cggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggaccc

SEQ ID NO: 84972 - DNA, 85 bp, Homo sapiens
  chr2:115920613-115920698
  hyper
cgggacccaagcgctggggtaggaggactggggatctttgttcggagtgcgctgcgaaggctgctggaggcggacaccctcccag

SEQ ID NO: 84973 - DNA, 690 bp, Homo sapiens
  chr2:11622659-11623349
  hyper
ctggggttccaggcccggggcgcgaacccgggtgggagggcgcagggggctcccctctgtccctgtcacctccacccatcgccggccgccgctaggggttccggccccgcgccctcccccgacccttccccggcggaggtcctggggcagccaagcccaccgcccggccctcctccgcggccgtcccgaagacccggagaagtggaccacagggggcggccagtgtcaggggtcgagtcctccgcgctggccgcggttccggagatccgggctttgccgagcgccccgcgccgtggccggggccggggccaggtccgggtgcggggcctggcgctgcggccgcgagctcagcctgtaggctgggctagcctccgtcggcggcgggcgctcaggagcggggccgcggcggccggaggacaaagggcccgaggtaggagcggtccctccgggcggcagcgggcggagcgggggcgcggggctgtgcggggctgctcggggcgggcactcggcgcccggcggggaaggtgcgccccgccggacgcgggcacttcctggccctggtcccgggaaggaggtggaaggtgtccgggatcggccctggcagcgtgtagggacctgggtgctgccgctgccgtgcgcttgtgcgtgcgtgtgcgcgcgggtataggtgtgggcgcgcgtgtgtgtggg

SEQ ID NO: 84974 - DNA, 90 bp, Homo sapiens
  chr2:11623469-11623559
  hyper
gagagagagagcacccgaggctcctggcgcttggcacatggtgagccctcggtaggtgggagccgtgaacagtgacggtgataatcgtat

SEQ ID NO: 84975 - DNA, 36 bp, Homo sapiens
  chr2:116723692-116723728
  hypo
cagaccggagctgttcctattcgaccatcttggaac

SEQ ID NO: 84976 - DNA, 171 bp, Homo sapiens
  chr2:11678128-11678299
  hypo
tttccagtttcccaccgtcacacacggtgccctgagtggcagaaggcacggggcactccacgtacagaccgcgtacagtgtgcctccccaacgagtaaagccctggcactagggatgcttcagagctgcagatgctcgctcgggcagaacctccagcgggtgccacccctg

SEQ ID NO: 84977 - DNA, 17 bp, Homo sapiens
  chr2:117052188-117052205
  hypo
aacgcactgccatttct

SEQ ID NO: 84978 - DNA, 181 bp, Homo sapiens
  chr2:11722451-11722632
  hypo
taggggaacacgagccgttccagaatctggctccagcccacctgccgaacctcattccctgctattttggctaccctgggcagttgagctcccccacccccatggccccatcctcctgtctccatgctctgtgcctgcgtcccggctctgggctgctctctccacccgcctattaaatcgc

SEQ ID NO: 84979 - DNA, 204 bp, Homo sapiens
  chr2:11809912-11810116
  hyper
gcacgaagtagtagccgcggcagcccaggtcgccgaagacccaggggtagtggaaccacacgaagctgtagagctccaccggcacgccgaccagcagcagcagcaggcccgcgagcgccaggctgagcacgtggtggcgcaggcgccccgcgcgcccggcccgcgccttcagcaccacgtgcgcggacagcgcattgcccgccg

SEQ ID NO: 84980 - DNA, 141 bp, Homo sapiens
  chr2:11810146-11810287
  hyper
cggtgaacagcaccttggcccagaggcgagtgtccacgcccagccgggcgtccaggctcagccccgggttggagctgggccgcgggggccgcgggctgctggtttccatcccgctcccgcggccggcgctccctccctctc

SEQ ID NO: 84981 - DNA, 37 bp, Homo sapiens; identical to SEQ ID NO: 39642
  chr2:118628528-118628565
  hypo

SEQ ID NO: 84982 - DNA, 147 bp, Homo sapiens
  chr2:11886072-11886219
  hypo
catttcaccaccagacgttatgtggctcattgtttatccgctgcctgcctcccggctggagaggcgcagggagctgcctgtccctcctgttcagagccaccgttccgcacctggaccaccgcttggcagaggcgggagtggaggctg

SEQ ID NO: 84983 - DNA, 765 bp, Homo sapiens
  chr2:118981092-118981857
  hyper
aacccagggcagcagcgaatcccacgccccacgctccctcttcccaaacctcaatatcgttgcttaaaatcttccgggcttattgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccgggg

SEQ ID NO: 84984 - DNA, 203 bp, Homo sapiens; identical to SEQ ID NO: 196
  chr2:118981945-118982148
  hyper

SEQ ID NO: 84985 - DNA, 269 bp, Homo sapiens; identical to SEQ ID NO: 27435
  chr2:118982253-118982522
  hyper

SEQ ID NO: 84986 - DNA, 505 bp, Homo sapiens
  chr2:119067621-119068126
  hyper
taatccggcttagcccgcttaatgatgccacttgtggcactccgaaggcagcggagaagtctataaactacttccattaaaatgcaaatcgggcccgctgagaaaacaagtgacacaaaaagtgggcgccgcgcggccgccgcccgcgatggcgccgatggctgatgccgcgattacgccggcgggggcggcccgcgcgccacgaacgtgcccgacaagccgcgccgcttaatttctgaagagatttatattttttttgttgtcaggaaatgaacaaatacttatcaatgtaaaaactgctatctccgatctccccgccgggtttttcatactgatattctttgcaccccgtaacacaggaaatgaaaatcttctccgcctctcacgtcgccgctgcgccttcaaatcctctgcgagcagactggcctccccccaccggccccctcccgggctcccctccccggtaaacagaaaagaaaacttctgtgggcgaaggagggagaaa

SEQ ID NO: 84987 - DNA, 331 bp, Homo sapiens
  chr2:119531997-119532328
  hyper
gaattttttttattacgttttcattgttctggtgcaaagtacacgtgaactcacagctcccagccactcgactttgcggagggggctgaaagcctcagtagcggacccggccgggaaaggcggagccgacagctgtcgcggggcggggcttccagggccgggaggtggaaggcggagagcggcgagggctccggctccggacccagccgagcgcgcagcgtgaagcggagaacgccgggttagcgccaggctgaatcctcgctctgactcctattgcggtgggatgtggtctctgagtctccgtttaccgattttacggaatggaacttat

SEQ ID NO: 84988 - DNA, 242 bp, Homo sapiens
  chr2:119566157-119566399
  hyper
tgagggttctccaatcgcagcaaagggcccgggctgggtgttgccgagcggtcctcggctccccggtggaccatgcccctccagaggtctggcccagcgtcgctctgctctgcaaaaaagtggctctccgctgatctcgaatgcaccagcgagcctccagattctgggtgaagccgattttggaaatccatatgccgccctagcaaacacatcaggattgaggttaccgcataagagcagcc

SEQ ID NO: 84989 - DNA, 795 bp, Homo sapiens
  chr2:119590773-119591568
  hyper
gatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaagggggtccctaccccacccggggtagcgggagggaggccgcctctctgcgcctagccgggcgggccttgacttgctaggattggtgggccaaatcccatctccggggagccttcaaataactctcccatggggaactgaggaggcgcgggagcctagggcggaaaaagctgaagagccgtggtcccggagaaaaggaagtgagcagtctcaatggaggcc

SEQ ID NO: 84990 - DNA, 22 bp, Homo sapiens
  chr2:119591658-119591680
  hyper
cgccgcccgggaccccagagca

SEQ ID NO: 84991 - DNA, 717 bp, Homo sapiens
  chr2:119592747-119593464
  hyper
caagagcgcgcgcctcgtgtaaccattcaggaccagttgaagcaacacaaataaagtcaggtctcttcagccttgctgtccacccctccccctcttcctggtttgaccctggcctggccgctctgaggcccagtttgcgcagccgacattgcgtggctactctcattaccaggggaagggcgctccccttttccctggtaatactccgggagcccctactcggaagcccaagagtcaaagggatacaggggtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagcagaggatgaggaggaatacggaggcggggagcccacagaaaaagatgttgaggaaagaagaggagaccccggcctaaacaaatcgaaactgtgcaatgaacgtggcccgggagaaccgggggtgaggggcgatggctggagctgcggcccaagcacagctttcagac

SEQ ID NO: 84992 - DNA, 498 bp, Homo sapiens
  chr2:119593465-119593963
  hyper
cttgcccggaccctggcgcggggaggcggccgggactgcctttctgcgcgcgtccctggagagcgggtgggcaggacctgcgccccgcggtgggcaagaagatttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 84993 - DNA, 30 bp, Homo sapiens; identical to SEQ ID NO: 27443
  chr2:119594194-119594224
  hyper

SEQ ID NO: 84994 - DNA, 30 bp, Homo sapiens; identical to SEQ ID NO: 27444
  chr2:119594750-119594780
  hyper

SEQ ID NO: 84995 - DNA, 1015 bp, Homo sapiens
  chr2:119599849-119600864
  hyper
ttctcaacaagtctccggaaaacgaaaggggggcagaacagacagaccgacagaagggacccgggaggtgggggagaagaggtgggcagacacgaaaggaaacacactctcgcacacaaagaaaagtcccagagaaaccagggccggcgatgcgggtcgggaggcaccggagaagcaatgacattcaaatgaaaaaggcaacgaaaacgaaactgggcgggggcagcgaggcggtgggggaggggataaaataattataataattataataattataacaataataataaaggagattaataaaaatgtccagcaaatagagatcgctacacgtatgtgttttccttacctgaaattaaatatatacaaggtcgtaagcggtttggctagatagagctttaaggagttcgcagtttcgtcccttatactgggaatagagaatggatcttatttttcgatagcacctgtccgagtctttctcccttttcaaaaatgctgcgtttcaacgtcattgtccattctgaggctctctttctgtctctctcgctcttttccctgcgctccctccctccttggagcagatgctttctcccccagcgaggggccgggagacgacggcggcggtgccgggagggggcgcgggcgcggccccggcctgtggcggctactcgctctcgtctttgtcctggaccgtggtggtggagtggttgtacagtccctgggccatgaggtgcagcgccaggccgttcttgatgcctgtggctttcttgatcttggcgcgcttgttctggaaccagatcttgatctgggactcgttgaggctgagttcctgggccagggtctgccgccgctgctccgtgatgtagcggtttgcctggaactccgccttgagtctctgcagctgctcggccgtgaacgcggtccgcggccgcttgtcctccttctcgttcttcttcttcttcagcttcctggtgcgcggacctgcagcggcggagagggccggggtggggtgggg

SEQ ID NO: 84996 - DNA, 166 bp, Homo sapiens
  chr2:119602464-119602630
  hyper
actggggttttgattcgtaattagctgagcggggagaaatagcccaagaaatgcacacagccccaaaaaggccccactgcccgttctgcatccgggacatgttgaagtgttgttgtatgtgtgtgcagaggcacggactcttgtaataaaatcgttcctagtctcc

SEQ ID NO: 84997 - DNA, 590 bp, Homo sapiens
  chr2:119602828-119603418
  hyper
cgtggctacgttgttcccggccccctgccggaccgggtgtctggagtgctgatcttgggccaaagcttctgccgctctcccagacactgcgggccggggcgtcaggcaggccttggccttctctcccggagcccagctcaggtctcctcctcgggttcgccaagcgcgaggggcacacggaaaagtggtggaaggaaagccgagaaaaacaggcctacggatgccagaagtctgctggatgtgcgggtgaaaaaaggaaagcgccgcgcggggaggatgcgggaaccgttccgcggagaagctacggaggaaactggctctcatgcccttggacacgcttcctggcctgagcctgacctgttttctctcctctcccactgtttttcagctccagaaaaccaggggctgccagcacccacctttttggcaactgcctttccctggtttctacccacccgggtcagactcttttcgctacccagccgggggagagggacggctttcagacgctttcctccctgtcttcctgtgtttcccatgtttatcaatgtaaacggtctctccgcagaaaatatcgagatggtgtttgt

SEQ ID NO: 84998 - DNA, 459 bp, Homo sapiens
  chr2:119603634-119604093
  hyper
tcaaaatcaaagaatcgagacccgagcctcctgtgccacgagctgtagcttctcgggtggtggccgcagaggccaggatcgcatagctggatgaacattcggttgtgactggaactggggtgaggaagcaggcgtgagagactggagtacccgaggccgggtttgctctccctagcgccgcagcttggcgttctggggcggtccgcggggccagaaggcatggcgcagcccggagttgggtactcaccggaggatggacgatccgaataacgtgtgcagtacacccaggcgggccatacgagaggctgctgcgagtcagttttgaccacgggcccgccgttggctgagcccataagtaggatagccgggttgccgtgctccgggtatttggtgccctgcgctccggggctccccgcgccgcctccactgccgccgccaccggtgtccgagggcttggct

SEQ ID NO: 84999 - DNA, 527 bp, Homo sapiens
  chr2:119604153-119604680
  hyper
ttcccagctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 85000 - DNA, 162 bp, Homo sapiens; identical to SEQ ID NO: 6349
  chr2:119604689-119604851
  hyper

SEQ ID NO: 85001 - DNA, 28 bp, Homo sapiens
  chr2:119605271-119605299
  hyper
gggagagcgcgtctccgccagcgccggg

SEQ ID NO: 85002 - DNA, 27 bp, Homo sapiens
  chr2:119605359-119605386
  hyper
cacaaactctctcgcttaaaaaaaaaa

SEQ ID NO: 85003 - DNA, 30 bp, Homo sapiens; identical to SEQ ID NO: 27453
  chr2:119605745-119605775
  hyper

SEQ ID NO: 85004 - DNA, 55 bp, Homo sapiens
  chr2:119606135-119606190
  hyper
cccggtccagactttcgacaacaccctggagctgccctggcgccatagagccaag

SEQ ID NO: 85005 - DNA, 237 bp, Homo sapiens
  chr2:119606705-119606942
  hyper
tggaggaccagtatccgactatgctgaagcctgcggtggccgagaaaggcgtcagcaaacgaggccttcgggggtgtcatcttagagctccagcggacctcctcgccctgaacgccctccgcaactgggacagtagagaaaggatccctttggaaatattgtctatttgtgacatgcgaaagaatccccctacctccagttttccagaaaagtcacagagggttaggctaggaggaa

SEQ ID NO: 85006 - DNA, 182 bp, Homo sapiens; identical to SEQ ID NO: 2039
  chr2:119607442-119607624
  hyper

SEQ ID NO: 85007 - DNA, 15 bp, Homo sapiens
  chr2:119607847-119607862
  hyper
cgtccccccacctcc

SEQ ID NO: 85008 - DNA, 30 bp, Homo sapiens
  chr2:119608197-119608227
  hyper
ggtatatttgtgtggcggtccttttggggg

SEQ ID NO: 85009 - DNA, 139 bp, Homo sapiens; identical to SEQ ID NO: 27457
  chr2:119610236-119610375
  hyper

SEQ ID NO: 85010 - DNA, 79 bp, Homo sapiens; identical to SEQ ID NO: 27458
  chr2:119610540-119610619
  hyper

SEQ ID NO: 85011 - DNA, 96 bp, Homo sapiens
  chr2:119610844-119610940
  hyper
ccccaaaaaattccccgaggtcggtgttctcaggcctaggggaccctctcccacccctggtccccacctgtccgagtggccgctctcgcctggatc

SEQ ID NO: 85012 - DNA, 513 bp, Homo sapiens
  chr2:119611311-119611824
  hyper
cggcgcctaggttttctgcctctgccggccccggagcccgatccaggccgcgcctccctgttgcccaaggggcgtgcatctttgggaccctcttcccggggaggtgcaagaaaagctccgggttccagcagaggtcggcgctgcagggcccaggcgggaagatgtggaaggaaaaagtttagtacagaaggtggggcggtaagggaacggaaagtctcaagagcctgggagcgggggagaggggcgagaacccgtctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcagaggctctgggtgggtgcgtgagtgagtccaagtgtgtgcccgagtgtgcacgcaaaaattgcgttcgttttgtctctcta

SEQ ID NO: 85013 - DNA, 30 bp, Homo sapiens
  chr2:119612029-119612059
  hyper
caccccctccacccccgccattgaactatg

SEQ ID NO: 85014 - DNA, 30 bp, Homo sapiens
  chr2:119612324-119612354
  hyper
ctgggaagccgcgggcgtcccagttttgtt

SEQ ID NO: 85015 - DNA, 122 bp, Homo sapiens
  chr2:119612692-119612814
  hyper
tgggctcacttcctgcggggggactgggggtagggatggggtaggggtggaataccggccacaaagccattccaggcacgtccctcccctcccgcgccgatgactcccgccccaaaattgtt

SEQ ID NO: 85016 - DNA, 875 bp, Homo sapiens
  chr2:119613016-119613891
  hyper
gctggggctggcagccgaggaggctgcagggacgcgcatggaagagccggtgcgtgggagggtttgcgggggggacatcgcgccccctaggggtgaccccagtgggtcccgtgtgctctccgcggagccggcggagccttgtcctctgcacccggcgcgcagcggccccttaaacagtggaaccgtgaggccgctctaagccgaagggctggaatctgggtttctcgggttttattttagaccattcggcaccaagcccgagctcccccgccgcaccgcttccagtcccctttctttccatagagcgacccgaagccggcggtggcgcagggagccgagtctgatgagctcgcgggcggctgaaggccggcttccctgtggggaacgcgccacctgtcggcgccagtgagaactgcgtctgtgtggcgccctcggggtattcggggctgcggggagatgtgtgcctgaagccctgcgcttgcggtggggacgtccggcctctttcctggcaattgacccctgaggcgggagagacaacggaattcccacaaagggatccttctcgggatctccccacctcaagacagctaaagctggaggaaaagcccctccggggggtggggggtgcgggtttgccctgcgattccgaaagcagaaaatacccgagccacacagggacgggcgccgcgttggtagtcggggctacgttcctactccctctacctcccccgcgctgtgtgaccctgggcggaaccccgctgctctctgggcctcagtgttcttattcgtaaactgagggcgttggatgagattggtcctctcccaactctgaccttgaaactgatactgaatctgagcagcgtctgtagacacct

SEQ ID NO: 85017 - DNA, 71 bp, Homo sapiens
  chr2:119614130-119614201
  hyper
ggagagcacccatgtcgtgggtccagcgaggacacaaggaggggcttagagacatgcgggaggcttagatg

SEQ ID NO: 85018 - DNA, 1025 bp, Homo sapiens
  chr2:119614602-119615627
  hyper
cgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagaccagcttctgtggttgcactcaattgaacaacaggcggatttacgttaaactttgttt

SEQ ID NO: 85019 - DNA, 577 bp, Homo sapiens; identical to SEQ ID NO: 27465
  chr2:119615975-119616552
  hyper

SEQ ID NO: 85020 - DNA, 512 bp, Homo sapiens
  chr2:119616781-119617293
  hyper
cgctgaggcagtcgcctctccgggtcgctccactcccggactccggcagcctgttggccttcctgtcaccacctcgcatggagcaccctgccctaagccctggaactgggcccctggctcgcaaggaagagggtgggggtggggtagggaggaaaggccgggaagcctgctagagagaaggaggtgactgagggccagcatcgccaggaggcatagttccactagtccccagtcccatggttccaccttgaccccagttcacctgcagggcggcagggaactcctctgattcccgaacctgcagctggtgctgcactggaggggtttccgttggtccaacgcaccccggtgaagggaattccctggagaagagagaggaggtgccagaacctggctgtaaggggggtgcaggtgtgcagagagaagcgggttgtcccgggctgtgggtcctgcagcgcagcacctgagacttcagtttccttccttttccttactcccgtagtcttccggga

SEQ ID NO: 85021 - DNA, 308 bp, Homo sapiens
  chr2:119769161-119769469
  hyper
ttgctttctctctcccggcacgcggggtcgctgcaggccgtgctcagccctccaggagccggccggtgtccgcgctcgcgggcggctctgggaccgggagaggctgcggctccccgctaaggctcctgcggccggcgcctcctggacccacccacccacctcggaagacagacgcctctcttcagctgtaccggccccaggctccgccaaactccctcctcgccctctccttccgaccccctagtaataacaaattcactgttgaccctggacagatggtgttcaaaaagctacgtgcagggggccag

SEQ ID NO: 85022 - DNA, 60 bp, Homo sapiens
  chr2:11986834-11986894
  hypo
tttggctctcagtggcgggaatcccgggaggggagcccctgggagcgtgcatagtggttg

SEQ ID NO: 85023 - DNA, 40 bp, Homo sapiens; identical to SEQ ID NO: 27467
  chr2:119914013-119914053
  hyper

SEQ ID NO: 85024 - DNA, 189 bp, Homo sapiens
  chr2:119914280-119914469
  hyper
ggaagtgttatgaatcgagagtggcctttgccaaggagccgcgcccgggcggagaccgggcggcctgcagccaccccgcctcgcaccccccgcgcccctaatccgggtacagaagaaagcccgagaacgtgctgtacttgttattattgcctccgtgagccttcccgccatccagcttcacatacactt

SEQ ID NO: 85025 - DNA, 1078 bp, Homo sapiens
  chr2:119914529-119915607
  hyper
cgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaaatagggagaggggaagcttcatgaacactgacccagagtggaagggtgggagccaggggccagggccaagaggaaaggaggctgcagggcaagggggcgacctggagagaactaaagaactgaggtttccgagaagcccacggagaggcaggcagggacgcaagtggccaaggagtgtagtttaggtatgggggtctctgggctctcaaggcccaacatttggctctacgtcccggtgagcgcggcctcggcgcatcgggaagcggagatactgtggcaccgaggcgcgttcattcccggggctcgcagggtagcccgcgggtggagagaaaggaggctggttccctgggaggttcagggcgcgggcgagggtttacgggggccggtgagtgtaggggtcactgacctgcccgttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggt

SEQ ID NO: 85026 - DNA, 297 bp, Homo sapiens
  chr2:119916524-119916821
  hyper
cggctcccaggagccacaagtgggcgcagcgggcgcggtcccaagccggggcacatcggacacacccacccgcggccacactcacgcgccccccaccgataacacacacagacacccacgcacgcagtggcggggcacgcacagccacccccacatggccacgaaagcagctggaatccaggtgtcagcagggctcctctggggtcacctaatccatcccctggcctgcaaagaggatcaaacctcaacccaccgagtccaggagagtcccgtgaggtccagcgggaaggagtttct

SEQ ID NO: 85027 - DNA, 50 bp, Homo sapiens
  chr2:119997993-119998043
  hypo
cacctcaatccataccgacctcacagcaaaccctccgtggccacagcctg

SEQ ID NO: 85028 - DNA, 30 bp, Homo sapiens
  chr2:120000595-120000625
  hypo
ggtggctgtgcctggcgtgagtgtcttggc

SEQ ID NO: 85029 - DNA, 404 bp, Homo sapiens
  chr2:120005365-120005769
  hypo
gaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacct

SEQ ID NO: 85030 - DNA, 30 bp, Homo sapiens
  chr2:120160587-120160617
  hypo
cctgaaggtgttacccgaaaacaccggggt

SEQ ID NO: 85031 - DNA, 337 bp, Homo sapiens; identical to SEQ ID NO: 27471
  chr2:120190015-120190352
  hyper

SEQ ID NO: 85032 - DNA, 167 bp, Homo sapiens
  chr2:120281646-120281813
  hyper
cacctgcatcctgcccgaggccggagaaagggcgagactgtcgctccctcgggtccccagcctgcagaagggcgcagtactcaccgagtgcgcggcgcaggcgagcagcaccggcagtagtagctgctgcagcggcggcgacaggtggggacgcatggtgcccgcac

SEQ ID NO: 85033 - DNA, 87 bp, Homo sapiens; identical to SEQ ID NO: 27473
  chr2:120281814-120281901
  hyper

SEQ ID NO: 85034 - DNA, 186 bp, Homo sapiens
  chr2:120281938-120282124
  hyper
cgacctgcggcgggccccgggactgctcctcctcggaccaggtggccgcgcgcgctaagccgcccgccccattgatcaggacgcggctttgccggcgcgcctcctccacccggcagggactggcgcggggtcggcgcggaggctggcaggggaggaggcagagggagggcgcggggacccggagtc

SEQ ID NO: 85035 - DNA, 30 bp, Homo sapiens; identical to SEQ ID NO: 39644
  chr2:120441329-120441359
  hypo

SEQ ID NO: 85036 - DNA, 138 bp, Homo sapiens
  chr2:1204780-1204918
  hypo
ctgtacaggccccatcgtcaccttcctcgcccatagctaaggacccgaggtatgagaagcgctggctggacaccttgtccgtgcctctgtccatggctcgcatctcaaggtacaaagccggaacggaaaaattaaggt

SEQ ID NO: 85037 - DNA, 30 bp, Homo sapiens
  chr2:12072116-12072146
  hypo
ataaaatgagaataacgcttccagccttgg

SEQ ID NO: 85038 - DNA, 30 bp, Homo sapiens
  chr2:120748913-120748943
  hypo
gaagtatctctcttccgggtatcttccgaa

SEQ ID NO: 85039 - DNA, 20 bp, Homo sapiens
  chr2:120769511-120769531
  hypo
tgagtctggctttgtcgcca

SEQ ID NO: 85040 - DNA, 20 bp, Homo sapiens
  chr2:120769771-120769791
  hypo
caccgcgcccagccaaatgc

SEQ ID NO: 85041 - DNA, 59 bp, Homo sapiens
  chr2:12092493-12092552
  hypo
agaggccacatgaaacgaccgaaagtggcttgcttgccagccttcgcagatgaggggtt

SEQ ID NO: 85042 - DNA, 97 bp, Homo sapiens
  chr2:120973458-120973555
  hypo
gccaccgcgcccggccctttcaactctttatcggatgagaaggcgtaggaatcatgtctttctaactggctgatgatatggccgagcagatgctaac

SEQ ID NO: 85043 - DNA, 335 bp, Homo sapiens
  chr2:120973770-120974105
  hypo
gcccaaccccagtctcggccctgctccactccagcactgtagttgtagcagttttcctactcatccgtttctactctttaatagaaaataacctattcatccaaacctttacattatgtctaggggctattaccaccctacttacagcaatctgcccttcagcgccaggggaatgcccgacagctaccttctcccccgtgaccgccgggctccgtatcctgggcgagccgcccggctccggatagcaggaaactggggagggctccggcctcgcctcgtcagccccggagccttcaccaatcccgggcccggaaagaccacgcccactgctggcc

SEQ ID NO: 85044 - DNA, 612 bp, Homo sapiens
  chr2:120979880-120980492
  hypo
cagaggcacgacaatcgttatccaactgatagccatggtcacgtgtgttctccgctgctcggcaaccacatccagggaccgcaggaacaggagggaccagacgatgtaatagaggacgaccaggcaaaggaacgacatgaggatccacaggggcacaaacaccaccagccacggccagtgaataatcctgtccagctttagggcgatgaagatgaactgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcag

SEQ ID NO: 85045 - DNA, 36 bp, Homo sapiens
  chr2:120994230-120994266
  hypo
tcatggcctccacatcgaagccgttgtgggacaccc

SEQ ID NO: 85046 - DNA, 93 bp, Homo sapiens
  chr2:120995387-120995480
  hypo
tagccttctcagaaacgccccatgtctgtggcaggcttggtgttcctcctgccattccaggctttctgctgcccctcccctcccctcccctcc

SEQ ID NO: 85047 - DNA, 156 bp, Homo sapiens
  chr2:121003489-121003645
  hypo
tagaaaatagggaatcgccctttgatccccaccccagagatgcgcattttaatggtttggtggtcttacctcctggtggagcgagggtctggggccttctcaggtatgtccttttaccccccgacaccaccccgcattcctcgagcctctgaccct

SEQ ID NO: 85048 - DNA, 152 bp, Homo sapiens
  chr2:12103180-12103332
  hypo
tcagccctttgaatacggcacaaatgtttttcatcagttataacagtgaaaccctggccattggaaaggtaataaaatctctgacccaaggaaagaatgtttcgcacatacctagcaaccagagcgaactcataaaacgttcattccaaggc

SEQ ID NO: 85049 - DNA, 121 bp, Homo sapiens
  chr2:121101236-121101357
  hyper
cgcctccgacgtccccgattccccaatatcctgggaaagccaggatgaactcccatcgtgcttctgccttgagtctagcccgttgcgagggaacggggtacggctccgtgtcctgtgggca

SEQ ID NO: 85050 - DNA, 102 bp, Homo sapiens
  chr2:121102132-121102234
  hyper
cagaggcagggcctgcgcggcggcggggaggcgggagtgggccgggaggagcgcctgggtccagcgcctggaacccgtcggtgccgccggccgcccagctgg

SEQ ID NO: 85051 - DNA, 83 bp, Homo sapiens
  chr2:121102536-121102619
  hyper
caacgtctatctcaacgcgcgcgcacatacggagattgtgcggcttttttcccccttgggagaaaaaacggggagagtaaaag

SEQ ID NO: 85052 - DNA, 390 bp, Homo sapiens
  chr2:121102965-121103355
  hyper
ctgcggccgcccgcccgtggatgcggcgcccagggatcctggagacaactttgccgtgtgacgcgccgggaggactgcagggcccgcggccgagggctcggcgccgcctgtgagcgggcccgcgcggccggctctcccgggcaccaagcttgctccgcgccactgcccgccggcccgcggcgaggacgacctgcccgtctccgccgccggcggcccttcctggcgcgaggcagtgagggcgaggcgctcaggtgcgagcgcggggccccgccgcagcgcccgccgcagcgccgcgccaagccgcgcccggctccgctccggggggctccagcgccttcgcttccgtctcagccaagttgcgtggacccgctctttcgccaccttccccag

SEQ ID NO: 85053 - DNA, 400 bp, Homo sapiens
  chr2:121103677-121104077
  hyper
ggcgcgcccggagcccggagcccggccctgcgctcggctcgactcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtca

SEQ ID NO: 85054 - DNA, 1132 bp, Homo sapiens
  chr2:121104109-121105241
  hyper
cgcgaggacggccgcgtggagatcccgcacctcgacggccacgccagcccgggcgccgacggccaggagcgcgtttccgaaatcatcagcttcgccgagacaggtgggtccggccctccggctgtctgccgcggtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggccggaggagagagagagtgtgtgtgtatctgtgtgtgtgtctgtgtgtgtgtgtgcctgcgtgagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagccccggtgcagttagggcgggggcaagcgggg

SEQ ID NO: 85055 - DNA, 181 bp, Homo sapiens
  chr2:121199949-121200130
  hyper
agccggccgcctggccggccagggctgcttggcagggagcgccgggatctggggggaaagaaatcaagccccgaagctgaaggcttaattaggctgatatcatcccgcacaaatgttcctccgagaggaaggcttctgggcaccaaaattattttgtgattaaaagcgaaaaggaaggaga

SEQ ID NO: 85056 - DNA, 64 bp, Homo sapiens
  chr2:121200390-121200454
  hyper
ggccatgcacgtcgtcgtcatcccatttcgtagatggggaaaattagctcggagaggtgacatc

SEQ ID NO: 85057 - DNA, 36 bp, Homo sapiens
  chr2:121200695-121200731
  hyper
gaccaggcccactgccggccccgcccagcacctgcg

SEQ ID NO: 85058 - DNA, 30 bp, Homo sapiens
  chr2:121242474-121242504
  hypo
tcgtatcatttcagccgtcttcaaacaacc

SEQ ID NO: 85059 - DNA, 244 bp, Homo sapiens
  chr2:121344837-121345081
  hyper
aaggcctgtcctctgcgaggcttcaggcgcctggaggcagggtgggagggcagggcgcgggggctttgtctgcgcggaaacgccctgcccggcgcccgcacaaaggccgctttgtgcccgcggccggcggaggtgggggccgcgcgtccccggatccccctgccccggcccggcccgcggccccgagggggcgcccgccacttcgccgccgccagcccgtggccccgggcgccaaagggcctct

SEQ ID NO: 85060 - DNA, 248 bp, Homo sapiens
  chr2:121412072-121412320
  hyper
agctgcgggagggctcgtgagagccaatgagagcgcggaaggcggcgagcgagccaatggacgcggcggtggggcagggggcggggcctgggcgaggccgggggcggaatgggctgagtgccctgtctgaatgcggggaacgtctgggcctccccgcctggcccgctcttttaccgtcgcgcaggccccgctccaggccagccactggccccaccaagccccgcttcgcagcccgagagagcgggaat

SEQ ID NO: 85061 - DNA, 142 bp, Homo sapiens
  chr2:121492883-121493025
  hyper
ggcgacgagggctagcggcggcgggggacgcctcaggacccccggcacctgcgctcgctgcccgcgggaagagggtccgcgtggacccagcccccgcgtcccttctctggcgtccccggcttccgcgcgggcgtccagagaa

SEQ ID NO: 85062 - DNA, 861 bp, Homo sapiens
  chr2:121493409-121494270
  hyper
ccgtgcgcgcgggggcgctgcgcagtccggcggcgctgatggattgcagaagtgccggcgcttgccagccgaggcagcacggctccgcggactttttttcaaactcccatcaatgagacttcgaggaggagcgggcggcggcggcggctgcgactgcgaacgcggaggaaggccaggagccgcaggaggagccggaggaaagagcttgggccgcgcggcgcgccgcagcctcggggagccgcctgctcgccggcggtaggggctgcgcggcgcccgcccgcctctcggtcccctctcttgcctggcccgccccgccccggctggctggagccccggcacaaggcagccagccgagggtcgccgcgccagccaaggtgggatgggggcccacagccaccgcccggcgcccgagaggccacctgcgtgctagaggcaaacttttgtctctctcggtaaagttgcattggccttcttttgcttgcttttcgtgacgaagcgcctcccacctcggccaagcgcgggccgactgggatgctgcgccgtctcggggggtccctcggccgggtaccggcgcctaggccttgggatcggggccctgggcttcgggggactagaggctagtaggcgcgaccccgcctggggctctggacgagcagggcggggacgtaaggagagtcctggggcttggagctcgtggccagaggtcgatgttgcaccctctccctacctgggggagagcaccactcttctcggggtgcacagcgagccggcctccgcgcgccggcgggggtctgttttttcagggggtggagggtgggatcggaggctgggatgctccgaagctgccgtaggtgggcatgg

SEQ ID NO: 85063 - DNA, 40 bp, Homo sapiens
  chr2:121494968-121495008
  hyper
ggctctcggggacctcgagcccccccgagggtgcctcttt

SEQ ID NO: 85064 - DNA, 30 bp, Homo sapiens; identical to SEQ ID NO: 39649
  chr2:121639825-121639855
  hypo

SEQ ID NO: 85065 - DNA, 30 bp, Homo sapiens
  chr2:121731009-121731039
  hypo
gcctggctctgcgcacgtgtcagtgcaagg

SEQ ID NO: 85066 - DNA, 30 bp, Homo sapiens
  chr2:12179974-12180004
  hypo
agccctttcccagctcggcttgtcccttcc

SEQ ID NO: 85067 - DNA, 20 bp, Homo sapiens
  chr2:121852396-121852416
  hypo
cagaacgtccatcagccagg

SEQ ID NO: 85068 - DNA, 24 bp, Homo sapiens
  chr2:122013325-122013349
  hypo
tttttttttttgagacggaatctc

SEQ ID NO: 85069 - DNA, 243 bp, Homo sapiens
  chr2:122042116-122042359
  hyper
ctgcccctccgagcccgccgcccgcccctcgtccaaggaagggcactgcagagggcgcgaggctgggagaggggccccggcggagacgggcaaagagcaggggacgaacttccccgggccgggcaccaggctgctggcaggaagtttcctctgcttctccgatacgcgggggagaggagggccgcagggggcggacgggccaggggaggcggcgggccggcaggtgcgcgccctgcaccctct

SEQ ID NO: 85070 - DNA, 337 bp, Homo sapiens
  chr2:122042645-122042982
  hyper
gctggttgtagtgctcgggctgcgtgtgccagaagagcatggctggaactcccagcgcgccgaccggggcgcggcagcaagcgcagacgcggggcgcgccgaggacccagcggcggcttcgcgctccgaacccgcggtgccggccggctcggcgcatttatcggcggcccaggggcgggacagcggtgagacccgccccccaggaagcgcggcccggagggcggctccccgcggcagccgcacctggctgactcccgcgcgtgcctttccggcgagcgagcgcgcctccggggcggccagaccagagggctctagggccggccgggtgctctcccca

SEQ ID NO: 85071 - DNA, 47 bp, Homo sapiens; identical to SEQ ID NO: 39651
  chr2:122088821-122088868
  hypo

SEQ ID NO: 85072 - DNA, 315 bp, Homo sapiens
  chr2:122104569-122104884
  hypo
cagagcccaggtgtgcgtatcagcccaggtaacactatacataccttgctccctgtgagctgtgcaaggtgaggtttcaggtcttctccgattacggaataaattgccactaagcaaaacacgctggccttacgcacactactttcggtgttgtcataaccctagagagccagaagggaacacgaaaaggaaaccagatcaaagattcattccatagccaacatctcatcaacgtttccacaaatgccctcagagttcaaccttggacttgtcagtaacaaccaggatagacctcagccccgcaatggaatccag

SEQ ID NO: 85073 - DNA, 30 bp, Homo sapiens
  chr2:12222158-12222188
  hypo
cgctgcctatagactcgtgtgaagggacag

SEQ ID NO: 85074 - DNA, 30 bp, Homo sapiens
  chr2:12246101-12246131
  hypo
tgcctggttctgcctcgagggcttgtaccg

SEQ ID NO: 85075 - DNA, 272 bp, Homo sapiens; identical to SEQ ID NO: 39653
  chr2:122495322-122495594
  hypo

SEQ ID NO: 85076 - DNA, 36 bp, Homo sapiens
  chr2:122511837-122511873
  hypo
aacagaacaaaacaacaataacgaaaaccacacaag

SEQ ID NO: 85077 - DNA, 30 bp, Homo sapiens
  chr2:12284474-12284504
  hypo
tatggaaatcacatccgcaagcatcaccct

SEQ ID NO: 85078 - DNA, 30 bp, Homo sapiens; identical to SEQ ID NO: 39467
  chr2:12303872-12303902
  hypo

SEQ ID NO: 85079 - DNA, 24 bp, Homo sapiens
  chr2:123285320-123285344
  hypo
gggcgtggcggctcacgcctgtaa

SEQ ID NO: 85080 - DNA, 26 bp, Homo sapiens
  chr2:12351331-12351357
  hypo
gtgagccactgcgtccagccgatttc

SEQ ID NO: 85081 - DNA, 76 bp, Homo sapiens; identical to SEQ ID NO: 39468
  chr2:12355766-12355842
  hypo

SEQ ID NO: 85082 - DNA, 35 bp, Homo sapiens
  chr2:124439807-124439842
  hypo
ccccggaaggacggccggctcggagtgggggcacc

SEQ ID NO: 85083 - DNA, 170 bp, Homo sapiens
  chr2:12471019-12471189
  hypo
tcatgatgaaatcaacgtgctgctgcgagggagactaattcaggccaaggtccaggtgacatctgagctgcagatttcatattaaaggtgacatcttagttgcgccttaatttaaaaagaatatgattttgactgctggataaaggggaaaagaccggggaaggcaaata

SEQ ID NO: 85084 - DNA, 28 bp, Homo sapiens
  chr2:124782165-124782193
  hyper
tgtctttcctctctccgtctccctgaga

SEQ ID NO: 85085 - DNA, 1117 bp, Homo sapiens
  chr2:124782288-124783405
  hyper
cgcgaagaccggcgagaggatgtgcggtgggagtagctgcggggtctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 85086 - DNA, 90 bp, Homo sapiens
  chr2:125742056-125742146
  hypo
actttgggtaagtggcgaggtactttttacccaggtaaagggtgagattgggttagaggcccaatttaagaggattacagtctcacctaa

SEQ ID NO: 85087 - DNA, 30 bp, Homo sapiens
  chr2:12608741-12608771
  hypo
ccatttattgagcaccgataaggtttggct

SEQ ID NO: 85088 - DNA, 40 bp, Homo sapiens
  chr2:126236905-126236945
  hypo
ggtcctgccagaattcgagcaccacgagggcgggccggca

SEQ ID NO: 85089 - DNA, 39 bp, Homo sapiens
  chr2:126237005-126237044
  hypo
cccctgactggtggcgccggctggcggctccagggccct

SEQ ID NO: 85090 - DNA, 31 bp, Homo sapiens
  chr2:126347693-126347724
  hypo
accaacaaaataggccgggtgtagtggctca

SEQ ID NO: 85091 - DNA, 24 bp, Homo sapiens
  chr2:126413299-126413323
  hypo
aaatatagcaatggccgggtgcgg

SEQ ID NO: 85092 - DNA, 30 bp, Homo sapiens
  chr2:126700543-126700573
  hypo
ctgcagagcagggggcggcacctgttgtgg

SEQ ID NO: 85093 - DNA, 30 bp, Homo sapiens
  chr2:12682673-12682703
  hypo
agaagagatgttctgcgggtttctggggta

SEQ ID NO: 85094 - DNA, 30 bp, Homo sapiens
  chr2:127227218-127227248
  hypo
aatcctgggtgaatacgcaacccttcaaga

SEQ ID NO: 85095 - DNA, 172 bp, Homo sapiens
  chr2:127374881-127375053
  hypo
tctcataatcctctccgtgattttacagagtcagtgtttatatcccagctcttgtagataaagggcctgagactcagaagataggaaactacccaagatctccctattccaaaatggcaggattgggatttgagcccagccccaaataattccaaaacgcatgcttttctgg

SEQ ID NO: 85096 - DNA, 265 bp, Homo sapiens
  chr2:127395350-127395615
  hypo
ataaatttaacacaacgttggcagcacacactgagctgcgagggtgaaagtgcagggtaggaggtgaatggtgttccatcggggctgggctttcttcagacagcgagtcacaaggagagaagggcaaggtcgctaacgggcaaggaggagcggaggttgaggttgcagggtgggtcccatgtggacttcagagtctaaccggggtgaggaaagaactgtggacatgagagacaggatagggtcaaagtatcgaggattccaacaa

SEQ ID NO: 85097 - DNA, 30 bp, Homo sapiens; identical to SEQ ID NO: 39659
  chr2:127397957-127397987
  hypo

SEQ ID NO: 85098 - DNA, 102 bp, Homo sapiens
  chr2:127412026-127412128
  hypo
gggactactgttccacgtagacgtatgtgtatgtattaccaaaaaaaaaagttaaactgttaaagtaatcacgggtgcagtggctcacgcctgtaatcccag

SEQ ID NO: 85099 - DNA, 207 bp, Homo sapiens
  chr2:127417883-127418090
  hypo
gctgctgcccttgcccgccttagcagctggctcggggtggccctcgagccctccctcacgcaccgtcccaggcttgctgcctttccagctgcacctctcacaactgttcacgacaggcccctcaacacgccgcgggcctggcacacactcacctgctggtctgctaggacccagtttcccaagcctagaaaacgacccaccacagcc

SEQ ID NO: 85100 - DNA, 37 bp, Homo sapiens
  chr2:127422857-127422894
  hypo
aacttttatagagtacgttgttacaattgttttactt

SEQ ID NO: 85101 - DNA, 336 bp, Homo sapiens
  chr2:127423014-127423350
  hypo
catccgctgggggtcttggaaagcatcccccataggtaagggggaaccaccgattcatgggacagatagatgatcacccagtggcagctcgaagggagattagggcacagataaggctggaggacatcagtgtaaagaggccaccctgtgaggggcccagaagggagccctggagaccctctgggtgcattgatcacctcagatgggggcccaagggatgccgacgcagggcaaagcactacagcagactcggcacaggtgcctggggctgtgcacgccctggcaagcgcccactctgccctgctccgcacctagtgaggacgtgtaacacacaca

SEQ ID NO: 85102 - DNA, 279 bp, Homo sapiens
  chr2:127427725-127428004
  hypo
gtctccttctgagaccgcagctcccactcagggaggcttgtgctgcagcacgccactgcccagagctgctctagcctcactggaccaagccttaagtttagccaggactcacttgctggggcccttctgggacaccccgattccaccctggggctcaggattgcctggagaagtctcactgtgcagcgcctctccaaccagtgcactcacagaggggcacaaagagcccagcaggccacccacctcacctccccattgctgtctcggccctgccatgag

SEQ ID NO: 85103 - DNA, 208 bp, Homo sapiens
  chr2:127428985-127429193
  hypo
gctttatcacaggcacgagcacaggggagcaacctctccacgcacggggccaggtgtcagctgtgcacttgcatgcttccttattggaacctctccctaccgggaggccatcattagatttggagatggagcctcgggggtcaatgtgtgtccgtattcttccagtcataacctggtagctccagagctcaaccgtggtctcctggag

SEQ ID NO: 85104 - DNA, 30 bp, Homo sapiens
  chr2:127430819-127430849
  hypo
gactcctgattcctgcgcttctcatcttca

SEQ ID NO: 85105 - DNA, 127 bp, Homo sapiens; identical to SEQ ID NO: 39665
  chr2:127433244-127433371
  hypo

SEQ ID NO: 85106 - DNA, 92 bp, Homo sapiens
  chr2:127435199-127435291
  hypo
atagctcccatgtgccgggcaacaccccgagagccacactcagtgctgctttgtatgtgttgcctgccgtaatccttcgctagggatgagca

SEQ ID NO: 85107 - DNA, 202 bp, Homo sapiens
  chr2:127437938-127438140
  hypo
atccaagggacaacccggagcctcccctcaaataatcctggcagcggactctcaatgagcataggaagtgagaggaacctttccagtgtctctaggaaaccgttcacactggagacccctgagaggacagctgagtaacacaccaataacaaactcagggagctcgagaagcaaagtctgtggccagcggccctgtgattcc

SEQ ID NO: 85108 - DNA, 262 bp, Homo sapiens; identical to SEQ ID NO: 39668
  chr2:127438633-127438895
  hypo

SEQ ID NO: 85109 - DNA, 30 bp, Homo sapiens
  chr2:127439943-127439973
  hypo
gcatggaccagaccccggcacaagggcccc

SEQ ID NO: 85110 - DNA, 417 bp, Homo sapiens
  chr2:127453528-127453945
  hypo
tgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccag

SEQ ID NO: 85111 - DNA, 21 bp, Homo sapiens
  chr2:127459661-127459682
  hypo
ccaccgcgctcagcccaggaa

SEQ ID NO: 85112 - DNA, 30 bp, Homo sapiens
  chr2:127461007-127461037
  hypo
agccgaaagggatgccgaggcatgtgtgtg

SEQ ID NO: 85113 - DNA, 29 bp, Homo sapiens
  chr2:12750064-12750093
  hypo
aaaaaaaagcaaatcgaacttgtagaagg

SEQ ID NO: 85114 - DNA, 30 bp, Homo sapiens
  chr2:127529764-127529794
  hypo
ggaatgaggatcccacgggtatcagaaggc

SEQ ID NO: 85115 - DNA, 775 bp, Homo sapiens
  chr2:127534404-127535179
  hyper
ccagccgggcaccttcgggcttagggatcccttggagggaagcccgccgggaagctgaagacagtggtcaccgccctcggtcattacttcccgggacccggaccctaaccctgcgccacatctccacccgcccccagccgtgtcctggctgcgcagctggaaaggttgagcagctcactgctgtccctctgttcggccttggacacatcgcctgaactcctgggcgcctctgctgttaagtgggggacagcactatttactggggaggaaaactccaggaatgtggaccctggggccacgcaggggttgggaagtgaagggcagggaacgcgggcggcgcccggggtctgcgggtaggcaggcggcctggccgcggaggcttccccgagtcctgcgccttcctagagagggaggggctcatatcggctggcacagccaccacgggtaccgaaacttggggacgtgcccgaccatgcctcctccggtggcccgggggccaccccgcattgcttagaagtctcgcttcccgttcctcctctctggttcagctcattactcttccggtgaccctgggtatgccacgcttattctccaggcctcagtttccccatctgtgctgtgaggagtggaaggaacgggatgactaggagccttttaagaccgagtattcgaggttctttccggccccgcggagccaggaggtgccagccgagatgcgcgtgccgcgcgcgccctccagtgcccggttcccgcttctgcacggtcctcgctgggc

SEQ ID NO: 85116 - DNA, 183 bp, Homo sapiens
  chr2:127638054-127638237
  hypo
aggcaaccactcacacgaaacccactgcagtggtgcaacttgggggcttttaagggcctttgcctttaggtggcaaggagcatgctcaggccctcaaactggtcagtgacacggtcaggttcgtctagggaaagacatctagggcagccaagagaagacaggagacagcgggggcgtgcagtg

SEQ ID NO: 85117 - DNA, 137 bp, Homo sapiens
  chr2:127643980-127644117
  hyper
acccagagccccaaacgcaccctcgcggcgcttcagcggggtgggcgtggtctggtcgacccggtggtgccgccccacagcgccccctcgcgtgcgccagccagctcggcctcagctccccgcgctcctgctcctgc

SEQ ID NO: 85118 - DNA, 125 bp, Homo sapiens; identical to SEQ ID NO: 2044
  chr2:127783043-127783168
  hyper

SEQ ID NO: 85119 - DNA, 412 bp, Homo sapiens; identical to SEQ ID NO: 2045
  chr2:127783169-127783581
  hyper

SEQ ID NO: 85120 - DNA, 81 bp, Homo sapiens; identical to SEQ ID NO: 39671
  chr2:127801154-127801235
  hypo

SEQ ID NO: 85121 - DNA, 55 bp, Homo sapiens
  chr2:127809256-127809311
  hypo
ctgagcacaacccagcgcaggtggtgcggtgcagcctgtgcgcagcccaaatcca

SEQ ID NO: 85122 - DNA, 390 bp, Homo sapiens; identical to SEQ ID NO: 27493
  chr2:127863488-127863878
  hyper

SEQ ID NO: 85123 - DNA, 452 bp, Homo sapiens; identical to SEQ ID NO: 27494
  chr2:127976374-127976826
  hyper

SEQ ID NO: 85124 - DNA, 234 bp, Homo sapiens
  chr2:127977701-127977935
  hyper
cggcgcctttgtcctcggcccgcgcccccgccgggagccgtgcgcccgcgggttgaggccgccgcggggccccgccgcccaggagcccaccccgctcgggcgccggccgcagcccggctctcaggatccgcgccagcagggccatggcgctcgtctgcatcggcttgtttgtctgagcaactttgtttcgggggctgctctttgggttgctgtttcctgcgtcttaacttgtca

SEQ ID NO: 85125 - DNA, 251 bp, Homo sapiens
  chr2:128050739-128050990
  hypo
gcaaaagcttgctaccgaacatgtcttccattatttgaggaaacaaactgttacatgataaatgctatttattcggcagataaaaggattcactacatggggtagggctggggaaggagtgagagtaaaccgaggggttagagctgttggaagcccaggtccggccgccacacgtgtgcgcaactgctcgctgttgccttgggctgttccaacgtgtgtggatgaaaattctctcccggccagttctaggg

SEQ ID NO: 85126 - DNA, 37 bp, Homo sapiens
  chr2:128158434-128158471
  hypo
aaccgggcgcactcccgccagtcgcaggagctggctc

SEQ ID NO: 85127 - DNA, 30 bp, Homo sapiens
  chr2:128166372-128166402
  hypo
atttcatggcaccttcgaccttgctctctg

SEQ ID NO: 85128 - DNA, 78 bp, Homo sapiens
  chr2:128292507-128292585
  hypo
tcaggtgttatcaaacggactcattatgagatgatcacttgggaaattttttgtttgtttgtttgtttgagacggagt

SEQ ID NO: 85129 - DNA, 53 bp, Homo sapiens
  chr2:128293399-128293452
  hypo
ctgacaaggtaagggcgtgccgggggcgtgtctgccagcggggagtagggggt

SEQ ID NO: 85130 - DNA, 30 bp, Homo sapiens
  chr2:128351156-128351186
  hypo
actgacgtgtggctgcggacagacaaagac

SEQ ID NO: 85131 - DNA, 71 bp, Homo sapiens
  chr2:128380851-128380922
  hypo
tcagcctccacatctcgggaaatgtgcatgcacatcgctcacaagcagggcctcagcgaccacctgggctt

SEQ ID NO: 85132 - DNA, 41 bp, Homo sapiens
  chr2:128421809-128421850
  hyper
gaaggcctgccctgccgccgcagctttccggccattgtccc

SEQ ID NO: 85133 - DNA, 192 bp, Homo sapiens
  chr2:128421890-128422082
  hyper
cggcgggctctgccggtgctggcgccgccggtacagccccgacgcggccagcgcacccagccgggccgccatggcgcggggcagccgccttgaggtcgcgggcgcgggccgcctggtgcaggggctatgggaccacctcggaggggaggcgcggccgcctggggccagacaccaagacgggacgggcgtgtg

SEQ ID NO: 85134 - DNA, 375 bp, Homo sapiens
  chr2:128432249-128432624
  hyper
tttgaaccttttgcccgtggttggtgtctgaccttggacaagaccccctcccgcagccctgggcgtcggttgtgagcagacggctgtcccatcttgcagcgggcgggtgggcaggagctccaccttccgctgcaggcgctcgcccagaggaagaggcgcgggggctgggggacccctgccccgacgggcgctgccgccccggcagctgcgagaatccgacgcgccagggcggagcggggatcgtggcgccgcggggctgtacgagggcgagctgcgcctcggccaggggtcccgcagtcccgcctccccggcccgggggcgtgggtgggggccgttaccttcccgtcatggtggcagcgacgccgagccctgggt

SEQ ID NO: 85135 - DNA, 496 bp, Homo sapiens
  chr2:128433025-128433521
  hyper
ccagctccagggacacggagcgcggccagcggcgggcgcgggtcaagtccttcccaacccgggctctgctcgccacctcctggattccgggcatagctttccttttaaagggagtaaagttataataaacgcgaacaagcacccccacccccacagccccgccgggacgccccgcccggcgccccctctgcagtccctgggccgccccaaccgcaaacgcgtgcaggagatggtaggcgtgggggcgatgctgagaccacctccctcccgggctttcctagcccggagttcccaccgcggatctgggcactgactccctcccgaggcacccgggaccgccgagtccacgcagtcccgcccccagggaggctaaagccgagaggcgtccctcttcagtcgcaaagctgctttccccgggaaattccgatttcatcccccgttgcgggccatcgccctaacttggcgaaagatatttcttaaacgacaaaaccaaatg

SEQ ID NO: 85136 - DNA, 30 bp, Homo sapiens
  chr2:128436077-128436107
  hypo
agaggctatggtgagcgtccaggagggact

SEQ ID NO: 85137 - DNA, 68 bp, Homo sapiens
  chr2:12856481-12856549
  hyper
agagataccatgaaacgaattctcgaaactccaggcagcaataccgatgaaagcgcattcttccaaaa

SEQ ID NO: 85138 - DNA, 537 bp, Homo sapiens
  chr2:12858144-12858681
  hyper
taactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacag

SEQ ID NO: 85139 - DNA, 22 bp, Homo sapiens
  chr2:128601383-128601405
  hypo
ttataaaagaggctgcgggctg

SEQ ID NO: 85140 - DNA, 151 bp, Homo sapiens; identical to SEQ ID NO: 39676
  chr2:128616477-128616628
  hypo

SEQ ID NO: 85141 - DNA, 120 bp, Homo sapiens
  chr2:128847679-128847799
  hypo
cctccatcctcagcgtgagccaccgcgcccggcctccatcagtgttccattagtcatctccttcatcctcctctccttcctccccttcatcatgttggctcatgtttatttattaaaatt

SEQ ID NO: 85142 - DNA, 30 bp, Homo sapiens
  chr2:128897581-128897611
  hypo
agagaatgctgtcctcgttgagggccatct

SEQ ID NO: 85143 - DNA, 59 bp, Homo sapiens
  chr2:129128223-129128282
  hypo
gatggatgaggaaaacgaatctcagggagctggagctgcttgcccgaggttctgtggtc

SEQ ID NO: 85144 - DNA, 47 bp, Homo sapiens
  chr2:129179600-129179647
  hypo
ccaggtgtgtggcttcgaggggaatgcagcagcgcccagacaagggt

SEQ ID NO: 85145 - DNA, 30 bp, Homo sapiens
  chr2:129384355-129384385
  hypo
atcccagtgccacatcggtggctgcatttt

SEQ ID NO: 85146 - DNA, 30 bp, Homo sapiens
  chr2:129493732-129493762
  hypo
atgccactacatggtcgcatgtgggtgtcc

SEQ ID NO: 85147 - DNA, 185 bp, Homo sapiens
  chr2:130482642-130482827
  hypo
ggtgtccttgaataacggagcatcttaatttagctcctcctcatctaatccacacattaataagaaaatgaaagggtgcctttggaaattatagcctggaggagaaatcaattatttacaactcatattcagttaagtaagcacactgaatgcctagcgagatttctccccgggactaacgctaa

SEQ ID NO: 85148 - DNA, 171 bp, Homo sapiens; identical to SEQ ID NO: 39679
  chr2:130497037-130497208
  hypo

SEQ ID NO: 85149 - DNA, 169 bp, Homo sapiens
  chr2:130542307-130542476
  hypo
tgcttgtaaaactggcgaaatccaagtaaggtctgtgggttgtaccaacgttaatctcaggtttcatattgcactatatttatgcaagatgcattcttccttcaaaagccatccattaacattggagggggctgcgcaaaagaaataccgtacccgccccccgacattt

SEQ ID NO: 85150 - DNA, 178 bp, Homo sapiens; identical to SEQ ID NO: 39680
  chr2:130666498-130666676
  hypo

SEQ ID NO: 85151 - DNA, 47 bp, Homo sapiens
  chr2:130680907-130680954
  hyper
cagaacctcatttgacgctgggaggcagcgaccgggtgtgggggcgg

SEQ ID NO: 85152 - DNA, 69 bp, Homo sapiens
  chr2:130737136-130737205
  hyper
ttattttgttttcaccgcaccattgtttttagtacatatgttttgtgtatttaaaaaactgtgttgagg

SEQ ID NO: 85153 - DNA, 401 bp, Homo sapiens
  chr2:130737256-130737657
  hyper
cggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctggg

SEQ ID NO: 85154 - DNA, 209 bp, Homo sapiens
  chr2:130763468-130763677
  hyper
atcaacaatgttgctcgcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccg

SEQ ID NO: 85155 - DNA, 104 bp, Homo sapiens; identical to SEQ ID NO: 27502
  chr2:130763729-130763833
  hyper

SEQ ID NO: 85156 - DNA, 87 bp, Homo sapiens
  chr2:130886777-130886864
  hypo
ggcaggagaagctcccgctactggttgccctcctaccactgtcgacaccaccaactgcagtgagccagtgtccgaggctccagccag

SEQ ID NO: 85157 - DNA, 49 bp, Homo sapiens
  chr2:130897204-130897253
  hypo
gggtctgcttcagtgcgggcaggatggcacgctccgccacaggtgggct

SEQ ID NO: 85158 - DNA, 195 bp, Homo sapiens
  chr2:130947958-130948153
  hypo
gttgcccaaggaccacgagtacagcaggtgctgcagttacggggcacgcccattcctaatcattgtgctttgtgtctcctcagggagaaacaaaggcagcgctgccctcgggggagcattggccctggcggaacgcagcagccgcgaaggatccagccagaggatgccacgccagcccagcgctaccaggctgcc

SEQ ID NO: 85159 - DNA, 63 bp, Homo sapiens
  chr2:130970979-130971042
  hyper
gctcatgagtgggcacgtcttgcccaccgccccgtcgccgaccaccacgcacttgagcatcag

SEQ ID NO: 85160 - DNA, 242 bp, Homo sapiens; identical to SEQ ID NO: 27504
  chr2:130971062-130971304
  hyper

SEQ ID NO: 85161 - DNA, 30 bp, Homo sapiens
  chr2:131018739-131018769
  hypo
tcaaaaacaaacaaacgaacaaacccacaa

SEQ ID NO: 85162 - DNA, 96 bp, Homo sapiens
  chr2:1310590-1310686
  hypo
gtgcgctgtgagccgcgctgtgtgcgtgcacgtgtgtatgccatgcactgtgtgtgtcagagagctgtgcgctgtgtgccccgcactgtgtgtgtg

SEQ ID NO: 85163 - DNA, 81 bp, Homo sapiens
  chr2:131085026-131085107
  hypo
agagcgagacaatgtctcggggaaaaaagaaagccccaaagtcagagttaatcagctggggcctgtcgcagtctggccaca

SEQ ID NO: 85164 - DNA, 102 bp, Homo sapiens
  chr2:131089765-131089867
  hypo
cccggccttcattttttattaagcactgtgccagcggtctccgtgggtgtgagcccttgtactgcacggggttcgagggacaaactgcgacagcatcaaggc

SEQ ID NO: 85165 - DNA, 84 bp, Homo sapiens
  chr2:131114416-131114500
  hypo
ttagtacatattgggcgcacacttcgtaggggcgttcgtcactgcctataaagattctaaacgtgggccaggtgcggtggctca

SEQ ID NO: 85166 - DNA, 186 bp, Homo sapiens
  chr2:131477750-131477936
  hypo
gtgaacacaacaggccgggacctgcaggagtgctccaggcagaggggcagcgcgtgggtggactctgggctgggcatgggcggggtgtgctgagcagaggacagtgggtggggcagctgccgccctgcagggagggtagccacagggctttgcagaccaggacaccagctgcgatgactttaatta

SEQ ID NO: 85167 - DNA, 759 bp, Homo sapiens; identical to SEQ ID NO: 27505
  chr2:131484847-131485606
  hyper

SEQ ID NO: 85168 - DNA, 70 bp, Homo sapiens
  chr2:131486934-131487004
  hypo
ctggtgaccatcctgcggaaccaacggctgcgacaggagccccactacctgctcccggctaacatcctgc

SEQ ID NO: 85169 - DNA, 929 bp, Homo sapiens
  chr2:131513348-131514277
  hyper
cccttcttgcaggcccgctccgaaccctgggtaagactcgtgacgaggctccgggtggccgagcccttccgagagtgctgcggtcggcagggctgggctggctctctgggctgagggggaggggctcccacacctgtgcgctcccggaagaggggacagcggcgggggcgccgtgcgcacgggggcgaggggagacgactgcacctgagggaggcgcagccgcaaccgggtgggaggcagagacacccagaaacagagacggggcgatacgaacagacaaagccggctcgagcgcggcccgagcggcggcgcagggaggcggcagcctggcggagcagcccccaccgcggccggcgcgccccctcgccacccctgcgcgccagcgccggcccgcccctcccgctggcctctggcggcttaaccctcgcctgcccgaccccgcggggcccctggagccgcggtgggtgggtgcgggcgccgggcctccccctcccggccgcggcgcgcggcgccgggagctgaccgtggtgctgagcgcggctcgcgctccgacgcggtgcccgagcctgtcgcggccgcgccctgctgcactgcgggcccccagcggtaagtcgccaaggccccgagaggctgcgttggtcctgccccgcggatgtggacccccggggagggcaaggattggggaatttggtgcattctctggcgcgatggacgggctgagggcaggaagcagggtcgacaccctccacccagcggttcccggcgcagtcaggggcctgggagcggtgacccttttaggtctgggctagggaagcggagaaaccctccgccggcggatgcaggagctgagggagagccaatatcgctgtgaggcccatctccttgcccctgggcaggccaggaccgcccagaggcgccctccaaggagg

SEQ ID NO: 85170 - DNA, 30 bp, Homo sapiens
  chr2:131525696-131525726
  hypo
tgtcaaaaggttgtgcgtgcttttctgatt

SEQ ID NO: 85171 - DNA, 30 bp, Homo sapiens
  chr2:131586487-131586517
  hypo
ggcaccagccttccccgtgcccatggtggc

SEQ ID NO: 85172 - DNA, 659 bp, Homo sapiens
  chr2:131594263-131594922
  hyper
cggcggcccctgggccgggtctgtggacggctctgctgtgtgcctgtgcgtgcccagtcccgcgggtgaccaaagcccaggggcgggcagggcaggagcctggacctcacgtgcctccagtggccaggtttgcgggggcggagcgtccgggcgagggcgcgggggcggaccctagggcggggcgcggggtggcgtcggtggagccggctcggcggcgcggctcgtagtgctgcggccgggctccgggcgtcccggcggccaccatgctcagcgtcgtgcacttcctccggagcttcttcaaggtgagagccggcgtccgggacttgcggtcgggctcccggcgccctgcgcgggtggggaggagcacagcccgcgctggctgctgcgccccgggccgtcccctgggcacccggtgggtggggacaccctcgtggctccccgccgctcccaactttccgacgtgcagaccggaggcggcgtcctgcaaagtggggccgtctcgagcgcggggaaggacggggctccgttgggggcggtagggacggcggcccggggcgagcccctgagagggcaagggcgagcgcctgagccggcctccccgcacctggaccgtcctgggcgcgcggggcactcggagccgctgcctggaccggcctggg

SEQ ID NO: 85173 - DNA, 310 bp, Homo sapiens
  chr2:131594947-131595257
  hyper
cgcttggcgcagtaccagctgttttgggaaggagggctggtgccggcccggtgggtacgggagaagtggttgctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggcactgtcaggggtggccggccacaggttgcc

SEQ ID NO: 85174 - DNA, 30 bp, Homo sapiens
  chr2:131639301-131639331
  hypo
ggagggcggcccttgcgtgggcgagatggc

SEQ ID NO: 85175 - DNA, 313 bp, Homo sapiens; identical to SEQ ID NO: 27509
  chr2:131720786-131721099
  hyper

SEQ ID NO: 85176 - DNA, 148 bp, Homo sapiens; identical to SEQ ID NO: 27510
  chr2:131721437-131721585
  hyper

SEQ ID NO: 85177 - DNA, 475 bp, Homo sapiens
  chr2:131721866-131722341
  hyper
gggtctgtgctcttgggaccccccgcccccctcctgcctttccttctcctccctcactttctgcctgtcgtttccatctcctggtcccttccttcccattgcttcgccctgctattccttttctttttctggtttccttctgattcccactgcctgtctctctgatccacgtctaccggtgggccacctgttacagccgggaccttgttggcccccataccagagcgcgctgtcaactgggaaactgattaaggtgagactagaatttggtgcccgatgcgctgtgttcctttccccaaactgttcttgaccagttgcacctgtctggctttacctaccgcagctgcttagcctctgtaaagccaggaggatggaagggggccgctggccgagggtggaacggattgcgccacctggctgtgagtgcgcttggtcctgaccgcaggactgcagctcccagcggaggcagctggtc

SEQ ID NO: 85178 - DNA, 348 bp, Homo sapiens
  chr2:131792172-131792520
  hyper
tgaagtgggggcctgcggccagtccttgtaaggaatcagagtccctggcccatccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggagg

SEQ ID NO: 85179 - DNA, 216 bp, Homo sapiens; identical to SEQ ID NO: 27514
  chr2:131792531-131792747
  hyper

SEQ ID NO: 85180 - DNA, 234 bp, Homo sapiens
  chr2:131792920-131793154
  hyper
cggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaa

SEQ ID NO: 85181 - DNA, 15 bp, Homo sapiens
  chr2:131793187-131793202
  hyper
cgcttgcatctgtgt

SEQ ID NO: 85182 - DNA, 180 bp, Homo sapiens
  chr2:131813291-131813471
  hypo
tgagttcacccaagccggtccaggcgcagggagaggacacaggcagggaggagctaagctgcgtgtcagccccacgcaactcgccagacctgctgccactgccgcccccactctcctccactaagatctgacttcattcttactttgtgtacgtgtgtgcatgcacgtgtgtgtggtggc

SEQ ID NO: 85183 - DNA, 261 bp, Homo sapiens; identical to SEQ ID NO: 14463
  chr2:131967115-131967376
  hypo

SEQ ID NO: 85184 - DNA, 49 bp, Homo sapiens; identical to SEQ ID NO: 27516
  chr2:132088590-132088639
  hyper

SEQ ID NO: 85185 - DNA, 71 bp, Homo sapiens; identical to SEQ ID NO: 27517
  chr2:132088785-132088856
  hyper

SEQ ID NO: 85186 - DNA, 296 bp, Homo sapiens
  chr2:132121322-132121618
  hyper
agcccagagacctcccggaccgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaaggagggcggtgtcggcaggagccaggggtgtgctttggcttcccaaggctagggccgttcccttcttcctcacccggctccaagacctg

SEQ ID NO: 85187 - DNA, 25 bp, Homo sapiens
  chr2:132121651-132121676
  hyper
cgcagacgtatctgggatctctcac

SEQ ID NO: 85188 - DNA, 47 bp, Homo sapiens
  chr2:132121677-132121724
  hyper
cgcggcgcttcggcttccccagccgccgccgccgcagcccaacctgc

SEQ ID NO: 85189 - DNA, 303 bp, Homo sapiens
  chr2:132152221-132152524
  hyper
tgcacagcaggggtgcggccctgacccgaaagcggggcaggggtgcggaggacaggatctccgatgtccctgctccgcgggcgcccgcagtgctgagccgaagctcggcggggctgagctccagctgggggcgggtagctgacagcctctaggcccgggctccctccagaggcagcgttgcaccctgaccctaacttccgcctgcggcgttcagatgcggaaagcagggagcctgaacccaaagctgcgatcagagaatcgtgtgtgtgaagggtttcttgtgtcctccgtgttcccctgtgg

SEQ ID NO: 85190 - DNA, 635 bp, Homo sapiens
  chr2:132182618-132183253
  hyper
caggtgggccgggggcgcggtggaagcggatggtctgggtcgacgggagaagcgaagcgggcgcgggaggcgggcgcgggaggcgggcgcgggaggcgggcgcgggaggcgggcgcgggaggcgggcgcgggaggcgggcgcgggaggcgggcgcgggaggcgggcgcgggaggcgggcgcgggaggcgggcgctggctcggggggcgcgtgagagaagccgccgcgcccggcctcgctcagacgctcagacgcccgcgcctcggcccgcctcgctccccgagccgccgccgccgccgccgcctgccgaggccccctacgccgtgcccctggcagcgagaactcatccaccggggtgtccccgcagcgagcggccgctgaaggctccccgcgcccgctcctcgccgccgcctgacacggctcccgggcgccctcggccctgtccgcgcccaccgcccggctggcgcgcagacccggttccccgcccgcccggcaaccctgtgatgaagttttcacatacgttcatttcattgaaacaaaagtcttgtaggcaccattggcaggggcaagaaacaagcacacaggttatttgcagaagaccacagaactggcaaatgacagcgccaggattcaatt

SEQ ID NO: 85191 - DNA, 207 bp, Homo sapiens
  chr2:132218311-132218518
  hyper
gagtggcgggggcagcgggcgggcgcggcgaccggggccggggcggggatcctggcggcgaccgcggaggcggcagcgccccgggcccgcggccccctcccctccggcgaggggagccgctggatggggccggtcggggggcggccctgcggcgcagagcggcggcgacggcggcggaccccccaggcgggccggggctgagcccgg

SEQ ID NO: 85192 - DNA, 49 bp, Homo sapiens
  chr2:132300662-132300711
  hypo
tcttaccgctcccgccgcactgccatctcggtcgcggtcaccaccagtt

SEQ ID NO: 85193 - DNA, 30 bp, Homo sapiens
  chr2:132301604-132301634
  hypo
ggttgtgtgcactaacgtgtactgctggtg

SEQ ID NO: 85194 - DNA, 99 bp, Homo sapiens
  chr2:132415272-132415371
  hypo
ccaggggtaccagggcggggatccacagttgccatagtgaggacctctgaggagtctggttcctgccttgctgcagtccggggagcagcgggcaggggt

SEQ ID NO: 85195 - DNA, 46 bp, Homo sapiens
  chr2:132416768-132416814
  hypo
gctcctgcacagaggcggtctgtgcctctaccgccacaggggaaaa

SEQ ID NO: 85196 - DNA, 201 bp, Homo sapiens
  chr2:132767329-132767530
  hyper
aggttccaaaggcagcgggggcaaaaagcctaggcggagggggcaaaaagccgcggcggcgggggcaaaaaggagcgggggcaaaaaccccacaaaaacccgcggcgacggggggaaaaaaccgcggcggcaaaaagcctcagcggcaggagcaaaaagccgccgcagtggggataaaaagctgcggtggaaaaaacccgt

SEQ ID NO: 85197 - DNA, 240 bp, Homo sapiens
  chr2:132767710-132767950
  hyper
gcgggaaaaaaccgcagcggcgggggcaaaaagctgccgcagcggtgacgaaaagccacaggggcgggggcaaaaagccgcaaaaagccccgacggcgggtcaaagagccgcaaaaagccccagcgtcgggggcaaaaagccgcggctgccggggcaaaaagcagcggaggcaaaaacccgcggcggtggctgcaaaaagcagcggcggcaaaaagccggggcggcgggggcaaaatagt

SEQ ID NO: 85198 - DNA, 120 bp, Homo sapiens
  chr2:132795881-132796001
  hyper
gagcgggggcaaaaaaccacagaaagccgaggcggcgaggggaaagagccgcggcggcagggggcaaaaagctgcaaaaagcagcggcggcaaaaagccgcggcggcgggggcaaaaaaa

SEQ ID NO: 85199 - DNA, 120 bp, Homo sapiens
  chr2:132796061-132796181
  hyper
gcggcggcggggacaaaaagctagggcggcaaaaagccgcgctaacgggggtaaaaagccgcggcgacaaaaagccgctgagagggggcaaaaagcagcgggagcgggggcaaaacacaa

SEQ ID NO: 85200 - DNA, 92 bp, Homo sapiens
  chr2:133014570-133014662
  hyper
acacggccacgggatcccaccgccacagacaggagggaggtaccgcagcgacccgcctaggatgccggacggccctcggcaccaccgagacc

SEQ ID NO: 85201 - DNA, 300 bp, Homo sapiens
  chr2:133014723-133015023
  hyper
cgccagggccacgttgctcgtttctcatccatcctccaacccggtcaagctccaggagaccggcatgccccccacttgggacgcttcccagggccaggcggcccaaccccgtgccacgcaaacacggtcgtcggcaccggtcgctgctctgcaggggagcgggcagagagccggctcacagcggaacgggtcacaagccggactgaacgccaggcacagccaccgctcacgcagcctcccaaccgctaggacgccggcccggcccggcgggattctcccctgactcggaaggggaaggcg

SEQ ID NO: 85202 - DNA, 180 bp, Homo sapiens
  chr2:133015296-133015476
  hyper
ggcgctcagggacgcctggggaagggagggggcctgcggtaccaggaaaaatctgcgtgcggcaaccttgagccttcgcggtctgggcagggggcctggccgctgcgcgtgcgcgcaatccccgaagggccccctagtccaccagcctcctttctcccaggcaaagcacctccaagtaaa

SEQ ID NO: 85203 - DNA, 163 bp, Homo sapiens
  chr2:133015536-133015699
  hyper
tcatctgccccagcccaccgcaatagctcacacggcccgtgcgcagccgccagaggggagcacgggacctgcgctcgccagatcaggcggcacccttccccgcgtgggaggggcgcgtctcactcaaccgcctcgacccccacaccaacgagctccctcagga

SEQ ID NO: 85204 - DNA, 30 bp, Homo sapiens
  chr2:133036010-133036040
  hypo
gctaagtccggagctcgctggcagcagctg

SEQ ID NO: 85205 - DNA, 160 bp, Homo sapiens
  chr2:133062139-133062299
  hyper
actttttcttttcatcgttgatagtgatttaacatttcattactttatcgttattatgattgtcattattttagacgaatgcacgaagtcaaaggacttccaaatgcacggacgtcaaaggctaccttcacccgggtagccttgcgaatggccactgctg

SEQ ID NO: 85206 - DNA, 338 bp, Homo sapiens
  chr2:133062361-133062699
  hyper
cgcaagctaggggcgacattgtttggaatgctgggttgagtcccggctggaccgcgcccctctcggaagtgtagccaggagtaggggtgtaggatgtgcagctgtgacccgtccctgtggactgaagtaggaggagtggaggaggggactggtgaccaatgaaaaggcctcgtgggtggggtaggctggggaagttcagcagcccctatctacccgggatggaatgggaagcgcttgggctcagtttggggagcagccctgggtttgacaaaacgtgcatcttcacgtttcgtgacagcgacttgcgctgtgccaccttgggtcgaggcttagggtca

SEQ ID NO: 85207 - DNA, 92 bp, Homo sapiens
  chr2:133174078-133174170
  hyper
tgctgagtcaaaccccgccgctgggctgggtctgcagccgggccgctgagcacaatccgctgtggttaatgattaatcgctgaccaccccgc

SEQ ID NO: 85208 - DNA, 144 bp, Homo sapiens; identical to SEQ ID NO: 27528
  chr2:133426223-133426367
  hyper

SEQ ID NO: 85209 - DNA, 625 bp, Homo sapiens
  chr2:133426637-133427262
  hyper
ggtggaggtgccagacgccaagcgctgctgcgccgcaagtccccgagcccgggtcggcggcccttctccggggccgtccccgcggcgacccgaatggccacagagggtgggaaagggcgtttgtgagcgcgcgcaccctggatccccgaccccgcagccctttcttccaggccccggctttcaggacaaccgttcgactagggtcagtggtcggggttccagctctgcagagcttagtcgggagccagtaggcgaactggagagaggacgcgagacctttgcgcctctggacgcttcggcctggctgttctcggtgtacgcgctcctgtctagacccaactacccacgctcccgcagccccacatctatcgcactctgagcgcagcaacccagcttcagcgtggccgcaggctgcctcgcgcatcgctcacctgtcggcggcgccactcccacggggtgccggaggcgccagacaacttggcagggttcgggagatgtcgccccctctccctcgcccagaacccagcaccgctcggaccctccctcctctcaagcccagcttctcccgacggtgcagccggacaagctgcagcccggagtcccgcaaacccgccgctccccgctc

SEQ ID NO: 85210 - DNA, 181 bp, Homo sapiens
  chr2:133427471-133427652
  hyper
cgcaaaaagttgccgcgatgcctaggacccacattctcccggagtcccggggccgggagagggcaagcgcatcagaggaggcgacagcagcggaggctgccccggctgcagcggctgtggctgccgaggctgctggggcccgcgctgctgccgcggagacgacggtcgtagcttagaggag

SEQ ID NO: 85211 - DNA, 221 bp, Homo sapiens; identical to SEQ ID NO: 27531
  chr2:133427885-133428106
  hyper

SEQ ID NO: 85212 - DNA, 47 bp, Homo sapiens
  chr2:134024354-134024401
  hyper
gggacgtttcactggcgctcagggaggcccctcgggtgggcagtgcc

SEQ ID NO: 85213 - DNA, 34 bp, Homo sapiens
  chr2:134024695-134024729
  hyper
ggggacgatggggaccgggcgccctgagaggggg

SEQ ID NO: 85214 - DNA, 30 bp, Homo sapiens
  chr2:134326018-134326048
  hyper
gctccgtagttgcttcgagcttgtaaatac

SEQ ID NO: 85215 - DNA, 808 bp, Homo sapiens
  chr2:135475588-135476396
  hyper
tgaagggtctgcagacgcgccctccggaaacatcaggtttcagtggcatccatccagatgaggttggtggcccaaatccaaatgtcccattcctctgccccatcatgagacgacggggcagggacccactgtgacccgcgtccgcgattagaatcggggactgcccgagaccagaggccgcccgagtcccggctcgctcccctccttgcgcccttcgccggggcgggcagccgggcggccgccgagggacatctcgcggctacacccgcagagggaagttctcccaggcagccggcggagccgcaggggactacggaaaggaggatgcaacgagcctgggtccctccgagctgagtagggcccggagtggcccagaagcgctcgactccgaacgcaaaaaatgcctcccgcaaacttttcccgtgggcgccggagggcctggagctggcggagaggagggcgcgagtccaggcggggtcggcctgaaggcagctggggtctgggcttcgagggaaggaaccgcagccgaggcggtgccggccgcagaaggtggggctgccgctctcggctagcggcgttctcgccgggaagtcggggctccgcgcccccgcgcgctccgagccccgcgcctcgcccagcgcggcccgcgagtggggagaggcgggccccgagcagccaccccggtcgccggccgggtcgggcagctcgcgctcacctcggtcctccagcccgtcgctgaactggccgctctcgctgatccgcacctgccgctcctcctccagctggggcggctcgcgcaccggggagc

SEQ ID NO: 85216 - DNA, 321 bp, Homo sapiens
  chr2:135476749-135477070
  hyper
ccctgggggcaggtgcgggcggcagggacccgccccaaggcccgggcgcgggagccggcgcaccgaggcggacgagagggaggaaccagcgtgaggacccacaggcggccctggcagagcttggctagggcgtagcggggacccgccccacctgcgccgcgggatggtgcccagaggggacccctcccactggattcctctggggtccgcgaagcccgcggccgcgcgtgggtagcagacagcgcccctaatttggcatctttctcttctggagctgcacaggcttcagaggctgtacagggtcttcgcctgggcctccat

SEQ ID NO: 85217 - DNA, 30 bp, Homo sapiens; identical to SEQ ID NO: 39689
  chr2:135832320-135832350
  hypo

SEQ ID NO: 85218 - DNA, 30 bp, Homo sapiens
  chr2:136873990-136874020
  hyper
ctcattctcctaaagcgcaaaaacttaatt

SEQ ID NO: 85219 - DNA, 467 bp, Homo sapiens
  chr2:136874932-136875399
  hyper
ccctcaaacccaaagcgcgcgggcggatcaactcctagctgctgccaccactcgatcccctcagaggatcggcgcggtgggtccacccgcctctcccgccctctgcctactgtgctgggagactggcacagctccgtcggccgcacagagtttaacaaacacgcacccagtgtcaagaacagtcaccaggcgcttaaccccgaagttaaagcgggcgcaatctcctcctgggaactcagcccaggcacgccgccctccgcctctaaattcagacaatgtaactcgctccaagacatccccgcttccccaaggaagagaccggtggtctgagtcccgaggcagcgcgcacgccttctctgcacttgtgcacagaatgttcttacgtttgcaaacagcgtgcaagccgccgcgcgcggcgggactcaagggggagacacatgcagccactggaacgctctttccagtcg

SEQ ID NO: 85220 - DNA, 264 bp, Homo sapiens
  chr2:136875881-136876145
  hyper
ggaccctgctgtttgcgggtggtcggtagtgagtccggagccggacaggacctcccagaggcatttcctaagtttgagggaagcgggatgcgcctgaagacaggtgggaagcgcgggctaggaacgcgtctctctgtggcgcgtccatccttgctaaagtggatggaattccagacctgggaatgctacagtagagacactgaggcccagggaaggggagtgacttgctggagtaacccaaccagtaggcggcaatgctggaag

SEQ ID NO: 85221 - DNA, 666 bp, Homo sapiens
  chr2:136876362-136877028
  hyper
gtaatttcataatagcggtaaccaattcgcgaatagtgctttattatcctaaaagtatgctttattataagagtaatttagcgaccagtactttttgtaacagatcactaggaacttgcacagaatcactcattcattctcacaacaccgtgtgggtattaccatcacagagatgcatttagtccgatatttatagaaggacgaactgcgtgccacgcactgttctaggcgttggggatccagcgtgaaccagacaaggcccgcattcggagaaaccagcaaataagcccggagagatgaaatgccagggatgggcagggattccaagccgggcttgaacccaggtcttcggtccccatactcggcgtcttccacgattttgagcagaggacaagctttggcacgaatcagaaattaggttgaagaactgggcggggcggagtgggggtgggggtcagacgtttaaagcgatctcagactggctgaggtttgcagtgggcgcgcagacagtgctttccccctcgcgccacttccctccggcgcggagactgggtggggcgggggagcgagtgtggggcggggccgagaaactgcgtccgcaggcggggtggccgctgcggagatagctgggaccgaggcgcgtgcgtcgcgacacggaccccagag

SEQ ID NO: 85222 - DNA, 92 bp, Homo sapiens
  chr2:137181222-137181314
  hyper
ttgcgcagccaagggcgtgcgcagcccgcggccggaagcgtcccggcagatcgcagacggggtgttgagggaccccgcgcttttgctttctt

SEQ ID NO: 85223 - DNA, 409 bp, Homo sapiens; identical to SEQ ID NO: 27537
  chr2:137522341-137522750
  hyper

SEQ ID NO: 85224 - DNA, 112 bp, Homo sapiens
  chr2:137522848-137522960
  hyper
cgagggtcgtgcgggtgcgcggcagaggcggtaggaggcggaggagaggggggagaaagagggggcggtggggaacagctgccggggtaggcgaggcgcaaggtggctcccc

SEQ ID NO: 85225 - DNA, 78 bp, Homo sapiens
  chr2:137522961-137523039
  hyper
cggccccgcgccccgcggctctcggacgcaccaggcagccaatggctgcgcagaggtgtacagcagatggcgtctgac

SEQ ID NO: 85226 - DNA, 294 bp, Homo sapiens
  chr2:137523099-137523393
  hyper
tcctcctcctccttcagtgctgaggagccagagtcgccgccgggttgccagacgctggaatgggtggtcttccgacacacaccaccatctttcttgcgctcgggaagctcggggctcagcggctcccagaggttacggcggcggctctggcgagacgggtgagtgcaagcacgcggagccccgagtcggggatgccgggccccctggccggccgactggggcgcggggtggcagcgccggggaagggggcgcgctgccggcgcagactttgctctttcctcgccggacagccat

SEQ ID NO: 85227 - DNA, 160 bp, Homo sapiens
  chr2:137523516-137523676
  hyper
cggggacgccccacgcggcgacctgagcaccgacctcatgcaacgggaccgaaccttgggacccgggcagcaggagctctgttcccttcacctccagcttggtttgagggatactgatgaaggaaaccgggggtttcccgtcctgcgcggagagcctcgg

SEQ ID NO: 85228 - DNA, 64 bp, Homo sapiens
  chr2:1379782-1379846
  hypo
agctgctgcaggctgcgtttgctggacatgggacacccagcacgtgcatcgtggtaattcctgt

SEQ ID NO: 85229 - DNA, 886 bp, Homo sapiens; identical to SEQ ID NO: 27541
  chr2:139536937-139537823
  hyper

SEQ ID NO: 85230 - DNA, 316 bp, Homo sapiens
  chr2:139537850-139538166
  hyper
cgcctgcctctcgcgcatctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctgcgggaggga

SEQ ID NO: 85231 - DNA, 82 bp, Homo sapiens
  chr2:140650882-140650964
  hypo
aggaagactccgtctcaaaaaaaaaaaaaaaaaaaggaagtgaaatgtcttttttttttaatcaacacggtgtatttttatc

SEQ ID NO: 85232 - DNA, 39 bp, Homo sapiens
  chr2:141842488-141842527
  hypo
attacaggcgtgagccaccgcgcccggcctctctttctt

SEQ ID NO: 85233 - DNA, 117 bp, Homo sapiens
  chr2:142022840-142022957
  hypo
ctctacagttcaggccgcccaggaagatgctgaaatcccaggattccatcaggaagcaaccagaaaggagagtaaccccagcctgtctcctggactgcagcgcgacccccttcaact

SEQ ID NO: 85234 - DNA, 62 bp, Homo sapiens; identical to SEQ ID NO: 39395
  chr2:1424987-1425049
  hypo

SEQ ID NO: 85235 - DNA, 97 bp, Homo sapiens
  chr2:142625-142722
  hypo
ctcaaaaccaaaaaaagaaagaccccgccaggtgttgctgataactcgcccaccatcacagtgaaggagaagctcggcttcacgagagcttcgcctg

SEQ ID NO: 85236 - DNA, 663 bp, Homo sapiens
  chr2:142887903-142888566
  hyper
ttccaacatctgcagcgcttagaattcgcggacagaagcgcacagccaagtgcacacactcccggaggggacaaaatggggaccgggaaacggccaaagggaaaagctgtgggggtgccgaggactcaggcacttggttcagaaatcccgcaccgcacctctcacccccgcacagggccagcgcacggtggtcacccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctggcaatcggcaataatcccgagagagtgagtaaggcgaggagaaactcggacattgtggtcgcccggtaaggaagcctgcgctggagactgctcggcggcaccttcggcccggcggcggcggcggcggcaggggccgcttggagcctggaatcgagcggcgtcatttacaaatgtcactggaaattcttcagctcaatgagtccagccagtcagccttctcctgcctggagcaggatgtggaaggtggagggatgcgcgcgtgcgggagagaggaggcagagcgtgtgtgagcgcgagcgagacgcccgtgtgtcttgactt

SEQ ID NO: 85237 - DNA, 98 bp, Homo sapiens
  chr2:142889151-142889249
  hyper
cccaaagtcattaaccgttgcgtaagaagggaaggttaatggaaaaggctattgaggtccccaggcagggaacaataaagcaacgaattggcagcgtt

SEQ ID NO: 85238 - DNA, 45 bp, Homo sapiens
  chr2:143931476-143931521
  hypo
atgtgcaaaattaatcgcttttcaaggggtcgttccgagttttat

SEQ ID NO: 85239 - DNA, 30 bp, Homo sapiens
  chr2:143948617-143948647
  hypo
gtgagccaccgcacccggcccacctatcta

SEQ ID NO: 85240 - DNA, 39 bp, Homo sapiens
  chr2:144022361-144022400
  hypo
aaagtcaagttcaaccggtattaacggaccttggaaaaa

SEQ ID NO: 85241 - DNA, 18 bp, Homo sapiens
  chr2:144081508-144081526
  hypo
caacgggccatgtatcag

SEQ ID NO: 85242 - DNA, 30 bp, Homo sapiens
  chr2:144093577-144093607
  hypo
attttttttgagacacggttctcaccatgt

SEQ ID NO: 85243 - DNA, 96 bp, Homo sapiens
  chr2:144108415-144108511
  hypo
aaaaaaaaaaaaaaaagaaattatatattttgtggtaagatggcctcaaggagcaaataggaaatattcagccaattgtctcggttctctttatgt

SEQ ID NO: 85244 - DNA, 81 bp, Homo sapiens
  chr2:144247835-144247916
  hypo
gggattacaggcatgagccaccacgcccggccggccatgtcaattttcaaagtgtttattctttcacgtaattcaccagta

SEQ ID NO: 85245 - DNA, 36 bp, Homo sapiens
  chr2:144667175-144667211
  hypo
agaggcaataactcagactgccgcagacctgtacag

SEQ ID NO: 85246 - DNA, 224 bp, Homo sapiens; identical to SEQ ID NO: 27545
  chr2:144694291-144694515
  hyper

SEQ ID NO: 85247 - DNA, 704 bp, Homo sapiens; identical to SEQ ID NO: 2056
  chr2:144694553-144695257
  hyper

SEQ ID NO: 85248 - DNA, 67 bp, Homo sapiens; identical to SEQ ID NO: 27547
  chr2:144695258-144695325
  hyper

SEQ ID NO: 85249 - DNA, 32 bp, Homo sapiens
  chr2:14487999-14488031
  hypo
gggcgcagtggctcacgcctgtaatcccaaca

SEQ ID NO: 85250 - DNA, 94 bp, Homo sapiens
  chr2:145174483-145174577
  hypo
gtatttcaaataaaacgtcttaatccagatgatattataatcaataataatggctagaaatgatagcgcatttattatgcgctaacgttgcact

SEQ ID NO: 85251 - DNA, 35 bp, Homo sapiens
  chr2:145204264-145204299
  hypo
atgactcatgggcaccgtaccaaagactaacaatt

SEQ ID NO: 85252 - DNA, 1184 bp, Homo sapiens
  chr2:145273327-145274511
  hyper
acacacgcacacacacgcgtacacacacacaaaacctagagagagagagagagagagagaaaagcatcatttgtctctaatcaaaattctctcgtctttgtgttttgctccttccagcacctcacactgcgcccccagccgccccctccccgcgccgcgcagctctggggcaggccgggggcgcgcacaattgtcttctctagaggaaagttgctccaagtgggcccgggcggtccccgcgaggcgcgggctggggctgcggaggccgggaggccgggtgggcgctgcgtcccagcgcctgcctcgggagcgtctacgcggccccgcgccgggtgatcgggctgagagcgaggggagcgagaagtttcctttccgagtctgggctggcgctcgttcgcttgtttgttttcgggggttggtttctttctttttaaactcagttatcctccgtcagctcccccacccccccccggcaccctcgctagtccccagccctctcccctcccccaggcgccttccgcgctcttgccaatcacttttctcttttattcccacgattttgtttggggtaatacctagggggtctctctctcactctcttcctctctctctgtttctctctgtccccccgcgtcccttctctggctgtctccaaaacggacctaccaaactctcacccccccctttaatatcccacctctgatctgcgtgtgcccctcgaacccccatctcctttctccttcctccttcctgactcagcctggataacgggctcctccagaccatgtagaaactgccgggaaaagtctcgctgcgccctgcgactccttcagtccccggcctgggggcagagcctgctggagaggagtcatccgtccccgagccatcatcgaccccaccggaccccgcgcggggccggccgactccctcccaccccggggtctgggcgcgatgggccgggccccgctgcccgcggaccgttacttggcgcaccgagaagcggccgggcgactccggcaagaaactttaagcctcgctgaggcgcagacccggttcccctctcctgccttcgcagtctctctgccacccccgcccccgccccgggatcctgcgcgatccagcgcctgggcccccgccctgccccaggcggacgctcccgaagcccggccggagacccggcgggc

SEQ ID NO: 85253 - DNA, 399 bp, Homo sapiens; identical to SEQ ID NO: 2060
  chr2:145274576-145274975
  hyper

SEQ ID NO: 85254 - DNA, 915 bp, Homo sapiens
  chr2:145274976-145275891
  hyper
caggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatataattataagcctctttggacactgtcctttaccccaccccccctcgccactttgacaatatttacttaagtatttccccccacctcactcacacacatgctcccccacactggttcccttaaatagttccagtagaattttttttttcccttaagaaaggaaagagaaagtccaaccactacggcaatacttttaagctctactaaatgatcgtatcctttctggcttcgaaacttttgtacctaaaaatcgagagaggcgctgcattttttca

SEQ ID NO: 85255 - DNA, 457 bp, Homo sapiens; identical to SEQ ID NO: 27553
  chr2:145277493-145277950
  hyper

SEQ ID NO: 85256 - DNA, 740 bp, Homo sapiens; identical to SEQ ID NO: 27554
  chr2:145281202-145281942
  hyper

SEQ ID NO: 85257 - DNA, 36 bp, Homo sapiens; identical to SEQ ID NO: 6423
  chr2:145281943-145281979
  hyper

SEQ ID NO: 85258 - DNA, 226 bp, Homo sapiens
  chr2:145282041-145282267
  hyper
gggaggtgatgccgggggctgattaccatgagaaaggctgtgcctggaaaagcctcctccacgcgactgtcaatctcactaaggcttggggggcggggagcggggggggggacggaaaggggccctgtaggagtcaccagaaaacttggagtaagttggatgcgacgcaggcccgaggaggtggctttcgcctcaacttggaaggctggggcgttgagggcgcgga

SEQ ID NO: 85259 - DNA, 26 bp, Homo sapiens
  chr2:145286967-145286993
  hypo
gccactgcacccggccagaaattatt

SEQ ID NO: 85260 - DNA, 188 bp, Homo sapiens
  chr2:145569755-145569943
  hypo
ctccaacacatacaccgtaactgacattaatcacttgtctcagaattatctgaatgcaactttaataattcagtaattgaccacctgaattttttggcataatgtgactgatggcattgtacacaagtctcacacttaagctgtgtctcactgtaaaatgttcacgtgtttgccgagtcttacactat

SEQ ID NO: 85261 - DNA, 36 bp, Homo sapiens
  chr2:146299343-146299379
  hypo
gatgggggatggagacggagtcttactctgttgccc

SEQ ID NO: 85262 - DNA, 33 bp, Homo sapiens
  chr2:14772249-14772282
  hyper
agaagaggagccaaacgtcgcaggagcaatttc

SEQ ID NO: 85263 - DNA, 226 bp, Homo sapiens
  chr2:14772565-14772791
  hyper
ggcgcaagcgggcatcggcacctggcagaaagcgccgcgccccccgcgggtgcgcacacctccgctccccggggcggcgcgcggtcgggtgtgcggggtacggggcggggcggagcggagcagagcaaagcgcacaggaggcccgcctctgctcccctcccccgccggcgaagattgacacagctcgagcacccgccccaaccaatgagcgcgtcctggggcgggc

SEQ ID NO: 85264 - DNA, 30 bp, Homo sapiens; identical to SEQ ID NO: 27055
  chr2:14773043-14773073
  hyper

SEQ ID NO: 85265 - DNA, 135 bp, Homo sapiens
  chr2:14773907-14774042
  hyper
acccctggggaggcacggaggactcggctggaaagggtgactccggtgagggcacgtaagctagccggcaggtcccaggggcactgcacgtcttggggagggacaccgaaaggggcagcccggactctgacggtg

SEQ ID NO: 85266 - DNA, 120 bp, Homo sapiens
  chr2:14774564-14774684
  hyper
ccacctgcaccaaggcgagatccgccaggacagcctgtatgaggcgggcgcggccaacgtgggccgggtggtgaatagctggtaccgctaccgcccgctggtggccgagctggtggtgca

SEQ ID NO: 85267 - DNA, 348 bp, Homo sapiens
  chr2:14774939-14775287
  hyper
agtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccccttgagatgtaaaccgggaacggggaagg

SEQ ID NO: 85268 - DNA, 296 bp, Homo sapiens
  chr2:14775526-14775822
  hyper
cccaagacagcacttcgggattccgggttatcctgaggctgcccgggacttttccagctctccagccccaggtctcctgacattgtgttccaggctgcgggctaagccagacagtgtttgcctccggttctttccaccgtgggaagcgaacgccacccccacccgcctttgcctgcgagtctccctcgctggcagaagggaagccggcccggtcccgggaggaagatggcgctgcgaattcggtgaggacagccggccccgcccccgacaaggagctcgctcgttcacctggtgtc

SEQ ID NO: 85269 - DNA, 84 bp, Homo sapiens
  chr2:148600063-148600147
  hypo
agaaaggaatgtcctcgtgaagactggctgcttctctttagtactacagaaaaataattttcatgctctcgttcttataatggc

SEQ ID NO: 85270 - DNA, 62 bp, Homo sapiens
  chr2:148601287-148601349
  hyper
aatggattcaagttgcgcatcgtgataaatggcgtgaatatcctgagcgggtggacagccct

SEQ ID NO: 85271 - DNA, 160 bp, Homo sapiens
  chr2:148776716-148776876
  hypo
tagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacacc

SEQ ID NO: 85272 - DNA, 113 bp, Homo sapiens
  chr2:148958934-148959047
  hypo
aagcaggggtacccacgaccctgaagccccagagggggatgttacagcatgctaatgacctcttttagtcccattgtctgcagcccgacagacagaggcgccttaacaactct

SEQ ID NO: 85273 - DNA, 267 bp, Homo sapiens
  chr2:149255724-149255991
  hypo
actctgttataagatcgatgatgtggctagtgctccattattctttgacgtttgcacaacagctctgcttcagcaataaggagcaccaaagaattcacacagagaggtgttatcaagattaaagcctgcagaaaattttaacatcatctccggttaaccagctctatttaaaagtgatctaggatcattgatccaggttcttcgtttttgtttgtttggtttttgttttgtttttgagatggagtctctcggctcactgcaacctcc

SEQ ID NO: 85274 - DNA, 86 bp, Homo sapiens
  chr2:149256171-149256257
  hypo
tgggattacaggcgtgagccaccatccccagtcagatccaggttcttcaaatatgtattatacctctctttcgagggttggtttgg

SEQ ID NO: 85275 - DNA, 30 bp, Homo sapiens
  chr2:149309923-149309953
  hypo
agagctgttcattggcggtagctggatttg

SEQ ID NO: 85276 - DNA, 103 bp, Homo sapiens
  chr2:149514585-149514688
  hypo
tacagggaatagggccgtcttagaagaatagaaaaaatgtcaatatgaacttgtggtttttaatattgatatagttagggctgggcgtggtggctcacgcctg

SEQ ID NO: 85277 - DNA, 216 bp, Homo sapiens; identical to SEQ ID NO: 27558
  chr2:149632642-149632858
  hyper

SEQ ID NO: 85278 - DNA, 1253 bp, Homo sapiens
  chr2:149632888-149634141
  hyper
cgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagaggaggctgtgtccacatctgtggggcgagggggctcagagcgcagtagccccctgtgccaagagcagaagttacttcgtgcggctc

SEQ ID NO: 85279 - DNA, 4 bp, Homo sapiens
  chr2:149634142-149634146
  hyper
gacc

SEQ ID NO: 85280 - DNA, 63 bp, Homo sapiens; identical to SEQ ID NO: 27560
  chr2:149645496-149645559
  hyper

SEQ ID NO: 85281 - DNA, 427 bp, Homo sapiens
  chr2:149645560-149645987
  hyper
ggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctgccacttaccttctgtcaccattctgtcgctaacgctaggaatgatgaaacctcctgttctggaaatgcatttccctttagcaccagcgccttctaatgaggtccctctgccccgcaggacaaaagcgcccattagggggc

SEQ ID NO: 85282 - DNA, 137 bp, Homo sapiens
  chr2:150186851-150186988
  hyper
cgggcggtcggctcccgctggccggagtttgcagacttggcgctcaggccgattctcccggagttgggccgcgcgcgccgggccaatgagcgcgccccgcggagggctccgctccccccgcgcgcgctgattggtcc

SEQ ID NO: 85283 - DNA, 30 bp, Homo sapiens
  chr2:150394715-150394745
  hypo
ttcccagctcatgtccgcattcctggactt

SEQ ID NO: 85284 - DNA, 39 bp, Homo sapiens
  chr2:150422336-150422375
  hypo
tggcattacaggtgtgagccatggcgcctggccaagggt

SEQ ID NO: 85285 - DNA, 41 bp, Homo sapiens
  chr2:150706992-150707033
  hypo
gcataggaacagctccggtggtgagcgacgcagaagatggt

SEQ ID NO: 85286 - DNA, 30 bp, Homo sapiens
  chr2:151342707-151342737
  hyper
tctttccctcaacagcggcaattgcacgta

SEQ ID NO: 85287 - DNA, 52 bp, Homo sapiens
  chr2:151343072-151343124
  hyper
tcgcccaacagggaccgtgggaatcccttgggaggggcgcagacggcttgta

SEQ ID NO: 85288 - DNA, 47 bp, Homo sapiens
  chr2:151343590-151343637
  hyper
cctaaaagcttccagcgcactttccctttccccgcagtctaatcagg

SEQ ID NO: 85289 - DNA, 172 bp, Homo sapiens
  chr2:151795349-151795521
  hypo
cccatatagtgtgtgcgtgtatgtgtgcatacacatacacacacacacatacgcatacatacacatagatatatatgaatcaatggttcttatattctctttgtgacagatgaagcgattcagccccgacaccaactcaagtcaaggtacgaataggcgtcaaagtccaagg

SEQ ID NO: 85290 - DNA, 58 bp, Homo sapiens
  chr2:152118660-152118718
  hyper
atagtaggtggtggccgcttcctgtgttgatactggggggctacgcttttcctaacat

SEQ ID NO: 85291 - DNA, 30 bp, Homo sapiens
  chr2:152234018-152234048
  hypo
tttaataaggcctgtcgactcatacctaac

SEQ ID NO: 85292 - DNA, 79 bp, Homo sapiens; identical to SEQ ID NO: 39697
  chr2:152266023-152266102
  hypo

SEQ ID NO: 85293 - DNA, 708 bp, Homo sapiens
  chr2:152954512-152955220
  hyper
aaagacatttctccacgcaccaaagatacaaccagacatatttccagctcttaaattcaacgtccctgacttaagccaggtccccaccgaactgtccacacacatgcacaaactaacttcccggggcggtgcggagacgccgggacgcgaagacgtcaagagcccaggctagagggagagggactgagcccgagcaccggccgaggccgggaagagacgcgcgcgggcttgacccgcagctcccgcacgtgtgggccacggccggctccaggacccccgcgccgcgcgctcggcctcctccccatcctggtctcccgcctccttctcatacctgtctgaggatgaagctggtcgaagtggtgctgccatcggatcttttcaacctgctcctccgggttgtggtgcctcgggccacctggactcgacacacgggggccagagagaagccggtgaggaccgcagcgcagagcggggcgaccacccccggctggagtccgcctccggacccgctccctggggtcccctagagcccgcacccaagtctcctccgcgactcccaaatacagcccccacccccacccacccactgcaagcctcgactgctgaaaagatgctcgagaagagcagcccgcaagcacccaccacatccattaacaaagactctcagggtgcggggtccgagtccccggcatccgctgggggaggctg

SEQ ID NO: 85294 - DNA, 42 bp, Homo sapiens
  chr2:152955741-152955783
  hyper
ggcttctcggaaactcgcctacccgagcggattgggagaagc

SEQ ID NO: 85295 - DNA, 32 bp, Homo sapiens; identical to SEQ ID NO: 27565
  chr2:152956018-152956050
  hyper

SEQ ID NO: 85296 - DNA, 29 bp, Homo sapiens
  chr2:153044296-153044325
  hypo
tgagccaccgtgcccggccggatatgttt

SEQ ID NO: 85297 - DNA, 30 bp, Homo sapiens
  chr2:153192735-153192765
  hyper
ggcggtgagcggaggcgaacttggagggct

SEQ ID NO: 85298 - DNA, 133 bp, Homo sapiens
  chr2:154079386-154079519
  hypo
ctgggccactgagagcgcagggatgcctgggtccagagaggcggctgggaaactgcagctgcgcgcggaagtgagaggctcctcctgccccctgactcggtgaggggggtgtgacttccgcctgttcccggcc

SEQ ID NO: 85299 - DNA, 1142 bp, Homo sapiens
  chr2:154333308-154334450
  hyper
cctagggagcattaacgtcactaacgtcactgtgtaccttagcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccaggggatccacaagttgaatcgcagctctccagggttaattgccctggccgggagccagactcctcaccgccgccccgttcccccctgctggggagcgcagaatgaccaccaggaggccaggaacaaaacgcttaaatgttgcatttattaaggaaatgttaaataagaaaaaaacaaaaagtcaaaacggtgtcacggatgtcaagagcacttttgtggcgtaaaccgtgcagtcacgagctacgagttctattctgggtctttgtcccagggccagcaggaacgctagacgcctcccaaaagacccagtgggaaatgcactaaaagaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggccttc

SEQ ID NO: 85300 - DNA, 354 bp, Homo sapiens
  chr2:154334451-154334805
  hyper
caccgtcggtctccccgcattccaagtaagtagcagcttccaaagttctgcgccctaatcgccctcttcttgccactttctgctgagttcagagtctgggcgctctcctccgactgccaggcatgaggactttcagagggcgagggagaaaccggtcgcttctttccgaaaggccgaagtcgagagaaataattgactccgacaggtttgcttcgcccagtctctgatagtgaggggcacagccgggctagcaaagtgggcaggcgtgggagcggttgccgcgggggcagagggcgggtcagtagggccccacgaccaccgcctccacctccttagacggcctccggtccttca

SEQ ID NO: 85301 - DNA, 479 bp, Homo sapiens
  chr2:154335184-154335663
  hyper
gtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctcttgggaggtggaggaagcaaaggggcgaacctggtcttgctttttattgcttgcttcttttgcaaactccaaaggccaggcagaggtcactgtactcttctagcttgatggatgattaaagagtttgtcgggggagggtgcggtcagctgaaagtttcagaggaactgggacacacgagctctgcgtgtcctttgcctg

SEQ ID NO: 85302 - DNA, 90 bp, Homo sapiens
  chr2:154727902-154727992
  hyper
cctccgtcctttctgcggagggcgccgaagcgtcaagtaccccgcagcatctctcggctggagagccgacggcaagggtggggttgccgg

SEQ ID NO: 85303 - DNA, 197 bp, Homo sapiens
  chr2:154728244-154728441
  hyper
cgcaccgccccagcccggggaggagcgggagcagggagggaggagggctgggggtgctggttacgtaaatgatactagcccagtgagaggcctccaggctggggctacgagaggaggagggaccacgcgaggaggagggaccgggaggcggcgggctggggtgggaggggggcgggggccggggagaagtgaccagg

SEQ ID NO: 85304 - DNA, 20 bp, Homo sapiens
  chr2:154728885-154728905
  hyper
agagtgccggggctaggtgc

SEQ ID NO: 85305 - DNA, 185 bp, Homo sapiens
  chr2:154729082-154729267
  hyper
gcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttc

SEQ ID NO: 85306 - DNA, 540 bp, Homo sapiens
  chr2:154729521-154730061
  hyper
ttccttttgtctctccgttttgcaacatttgttctctttctgtgtctgcttctcgcagcttatctctgtctccctctgtcatctctctgccccgtcttcccgaacaccagccccgcgatcccgaagcgccttggttaggggagcaagccctggcgcatctaatgggtatctccaggtgcagagattttcctgcggggtcagtggggacgcggaggagacagcctgcccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagc

SEQ ID NO: 85307 - DNA, 30 bp, Homo sapiens
  chr2:154870172-154870202
  hypo
gcacccaccgctgtgcggtgggctgcccac

SEQ ID NO: 85308 - DNA, 349 bp, Homo sapiens
  chr2:155555158-155555507
  hyper
ccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcacca

SEQ ID NO: 85309 - DNA, 30 bp, Homo sapiens
  chr2:15579677-15579707
  hypo
gtctacagctcccagcgtgagcgatgcaga

SEQ ID NO: 85310 - DNA, 1825 bp, Homo sapiens
  chr2:157176340-157178165
  hyper
gtagagaagaaggagcgctcccagccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggc

SEQ ID NO: 85311 - DNA, 192 bp, Homo sapiens
  chr2:157178166-157178358
  hyper
aggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctagaagtgctctggtgtcactcccctgtataggacctggcgagatggaattgta

SEQ ID NO: 85312 - DNA, 201 bp, Homo sapiens
  chr2:157178715-157178916
  hyper
aaggtcgttgggtgccgctgtcactgcagggcgccatcggctccctgggccttacatatctctcttgtgagaatcagtaccccaaatactctctctctctctcacacacacacacacacacacatccacccatccacagcggaaggccagcagggcaccgaaagaaattgtggcggtcgcctggaccgcagaaggcagacc

SEQ ID NO: 85313 - DNA, 82 bp, Homo sapiens
  chr2:158454042-158454124
  hyper
gctcggccacctgcccgacggcagcgcaacccccaggagacgttctccgacggcttcccggcgcacccgggtaccatctagt

SEQ ID NO: 85314 - DNA, 73 bp, Homo sapiens
  chr2:1588152-1588225
  hypo
cgcactctgacccaccgcgggcgctgccctgctgagctctcacgggagtcccagcccccgggtctcagccagc

SEQ ID NO: 85315 - DNA, 30 bp, Homo sapiens; identical to SEQ ID NO: 39470
  chr2:15960211-15960241
  hypo

SEQ ID NO: 85316 - DNA, 48 bp, Homo sapiens
  chr2:159744614-159744662
  hypo
tgtttacacactctgcgatattggaggtaacatcgtcctctgacaaac

SEQ ID NO: 85317 - DNA, 226 bp, Homo sapiens
  chr2:159825736-159825962
  hyper
ggaggcggggggaggcgcgcctggcaccgcggggtcctgggcgccccccggagtgttggggtgcgcgggtcgcgaagttgccgagagaacttaagccggaggcatggtattgccccagtctgggctgaaagtctattgctttgcttccaagaacactgcgattagcatatccacactcctttattgggggtgggggtgagttaggattagacgttgggggtttttc

SEQ ID NO: 85318 - DNA, 30 bp, Homo sapiens
  chr2:15991627-15991657
  hypo
tcaagccagagtattcggggtgcccatcac

SEQ ID NO: 85319 - DNA, 30 bp, Homo sapiens
  chr2:159964688-159964718
  hypo
tccagagaaaagtgacgctttaggtccagc

SEQ ID NO: 85320 - DNA, 33 bp, Homo sapiens
  chr2:160141926-160141959
  hypo
aaaaaaaagtctgggcgcgatggtgcacacctg

SEQ ID NO: 85321 - DNA, 264 bp, Homo sapiens
  chr2:160760635-160760899
  hyper
gtggggaatccttggcgctgtgggtggaggctcctcttggccctgtggccaaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctc

SEQ ID NO: 85322 - DNA, 413 bp, Homo sapiens
  chr2:160760959-160761372
  hyper
cggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgcccgcacctctgtctaggcctctgggggcgccccggccccgcccccgccgccctcggccaatcagacgtgcgtctcctcggccccggggcggagcgggc

SEQ ID NO: 85323 - DNA, 114 bp, Homo sapiens
  chr2:16080876-16080990
  hyper
ggcttgcaaaccgcccggcgcccagggaagcgacgagcgccggggcaaggcaagccctggacgggattgcgacgtgcgcaccgggcgccctaatatgcccgggggactgtttct

SEQ ID NO: 85324 - DNA, 105 bp, Homo sapiens
  chr2:16081299-16081404
  hyper
gagaggcggctctcccggcgaccctcctcgcgcgggcgcccctgccattcccgggaacaggggctcagcctctccctccctggaagaggacgttgtcgtgggttt

SEQ ID NO: 85325 - DNA, 1355 bp, Homo sapiens
  chr2:16081656-16083011
  hyper
tcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctgg

SEQ ID NO: 85326 - DNA, 487 bp, Homo sapiens
  chr2:160918575-160919062
  hyper
gagccaggagggtgccgggccgcgcaagtggggtgctgggcctagacaagaggctgcaggacaccacccgctccccccatgctcaggactgctgacacacgaacccctacaaacgcggccgcccttgcccgccagcttggcccctagcttcgccccttcttcctctccttcgaccaccccgacccccctccccaacgtaccgatccagtccccgaccctgggagactcaccctgccactccaggagccgctcgggggtaagcgccgccgccacaccctcggcgcagccccgcggcgcccccagcagcagcagcagcagcagcgacggcgacagcagcatcgctaaccactgggctctccgggagccccttgtcccgggagccccttatcccgggagcccagagccgcgtcccaagcacccggccccgccgcgcggaagcggatccgtagcctcctccgcgccccaccccctccgggggccttgccag

SEQ ID NO: 85327 - DNA, 83 bp, Homo sapiens
  chr2:160919402-160919485
  hyper
gattctggtaaacaccgcggatttgcagcgggcagcctagagtgaacccagctgctccgcgacgcaggcgctttgggagggtc

SEQ ID NO: 85328 - DNA, 151 bp, Homo sapiens
  chr2:161253372-161253523
  hypo
cgtagggaatgtctacctgcgcatgcacgtggcactctctgaccgaggtccggggactttcccctaggcggaaggatcttatcagaatctccatgccccaccctataccaaaagctcattgtctttcttgatttcacgtttccttagcctt

SEQ ID NO: 85329 - DNA, 174 bp, Homo sapiens
  chr2:161264166-161264340
  hyper
ctcgccgcgcggcggcggccggcgggggctgcagctccgcgctgacttcccctccgccttcgacctccgcactcgcctaaaagtacggcgcggcagcgggcgagactcgagcagctcgggcagccgccgccctgcgtgccatggacgggagttcgcgcgcggagctggcggcgt

SEQ ID NO: 85330 - DNA, 217 bp, Homo sapiens
  chr2:161264622-161264839
  hyper
ttgggtctggctccccgcatgccgcacattcctcggagtagccaacccccctcctctgttctttttccccctcggttctttcctaagcaccagcggcagctttgcaccccggctcgaagccccttttaaggtcgtcgcttcggggaccactctggcacctcggtcttccctctcttcttcacctttcgaactaggccccccgcgccactcttcaaga

SEQ ID NO: 85331 - DNA, 30 bp, Homo sapiens
  chr2:161349208-161349238
  hyper
ggtgaagtgccacaccgcacaaagatcaga

SEQ ID NO: 85332 - DNA, 51 bp, Homo sapiens
  chr2:161350175-161350226
  hyper
ggagcccgactgctccggggctgccaagggctggcgcgctggccgcggtcc

SEQ ID NO: 85333 - DNA, 45 bp, Homo sapiens
  chr2:161560571-161560616
  hyper
gggaaactccgccttcgcaagagcttgagtcgtctccgtgacctc

SEQ ID NO: 85334 - DNA, 85 bp, Homo sapiens
  chr2:161987588-161987673
  hypo
ctaaaaaaaaaaaaaaaaaaagaaagaaattgaaagtggtagagaatgcatctgaatttttttccacctccgttaaaatttcatg

SEQ ID NO: 85335 - DNA, 30 bp, Homo sapiens; identical to SEQ ID NO: 39698
  chr2:162087925-162087955
  hypo

SEQ ID NO: 85336 - DNA, 66 bp, Homo sapiens
  chr2:162094291-162094357
  hyper
ctcagccccgggttgcgtggttattttaccaacacggggggagggagagctcgaggaggtagaaaa

SEQ ID NO: 85337 - DNA, 245 bp, Homo sapiens
  chr2:162094615-162094860
  hyper
cccgggctgctgcctcgacagctgcttgtagctacagtaattagactgtcagtgcttgttagaggagagaggggaaaacacgcttctgacagcagattccaagactccccagtttgttaatttctaagagatctttaaagcattaattgaggtctccccaactctcccctcccgtccctctctgcaactcctcccttcccaaaaatatctttaggagaagcgagttctctcggcgtggaagcagt

SEQ ID NO: 85338 - DNA, 81 bp, Homo sapiens
  chr2:162095165-162095246
  hyper
gggcaactaattatccgtctcatttgagaagagcagcatttgaggcagcagcgttcgcctgctgaacggtgacagattggc

SEQ ID NO: 85339 - DNA, 186 bp, Homo sapiens
  chr2:162095461-162095647
  hyper
ccttcccgccgctggcgagtggaacccagccaccgccaccgagtccctagcgggccaggagcccccgcgcggcccccagcgccggcccggtggagtgcagccccgcgcgggctcgcccgagggctcggcctgcgccgcgcgcccactccccggggcggtggggcgaggacccgcgctccgggatcc

SEQ ID NO: 85340 - DNA, 30 bp, Homo sapiens
  chr2:16210239-16210269
  hypo
actgacttctgaaagcgggattgtccctcc

SEQ ID NO: 85341 - DNA, 40 bp, Homo sapiens; identical to SEQ ID NO: 39699
  chr2:162166372-162166412
  hypo

SEQ ID NO: 85342 - DNA, 55 bp, Homo sapiens
  chr2:162271455-162271510
  hyper
ccctctggctcaggccgagggctgggctcctctgtagagccggtgctgggagact

SEQ ID NO: 85343 - DNA, 32 bp, Homo sapiens
  chr2:162272302-162272334
  hyper
aagaggccaccggctcgcgctttgtatacttt

SEQ ID NO: 85344 - DNA, 231 bp, Homo sapiens
  chr2:162273084-162273315
  hyper
ttaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggac

SEQ ID NO: 85345 - DNA, 697 bp, Homo sapiens
  chr2:162273382-162274079
  hyper
cggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctgggcagtgataactgccaccttcccactccagctcacccgccgctctccctgatttgggttgcacttcttttcttctcccaccaccctttttctaatccagcaaatattcgcctatttgctgca

SEQ ID NO: 85346 - DNA, 138 bp, Homo sapiens
  chr2:162274300-162274438
  hyper
caaatgggttccttgcggcaaagcggacaccaatgtgcaaggcaagtccttccaattaacacattttcttgacacttatttaggtgagaatgattaattaaagcctttgtggactggctcgagcgacttttaaaacga

SEQ ID NO: 85347 - DNA, 395 bp, Homo sapiens; identical to SEQ ID NO: 27585
  chr2:162274832-162275227
  hyper

SEQ ID NO: 85348 - DNA, 128 bp, Homo sapiens; identical to SEQ ID NO: 207
  chr2:162275310-162275438
  hyper

SEQ ID NO: 85349 - DNA, 330 bp, Homo sapiens; identical to SEQ ID NO: 27587
  chr2:162275472-162275802
  hyper

SEQ ID NO: 85350 - DNA, 68 bp, Homo sapiens
  chr2:162279820-162279888
  hyper
accccaagggacctccgcgccacccctcggctctctctctctctctccctaccccgcaggatctacac

SEQ ID NO: 85351 - DNA, 264 bp, Homo sapiens; identical to SEQ ID NO: 209
  chr2:162280152-162280416
  hyper

SEQ ID NO: 85352 - DNA, 301 bp, Homo sapiens; identical to SEQ ID NO: 27590
  chr2:162280740-162281041
  hyper

SEQ ID NO: 85353 - DNA, 30 bp, Homo sapiens
  chr2:162282190-162282220
  hyper
aattcagggtctaaacgtgtgtatattttg

SEQ ID NO: 85354 - DNA, 30 bp, Homo sapiens; identical to SEQ ID NO: 27591
  chr2:162282450-162282480
  hyper

SEQ ID NO: 85355 - DNA, 238 bp, Homo sapiens; identical to SEQ ID NO: 211
  chr2:162283365-162283603
  hyper

SEQ ID NO: 85356 - DNA, 321 bp, Homo sapiens; identical to SEQ ID NO: 27593
  chr2:162283782-162284103
  hyper

SEQ ID NO: 85357 - DNA, 183 bp, Homo sapiens; identical to SEQ ID NO: 27594
  chr2:162284325-162284508
  hyper

SEQ ID NO: 85358 - DNA, 32 bp, Homo sapiens
  chr2:162311722-162311754
  hypo
gagccaccgtgcccggccgagattgttccttt

SEQ ID NO: 85359 - DNA, 48 bp, Homo sapiens
  chr2:162930196-162930244
  hyper
ttcagagcacattagcgttggtttctctacccctgcccgggttcgggc

SEQ ID NO: 85360 - DNA, 40 bp, Homo sapiens; identical to SEQ ID NO: 27596
  chr2:162930245-162930285
  hyper

SEQ ID NO: 85361 - DNA, 321 bp, Homo sapiens
  chr2:162930338-162930659
  hyper
cgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtcactcgccgctggcaagtttcggccccgagttaaacattagtgagcgccgagcccgctgggta

SEQ ID NO: 85362 - DNA, 49 bp, Homo sapiens
  chr2:162930921-162930970
  hyper
gctcctccaacctcacgtggacaggcgagggaaccgagacccagagagg

SEQ ID NO: 85363 - DNA, 222 bp, Homo sapiens
  chr2:1635805-1636027
  hypo
ccactcctgttacagcgatcccgcacagtggctgctagacacgttcacccaggcactgcccactgttctgattacagagagtatcaaactggtgattccgcagacattttggtttgaattacagaattttttttggtaaatcacagtcagcttccccctttggcttagacaacacaattccttgtgactggcccagaccgcacattacgcaggtgtgctaca

SEQ ID NO: 85364 - DNA, 318 bp, Homo sapiens
  chr2:163694871-163695189
  hyper
tccccaccttggaagcggtggacgccaagtgcactaacaaggcagaaagcgagggcgagagaagagaacaaacgaacttactttgcccttcaaatttccgaatgatggtccccagaaatgtattttgtggtgccacatgccccctgcgcacaggcatgttggccccggtcttccgaggagcgctcccccggagctctggagttctcccgggatctctcctcggctagagcccaggccagcgcgcgagccgctctttgtggcagagcatcctcttttgaaaccagaattctcttcccattagcaccacttctagacacc

SEQ ID NO: 85365 - DNA, 314 bp, Homo sapiens
  chr2:163695246-163695560
  hyper
cggactgccgcgggtgagagggtttgggggtggggaacgggaaggaggcggggtgaggggaggtggcgggggagggaaagagggagggagctgtgggggtggggtgggaagggggcggggagtcacaagggcaatcgatctgtttctcttctcccaaacagcgccaatttcccagtgcaaatgggcttaacctggcggttgcccagagcagtaaggaatggctgaggggggatggaagacttgtgccggttttgctggaaggagagagagaaaaggaggctgggggtcggcggggttgacgtttctatccccgc

SEQ ID NO: 85366 - DNA, 30 bp, Homo sapiens; identical to SEQ ID NO: 39397
  chr2:1637034-1637064
  hypo

SEQ ID NO: 85367 - DNA, 224 bp, Homo sapiens
  chr2:164591881-164592105
  hyper
tcgttcccccagccacgagattgtaatttaacctcaactttttgtgtgtgtgcaagattcttatttacacttcttatttacttagaagttagttcccgaagaaagtctagccccaccctatggctccgctttcttatttttttatttttgaagtaaaaagatagtaataagtaagcccaatatagcgaaaagcgagattcttgcaatcgcgaactcttaatccc

SEQ ID NO: 85368 - DNA, 592 bp, Homo sapiens
  chr2:164592629-164593221
  hyper
agagggagaaagagacggaggctgccgtgagggagagaagacgggaggcagtggcgagaggcgggcagtggagagagacgggcagcgggaggaccaggagggagagggagaggcgcacggagcccgcggagctggagggggagaaagggaggcgggaggcgagccggcgagcgagctagagacgcgccagagattcatgggcagggagggctcaatggccgcgccgcgccggccggccggccgctcgggtcatgttacacggccggggccgcggcggccgcccagcctcgccgatgcgctcacgcggcccggagggggccccgaggtcatgattacgcgcgcggggactcgcagctctccctgcacgcactctctggcggcccagcctggggaaaggggagcagcgccgtagggggaagggggctttctttcccacgcgtgaccagccggcccctgcgctccccggcctgcgttggagggcccgggacagagccgcgctgctccccggcccgcgggctcttccctgccggttcccggccctctcgacagctgcggcccgtccgcccttccccaccccctctgcgcacgggac

SEQ ID NO: 85369 - DNA, 190 bp, Homo sapiens
  chr2:164593222-164593412
  hyper
ggatctggtctcgagagcctggacctcaccggcaccctccccggggcccccagcaccagccagaaaacgacttgatctgcttagaagaggcaacttcggggagaaaattcgcgttcgcccagttcccctcccccgcctccctgtgaataaataaaatcctaagtgtctaggtgtgcggtcccctctcgcg

SEQ ID NO: 85370 - DNA, 79 bp, Homo sapiens
  chr2:1653102-1653181
  hypo
tgtgggtgaactgctcgtcgggtgtgacggtctccgtcccgatcagggtggtggacaccaggcgcggcatgggaagggc

SEQ ID NO: 85371 - DNA, 33 bp, Homo sapiens
  chr2:165477563-165477596
  hyper
gcctcctcaccccctcgccggctgcccagccag

SEQ ID NO: 85372 - DNA, 185 bp, Homo sapiens
  chr2:165478170-165478355
  hyper
ccgtcccatccgggacgcgaggccgggaccgctgcctcctcaggtgggcaccggggcgcgaggctgagcccagggtctgggcggccccggcgccgctggaggcggggacccagccgagcgggcgctcccgctgggcttgccgggaggaccgcaggcgggataggggtccgcgcagccctgaccct

SEQ ID NO: 85373 - DNA, 38 bp, Homo sapiens
  chr2:166650068-166650106
  hyper
caaagccatgtctttcgctgtcgcgggatgtcctctcg

SEQ ID NO: 85374 - DNA, 27 bp, Homo sapiens
  chr2:166650454-166650481
  hyper
cggccgtcctcccgcctgctctaacgc

SEQ ID NO: 85375 - DNA, 77 bp, Homo sapiens
  chr2:16689362-16689439
  hyper
ccgcgaggcctggcacgaaggagggctcacagtccggctcccagagccctgcaagtcgggcgcgctcagcccacctg

SEQ ID NO: 85376 - DNA, 114 bp, Homo sapiens
  chr2:16705700-16705814
  hypo
ctttcttacattctgcgctagcatatgtatttatttcgttatctatctcttcgtctagaccggcaatcaacaaactattagtgcaataaactgcttagtcgagaccaaattgtc

SEQ ID NO: 85377 - DNA, 30 bp, Homo sapiens
  chr2:167232024-167232054
  hyper
attgctggaaccacccggtcaagcttctcc

SEQ ID NO: 85378 - DNA, 80 bp, Homo sapiens
  chr2:167232373-167232453
  hyper
tagcccagcctcagccgagctggcggaattggaaagccgacagccgccgctggagcgctggcgaccgcctgcaagcagac

SEQ ID NO: 85379 - DNA, 30 bp, Homo sapiens
  chr2:167232714-167232744
  hyper
acccattgggtggggcgtgtgtgtgtttga

SEQ ID NO: 85380 - DNA, 31 bp, Homo sapiens; identical to SEQ ID NO: 6456
  chr2:167233063-167233094
  hyper

SEQ ID NO: 85381 - DNA, 293 bp, Homo sapiens
  chr2:168148971-168149264
  hyper
ctatgaggagtggttcgaagcctaagaagtagtactcttttcagctgccaaagggagaaggacgggggcgctgtctggtgactgttcgcgtgattccttcaaggcggcgaccacctcctgggattcgctctccagccgcgccgttcgtactcgggtcccgcgacccctccccgctcccccctcgccccagcgatgccaagacgctgaaccgcagggacgaggctctggggacaaagtcaccccgcggcgccctttcctgccaagccgcgggctcctggcggtcagaaagcgcc

SEQ ID NO: 85382 - DNA, 53 bp, Homo sapiens; identical to SEQ ID NO: 27606
  chr2:168149503-168149556
  hyper

SEQ ID NO: 85383 - DNA, 215 bp, Homo sapiens; identical to SEQ ID NO: 27607
  chr2:168149776-168149991
  hyper

SEQ ID NO: 85384 - DNA, 970 bp, Homo sapiens
  chr2:168149992-168150962
  hyper
cgcccgtgcggctccagctggtgcgttctcccttccgcgctcacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaaagtccaccgtggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggcccgctggggtctggtccatcagacctaggacacgttaaccacgcagagtaaccaggttagggtacccagctgcctccagagcgtttttgtttcatattagattatcttatttgataaagctgttgagagttccacccgtgctgcaaagccttccgcagaaggcgaatt

SEQ ID NO: 85385 - DNA, 35 bp, Homo sapiens
  chr2:168310888-168310923
  hypo
ttctcattttcctttcgctccgttacctgctggcc

SEQ ID NO: 85386 - DNA, 39 bp, Homo sapiens
  chr2:1689084-1689123
  hypo
gaagacaaggaaaaccgccgtgggcgagcatgacgggcg

SEQ ID NO: 85387 - DNA, 33 bp, Homo sapiens
  chr2:169103498-169103531
  hypo
agtgcgagtcacatccgccgcgccgcctcctgc

SEQ ID NO: 85388 - DNA, 63 bp, Homo sapiens
  chr2:169312818-169312881
  hyper
aggaggcggcggcggcgggcgggagcagcggcggcggcggcacaggctcggggccagccgggc

SEQ ID NO: 85389 - DNA, 30 bp, Homo sapiens
  chr2:169948461-169948491
  hypo
aagtgagtttccgggcggtgccaatgtcct

SEQ ID NO: 85390 - DNA, 502 bp, Homo sapiens
  chr2:170218359-170218861
  hyper
aggagtgctctggcccgcggccctgggcgcgcgaagggatcccgggaggggcgctgcaggtggaaagctgcgctctgagcagagcccgggaccgcgccgcccagcagagaactccgctagggagggcaggctgcaaacggcggagaacctcgttctcccgcaaagtgctttccaggagcatcggaccaacgcccgtgggaacaaagacagggtctccgtggggtgcgctgtcaccgaaactggcggggctgctttctcaagtttgctgccgctcagttcctggcgagcgaagaggggcgctcccgctccggcttcgcgaagcaacctgagcgccccaccgggagcagctcccgcgccgccgcccggccctagcccctgcccggacgctctcccctccggcctcccgcggacccgaccctgccacagccggggaagtgggggctccacgagaggctctggctgggctcttaccttggccactggccggcgctaggcaggcgac

SEQ ID NO: 85391 - DNA, 429 bp, Homo sapiens
  chr2:170219129-170219558
  hyper
cccggaacaagcatgcgggaatccagcgggcaggccccctgccgcccggcccgccccctgcactttgcagcgcggggaggagtgggcactcgaacacacgcgtgctcacacagggacactcacacaggcgtgtgcacactcacacacgcactcatacaggcgcatgcactcctaagtgtcacaccaactgacacagattcactcatacacgccagtcacacacgcgcgcacattccacagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcacggacgcagttttactaaa

SEQ ID NO: 85392 - DNA, 648 bp, Homo sapiens
  chr2:170219911-170220559
  hyper
gtgtcatggccagatcgtgcttcttacaagtctgctcattttgaagcaaaattgaaaaagagcgaacgtcttctccatggttccggtacccttttataagaaggagaaacacgagaggttcagggaacccctagcctcccttctttggggccgctttggacaggctggcaaggggcccggaagccaaaagcacaagtggccttacacccgccctcagcgcacgtcctcagcctgtacgtgacatcagagcccacagggaggggtaaaaaaggagggttgatgcaagttatttcccggtggtgggaaccctgtgtgagaaggggctgtttgcgggcctgaggccatcccatcatctccagctccagcccctgaaccagcgcggcagctagtcccaggctccggatcctggtccaagaagtcaggagccctttccctccagcgaaggggccgtgacgcatggaggagacagccctgaacgcacgtggtcgctggacaggttcccgctgcctcccttccccaggggcgagaacctgccaattactgccagcccctttccccggggcacaggtcgtccggggctctgctgaccccaacagtccggatcgcgtagcttccgtgggctgcagtggtaggcgcagctttaggtgt

SEQ ID NO: 85393 - DNA, 105 bp, Homo sapiens; identical to SEQ ID NO: 39700
  chr2:170282975-170283080
  hypo

SEQ ID NO: 85394 - DNA, 34 bp, Homo sapiens; identical to SEQ ID NO: 27613
  chr2:170335909-170335943
  hyper

SEQ ID NO: 85395 - DNA, 300 bp, Homo sapiens
  chr2:170336157-170336457
  hyper
tgtagagggcgccgccgtgcgcgttagggacccgcgggcggagactgcacctccgcagctcgcggccctggtgagggtgggaggcttgcgccggtcgtccgcgcctcgagagacctcaggctggttgggccactgtggccctctcgaggccggcgccgcggcaagagcgcatcggcattacacagttttggtcccatgcgacctccggttcccccatcctggcccgcgggacggatcaggaatgtgaacctgagcacgaccggggccacccggggcttagcgtcccgtatacacccacgt

SEQ ID NO: 85396 - DNA, 134 bp, Homo sapiens
  chr2:170419323-170419457
  hypo
aacccattatgggaacgagagctcagggaatcaacacaagaaaattctggtactctgctactgctattgctataaaaaacaaagtcctctctctgacctcggagtctcaggccttcctacggcacacgtaggaa

SEQ ID NO: 85397 - DNA, 164 bp, Homo sapiens; identical to SEQ ID NO: 39701
  chr2:170551729-170551893
  hypo

SEQ ID NO: 85398 - DNA, 30 bp, Homo sapiens
  chr2:170571327-170571357
  hypo
aatctgcaagataatcggaggttaatatga

SEQ ID NO: 85399 - DNA, 30 bp, Homo sapiens; identical to SEQ ID NO: 39702
  chr2:170584782-170584812
  hypo

SEQ ID NO: 85400 - DNA, 197 bp, Homo sapiens
  chr2:170681712-170681909
  hypo
ttgtttcccaagtctcggctcaaaaagtagcgatctccattcacctttacctccttctccattctcatgccttattttattgtaactttgtttcccaatttttaggtcatttgtgtcacttgcaattctcacaggagtggtgatgtcaaagaaacccaaagaagagatagtggagaggcagggcgcggcggctcacg

SEQ ID NO: 85401 - DNA, 180 bp, Homo sapiens
  chr2:170682149-170682329
  hypo
gacagagcgagactccgtctcaaaaaaaaaaagacagtggaaatgaaaataaaagaataggtagtggtgtcaaatactggaaagaggtcgggcttcataaagtaggagcagaaattaagttgtagcagattgtggagcgaatggaaatttaggaagaagaaagagtaaatgtgaacaatt

SEQ ID NO: 85402 - DNA, 30 bp, Homo sapiens
  chr2:170807951-170807981
  hypo
tggacttcctgacctcgaggaattgatact

SEQ ID NO: 85403 - DNA, 84 bp, Homo sapiens
  chr2:170860076-170860160
  hypo
gtttactatgtattacgtaagagagacaagcaaacagttacagtacgcatgctaaatgttaggtatacacagagtctttttttt

SEQ ID NO: 85404 - DNA, 30 bp, Homo sapiens
  chr2:17090745-17090775
  hypo
tgacagagcgagactcggtgacaagttgcc

SEQ ID NO: 85405 - DNA, 30 bp, Homo sapiens
  chr2:1709360-1709390
  hypo
gcagggtgcagggtgcggctccccacgacc

SEQ ID NO: 85406 - DNA, 69 bp, Homo sapiens
  chr2:17097513-17097582
  hypo
tatacctataatacacgtatcctaatagaaccctgactaatacagctacattagcgctgcattgtatta

SEQ ID NO: 85407 - DNA, 380 bp, Homo sapiens
  chr2:171568331-171568711
  hyper
ctggtccgtcccctgcgcaagtgtcactgcgggttcacctaccggcctcttcctctcgcaggtggcatgcagtcggcgctcgccgcccgcccgcaaagaaacggcaatgcaaacttcccagcctgggaaccccgctgcttggagagcagctccgctgtgccagccgccgccaggagactggtattcaacctccccgccccccgccacggttaaagtttgctccacattcgcagctcccaccccacccccatctccgccccgaggcaggaggaccacataggagttcctgggtccaccgtgcgcaaacacacccaccaacaaaagaaagcccattaaatcttccctcctgtgaactcgcgccccaacggatacctctttga

SEQ ID NO: 85408 - DNA, 30 bp, Homo sapiens
  chr2:171569116-171569146
  hyper
acgggttttcacaaacggagatgaggccga

SEQ ID NO: 85409 - DNA, 30 bp, Homo sapiens
  chr2:171569757-171569787
  hyper
gactcaaatcctggacgggagcgtgggaag

SEQ ID NO: 85410 - DNA, 15 bp, Homo sapiens
  chr2:171570047-171570062
  hyper
gggagaaggtgggcc

SEQ ID NO: 85411 - DNA, 9 bp, Homo sapiens
  chr2:171570181-171570190
  hyper
cgtccgtcc

SEQ ID NO: 85412 - DNA, 487 bp, Homo sapiens; identical to SEQ ID NO: 27617
  chr2:171570470-171570957
  hyper

SEQ ID NO: 85413 - DNA, 44 bp, Homo sapiens; identical to SEQ ID NO: 27618
  chr2:171571200-171571244
  hyper

SEQ ID NO: 85414 - DNA, 44 bp, Homo sapiens
  chr2:171571476-171571520
  hyper
gtatgttggggggggcgggaagagtgtctcgagcaacccaagcg

SEQ ID NO: 85415 - DNA, 61 bp, Homo sapiens; identical to SEQ ID NO: 27619
  chr2:171571846-171571907
  hyper

SEQ ID NO: 85416 - DNA, 374 bp, Homo sapiens
  chr2:171572347-171572721
  hyper
cgggccagggaggagcgcgaaggcagtgaggacaagagagcttaaaagatgggagggagagcggccggccggcggggttgtgggtgtttcccgactcttactgaccacggagccgggaggggcccgtcggatgcctccccctcccacttcgcgcctgcttcctctaaggctggatggcgtctcagtgcaccaagtagtttagcaagaagcgctcgcgggccccacgttcaggtagcgcaggcaccaaaagtttccctcggccggtgggtgcgtgcgtggggtgcggtggcgggggagggacggccgggacggaggaggggcggcggtataatagcgggcgtgggggcggcgggctggcccggagtccgcgcttg

SEQ ID NO: 85417 - DNA, 31 bp, Homo sapiens
  chr2:171624030-171624061
  hypo
cgtgagccaccgcgtccggccctcaacaaat

SEQ ID NO: 85418 - DNA, 601 bp, Homo sapiens; identical to SEQ ID NO: 27621
  chr2:171669846-171670447
  hyper

SEQ ID NO: 85419 - DNA, 270 bp, Homo sapiens; identical to SEQ ID NO: 27622
  chr2:171670471-171670741
  hyper

SEQ ID NO: 85420 - DNA, 484 bp, Homo sapiens; identical to SEQ ID NO: 27623
  chr2:171671306-171671790
  hyper

SEQ ID NO: 85421 - DNA, 179 bp, Homo sapiens
  chr2:171671799-171671978
  hyper
cgccgtttaggatgttttttgtgtccttaaaaagtgccggggatttcatcgtcaggtggagacaaggcgacaaaacagtagtttctttagtaccaaaggcaacgcgattatttcaaaccccacagcgagatccctcttgctgatcaggccatgtctgcccagggcggacccttcgatct

SEQ ID NO: 85422 - DNA, 238 bp, Homo sapiens
  chr2:171674091-171674329
  hyper
ctgtcccggggccttcgggcgccatcgcgccagcgccgagagtcgagcaggggcgccgcgcaagatctttgtccgccgcctcctgcgcgctgcgcgcaagttcgtttccccggtgacgttccccatgcttacttaccccaccctctctggatctgtaccgcgagaaatctggggtcctcagggggctaggtagaggagaaacgctgaaaccggaccgaaacctcgccctaggcttagc

SEQ ID NO: 85423 - DNA, 685 bp, Homo sapiens
  chr2:171674698-171675383
  hyper
tcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaagtaggtcccgccccaattttctatcaaatgaactgcagggaagatgggggcgctgggacgtcgggaggctgagctggcggaaagggaagggggagcgcggagataatggaggctgggaaataaatggggctctgaccccgtccctgccagaggtcattcggctgtcagggacgctaggtgactcccagggcaccggaaag

SEQ ID NO: 85424 - DNA, 143 bp, Homo sapiens; identical to SEQ ID NO: 27628
  chr2:171675522-171675665
  hyper

SEQ ID NO: 85425 - DNA, 103 bp, Homo sapiens
  chr2:171676684-171676787
  hyper
ggggtggggggttagcgggcagttgtgttaatttgccctccactcccggcgcccttacggaattcccggtggccgccagtcgccggcgcaaatgccaagtcac

SEQ ID NO: 85426 - DNA, 30 bp, Homo sapiens
  chr2:171677372-171677402
  hyper
ttcataggactgttacgagaattagatgag

SEQ ID NO: 85427 - DNA, 234 bp, Homo sapiens; identical to SEQ ID NO: 27629
  chr2:171677989-171678223
  hyper

SEQ ID NO: 85428 - DNA, 95 bp, Homo sapiens
  chr2:171678293-171678388
  hyper
cgaccccacctccggagctgccgggcgggggtcgcttacgggcccggaggggcgccgggtgccccgcctctcagagacaccgttccatatttgaa

SEQ ID NO: 85429 - DNA, 57 bp, Homo sapiens; identical to SEQ ID NO: 27631
  chr2:171678980-171679037
  hyper

SEQ ID NO: 85430 - DNA, 15 bp, Homo sapiens
  chr2:171680071-171680086
  hyper
cgtggggcaaggcca

SEQ ID NO: 85431 - DNA, 21 bp, Homo sapiens
  chr2:171718764-171718785
  hypo
ccactgcgcccagcccatttt

SEQ ID NO: 85432 - DNA, 23 bp, Homo sapiens
  chr2:171769313-171769336
  hypo
catctaatcgctttggtaacttc

SEQ ID NO: 85433 - DNA, 58 bp, Homo sapiens
  chr2:171822509-171822567
  hypo
tcactgtggatgtgacgccccccactgccaaggcccccaccaccgttgaggacagagt

SEQ ID NO: 85434 - DNA, 120 bp, Homo sapiens
  chr2:171906270-171906390
  hypo
taatgaaaacccaaacgaatactaaaaacttttaaatgttaagaatgactaacttcacaagattctgaaatgcaaaaccatctgtccattgttcagtaaatgaagcgccatgtctaactg

SEQ ID NO: 85435 - DNA, 35 bp, Homo sapiens
  chr2:172129409-172129444
  hypo
attacaggcgtgagccaccgcgcctagatggggca

SEQ ID NO: 85436 - DNA, 74 bp, Homo sapiens; identical to SEQ ID NO: 14471
  chr2:172367021-172367095
  hypo

SEQ ID NO: 85437 - DNA, 28 bp, Homo sapiens
  chr2:172372678-172372706
  hypo
ttttttttttttaggcggagtttcactc

SEQ ID NO: 85438 - DNA, 146 bp, Homo sapiens
  chr2:172378945-172379091
  hyper
acagccccaagaagtcgacgccccggtcccgccgcccggccactacccagagggctgccgccgcctctccaagttcttgtggcccccgcggtgcggagtatggggcgctgatggccatggagggctactggcgcttcctggcgctg

SEQ ID NO: 85439 - DNA, 191 bp, Homo sapiens
  chr2:172379532-172379723
  hyper
ttggttaactctttgcggcgactggctaggacgcactggaggggcctccaagacccagaaacttgagcccgggcgcgatgccggagcgccgcgcagtcgggccgctgcagcccacgcgccccggaaagtcgcccctgtggaccgagcctgcgcgatcgggggcgcggaaacactttcgcctcagccttttg

SEQ ID NO: 85440 - DNA, 44 bp, Homo sapiens
  chr2:172382315-172382359
  hypo
aagtaggctctgggccggcacagtccagctacttgggaggctga

SEQ ID NO: 85441 - DNA, 30 bp, Homo sapiens
  chr2:172396680-172396710
  hypo
ctgtatccttccccacgaaggcaactacta

SEQ ID NO: 85442 - DNA, 41 bp, Homo sapiens; identical to SEQ ID NO: 39709
  chr2:172411125-172411166
  hypo

SEQ ID NO: 85443 - DNA, 30 bp, Homo sapiens
  chr2:172428262-172428292
  hypo
aaaaaaaaagggaaacggactctcggcaga

SEQ ID NO: 85444 - DNA, 43 bp, Homo sapiens; identical to SEQ ID NO: 27633
  chr2:172945124-172945167
  hyper

SEQ ID NO: 85445 - DNA, 387 bp, Homo sapiens
  chr2:172945896-172946283
  hyper
cccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctt

SEQ ID NO: 85446 - DNA, 30 bp, Homo sapiens; identical to SEQ ID NO: 27635
  chr2:172946606-172946636
  hyper

SEQ ID NO: 85447 - DNA, 30 bp, Homo sapiens
  chr2:172947265-172947295
  hyper
aaaatacctcgtccacgccttcctgtccct

SEQ ID NO: 85448 - DNA, 141 bp, Homo sapiens; identical to SEQ ID NO: 6475
  chr2:172947773-172947914
  hyper

SEQ ID NO: 85449 - DNA, 310 bp, Homo sapiens; identical to SEQ ID NO: 27637
  chr2:172948183-172948493
  hyper

SEQ ID NO: 85450 - DNA, 393 bp, Homo sapiens
  chr2:172948890-172949283
  hyper
taatttgggattcaccgtggggctggcgggatggggaaccaacatccacttacagccagggtggtgtacgccacaccgcgagggactggctgtattggtagtagtggcgatggggtgggggctcttgtgcacttttttgtacctagcaccccagaagacagaaggagcagcggcagatcttgcctccactagccctgccccctaggcctggtggcgcgcgctttggccactggaggtgaggaagatcctgggtggcaacgagagacgtctacacatagataagggagcctaccacaggcctgggtttgctgcgggtttcggtgtcccccagggactcctaaactctggaagtcgcgctagacctcaggaggccggaaaatgaccacctggcgt

SEQ ID NO: 85451 - DNA, 885 bp, Homo sapiens
  chr2:172949348-172950233
  hyper
cgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagct

SEQ ID NO: 85452 - DNA, 30 bp, Homo sapiens
  chr2:172950463-172950493
  hyper
ttatggagtttgggccgcccaaccagcaaa

SEQ ID NO: 85453 - DNA, 428 bp, Homo sapiens
  chr2:172951115-172951543
  hyper
ttaaacctcaactaccgcctgcaaaaatagcaaactttccctgcaaaggcaggagctgagctcctgggaacggctctatccctcctgcagcgtcccgggacaggccctcggattttgggggacccttccctggctttcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagaggg

SEQ ID NO: 85454 - DNA, 136 bp, Homo sapiens
  chr2:172951948-172952084
  hyper
ctcggggcctgggtccgcgcctcagcctccctcctcctcctccttcttaccggttgggggtggggggagatcctttcctccgccctctcacctctcaagtcccagaccttagagaagaaacgggaccttccttccc

SEQ ID NO: 85455 - DNA, 398 bp, Homo sapiens
  chr2:172952153-172952551
  hyper
ggtccgggatttggagcagagctggagaaagcaaacagacactagtgcaagaatggttttgaatccaaagagaagttcagcaaaaccttgaggcctccttagtccgtcccaactcaagggcagaaaagatggcgcatagaaaagttgggtcgcgttgcaaataaatttcctccactccttcctaggttttcgattctttttattgatgttgatattggaattgctggctcggtgttatgcaggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 85456 - DNA, 106 bp, Homo sapiens
  chr2:172952776-172952882
  hyper
tgaagcagggtggggcggctctggagggtagtgcgttggccaacggtcgggccctgtctgctggctccccacccgtgccgcccggctggaaccctaactcttcatc

SEQ ID NO: 85457 - DNA, 79 bp, Homo sapiens
  chr2:172952992-172953071
  hyper
cgcccgtctccttcttgtctccccggcccaggtccctcccgcctccaggtccatccatcccgtccggaaaagaaggacc

SEQ ID NO: 85458 - DNA, 36 bp, Homo sapiens
  chr2:172955367-172955403
  hyper
atctcgcagccgagccgaggcagtcccggagagctg

SEQ ID NO: 85459 - DNA, 416 bp, Homo sapiens
  chr2:172955471-172955887
  hyper
cgggagctggccctccacctttggggggtcttttcaggcgcgcggtggggagcagagcccggaaggcagtgatctgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagagatcagacctcagaaaccaggatgtgggcagtcagatgggcctcaaagctgaggaaagaatgaatttcccagctcccgcgcggggtagggggtct

SEQ ID NO: 85460 - DNA, 359 bp, Homo sapiens
  chr2:172957707-172958066
  hyper
aaagaaatcctcctccggtccccagctccacaacaaacccctagctccagcgtagacagacaaacggctgtaaaaagtgccttccccaggctcaagaaacatgtcacccccacccaccgctttcctaccccctccctcatcccccaatcttcgaggattaacacttcctgaaacatcaagtgtttttataaaaaggaaaaaaataatcctgacatcgctgacaagaagttttgatggaagaattagctggtgcatacataatcactcccccaccctcctactcccggagcgggagccacggcggcgggcgcagcgcagccttccaaccctctgaaaaatgaaaccggtttccaccctta

SEQ ID NO: 85461 - DNA, 43 bp, Homo sapiens
  chr2:172958308-172958351
  hyper
gtccccaggaccaggcgcctcagagcgccgcaggctttttgca

SEQ ID NO: 85462 - DNA, 30 bp, Homo sapiens
  chr2:172958565-172958595
  hyper
tgcgtaggctccgaacggatataattatcg

SEQ ID NO: 85463 - DNA, 99 bp, Homo sapiens
  chr2:172959209-172959308
  hyper
ccctcctccttccttcggccccattcccggattctggcaaacccctccacagtgcagccgggccgggccccgggatgggcagaccgggcccagggggcg

SEQ ID NO: 85464 - DNA, 148 bp, Homo sapiens
  chr2:172959765-172959913
  hyper
ggaccacaatcgggacggagaagcggcagcgtgggcagcctgccacgtttgctccgtgcgggccccagtctgtcccccggggtcacccgagcgtgctccaagtccagtcctttcgccctcgcttctcctgccccgaagttgtaatcct

SEQ ID NO: 85465 - DNA, 1075 bp, Homo sapiens
  chr2:172960759-172961834
  hyper
cttttgacttttgagcgagttcgggggacgccaggagtgggggagttgcactcgagttttactgcccgtaagaacgactttttgagaggggacggggcttcttgctcccggacattgttctcttgggcggaggggaccacttcagagcttctctttgcacccgcctcttctgcccctcgtcttctaccactgaactgtttgtaaacaaagttccagtcttcccccgctctctccgcctccaccaaaccggtatttctcccaaattcgctccatcagtctgggatcgttacacagggcggatattcacaattttcacaagtgatcctgaaagaaggcctaggggaagcctcctaaacggtcccacattgcagcagggctggtgaggcctgggatccattctctctcttttctgcccttcccatcccggagtctcggggccggcggcgggaattccgcgcagccggaggggggtctgcgcccagcggagcgccgtgctggggcgaggtggctgtgggcagagcgtgcaccggggttggggggagaaggggattgaaggggcggggggcgcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcggcgggctgatcacaggactccgcgtctccgggcgggccgggagactgtgagaaaggcttgccagcgcgtcgcccccggcggggctggagccggcccccgcctccaggagccaggctttgtttcctcccttgcctacccctccccctttccgccccctcatttctgggacctggg

SEQ ID NO: 85466 - DNA, 141 bp, Homo sapiens
  chr2:172961876-172962017
  hyper
cggaaacacccccttcctctggccccttcaccctcctgctctcggcttcgcaggctccctggggaaaggcacaccgtggcccggcccgaccctgtcgtcactgggtgccgggtaaggtgactccggcgagtctgtggggcc

SEQ ID NO: 85467 - DNA, 484 bp, Homo sapiens
  chr2:172963608-172964092
  hyper
gtgattgtgtgtttgcgcgcgctcgagcacggccccgtgtcgttggggtcggcttgcattccagagcagccagccatgcctcccgagggtgactcacagagctctcagttcagtcccgaagggcggtgggacaaacggaggggaaggttcaaagtagggttccgaccctcaggctgctgcagagctcaggtccctgacaggaggtcccccgcggcggctggggtgccgagcctggccatctaggcgggcgcgggggcggtggcgccggcgccggaggggcagggcaggcggaggctggagccgctccgcgctgagtgagtcaccccgccgccggccggagaatccctcgcggggactcgggagggggcggggcgtgaaacccccggtgcggccccacgcccagcgcgcctgtcctctccttgccgcacctcgcggtgtcgcagcctcggaaagatgtaaacgtagctctcggccggctggcttc

SEQ ID NO: 85468 - DNA, 142 bp, Homo sapiens; identical to SEQ ID NO: 27652
  chr2:172964747-172964889
  hyper

SEQ ID NO: 85469 - DNA, 4 bp, Homo sapiens
  chr2:172965295-172965299
  hyper
gggg

SEQ ID NO: 85470 - DNA, 116 bp, Homo sapiens; identical to SEQ ID NO: 220
  chr2:172965647-172965763
  hyper

SEQ ID NO: 85471 - DNA, 1104 bp, Homo sapiens
  chr2:172965958-172967062
  hyper
cgagaggtacgggatttctgtccacccggtccctttccttccctcccacggcggccccttgggggtttccagctttgggcctagaagcttacttagggccgctcgaggcgcaggcctggaaatccttaaaagtacttaaaatgaactttaaaaagcattgtcctaaacccgcctgcttcccagccatctcaggcccgcgctctcctcgcccctgcagggcgcgagccccacctgagtctgggtgaggcccagagaggccgccagctcggctcgctccggcaaggccaagtattgagtcttttggaaacgccgctgaagagccgccagctggaaactggagtagatggtgcggggtttccggactttctttggcttcccgttcactatccgaatttcaggctcaaggtcctccttctctgcaacgataaagaatcgtaagaacagcgcaacccaggggtcctggagttcccgccctcctagagggcccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggtgctgctggtt

SEQ ID NO: 85472 - DNA, 1136 bp, Homo sapiens
  chr2:172970558-172971694
  hyper
ccccttctctgttttcggatttctctgacttcggcattcttttgctccgcaggaacatagagaacggtgggggtaaataaggggagcctgaagtttctgctctgtgcttgcgtgttcgaatcccatcgctgagactttcttctgctttggatcgcttgtcccaggctgacgccgcgctgcgacctctcccctcgtaggagcctaacgccaacccctgcgccaggcagggatggaatcatcattctcattgtatagatggacactgaggctcgagaacggaaacgacttcttttgagttgggtgcctctccccccttgccaggcagccgcctttctctgttgccatagcacaaatcacaagggtatttatggtaagccttagttgaacagctccaggtctccagaagacggcgagctggagaggacaagtctgcgctttgctctcagacccttgccccaccgctagcctggggcaggattccagccttcgcctagccgggcgctttgctctgccgggctattgggcgtcctccgctgcacagaaagccagcccagttgggtattactggggagaggatgcctcctgtcggcagggagctagggtgggcgcccgggtgccctcagtgcgtggcggggccaggcccattttcactctccttcctcactcgggggatgggagggctgcatgcgctgctgctcctactcctcacagtctcgtcgagggtcccggagacgggagtttccgggccgctggtccaagaggcaatgccagtttcggtacctttgtgttttcgtccccgaagtagtagctctaggaacctgcgctttcgaatccctttggggtttgtcctaaaactcaaagacgttggaagagggcggggatttggttatgagaacctcccagctcagcctttgcgaccaaacccgcagtgcttttgttcttacttcattggctaattgcagcttcttgggacaactctggctgggtcctttcgcattgctggtctcctcaacctgattttccctgcgacccctaaggcagcctcgagggactccgggagccatcagctctccgcagccccttgggccggcaggcagacgcgacccctgactcgggatctgcgtcctgggatttca

SEQ ID NO: 85473 - DNA, 156 bp, Homo sapiens
  chr2:172972735-172972891
  hyper
caatcacatggttaccgacgcgcagcagagtccgacctcgaactcagatctgggccatggaggcaaggccgctgtcgctctgggctgtttccggccaggggacgcgagagaaggcggcaccacacttacttctcccgggcctggtgctgccagctc

SEQ ID NO: 85474 - DNA, 325 bp, Homo sapiens; identical to SEQ ID NO: 27659
  chr2:172972930-172973255
  hyper

SEQ ID NO: 85475 - DNA, 260 bp, Homo sapiens
  chr2:172973998-172974258
  hyper
aggaccatttgtgcccggcgttccggggggaccgggagggggctgtgcttggggggcggcggggcgggggactggaagcgagggggtaagtgtagcagggaggggaacgtcgccggggggtcttggacctcgggtcttccgcgtgtccggtgttgattggctccagttgtcaggttgaaaccacaactcctcccctaagagctgcagaggtgagcccacgacgtgccggccctaggtgttctcatcgttgggttgtcagt

SEQ ID NO: 85476 - DNA, 30 bp, Homo sapiens
  chr2:172984274-172984304
  hypo
acacaattaatcttgcgttgtgttcattac

SEQ ID NO: 85477 - DNA, 28 bp, Homo sapiens
  chr2:173036676-173036704
  hypo
atgtgagtcaccgcgcccagcccaataa

SEQ ID NO: 85478 - DNA, 121 bp, Homo sapiens
  chr2:173037688-173037809
  hyper
ggggaggggtccagtcgtggtcacggaaacgggtggtcctcgcgccgggctgcactcattctgactagcaatatgctggtggaaagtgctactccaatgcctttatcgttgcgttgctatc

SEQ ID NO: 85479 - DNA, 416 bp, Homo sapiens
  chr2:173099681-173100097
  hyper
gttgtcggcggtgggcggcgccgggggagccgcgctcggggacagctggcggctcaacggcagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 85480 - DNA, 332 bp, Homo sapiens
  chr2:173100098-173100430
  hyper
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggggctccgggaaagcttggcacgaccctcttgagccttcagtttaaaatgaaacgctggcgccagatgtggccaccacattgctgataagtccagtaccttccgtttgtgcaaagct

SEQ ID NO: 85481 - DNA, 30 bp, Homo sapiens; identical to SEQ ID NO: 39711
  chr2:173291566-173291596
  hypo

SEQ ID NO: 85482 - DNA, 49 bp, Homo sapiens; identical to SEQ ID NO: 39712
  chr2:173422685-173422734
  hypo

SEQ ID NO: 85483 - DNA, 855 bp, Homo sapiens
  chr2:173600535-173601390
  hyper
cccaccgccccaggccgcgggagcccgcggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaaggtagctcgccgggggccgcagccgggggccgagctctgcggtgctgcccgggccctgagaccgccgcagctccgcacctgggcgcagcgcggccgggctgcgggtggccggggtccccgagcgggggaaggggttgaggtcctcgtccgggagacaggaggacaaggatccccgcctctcgtggggtgccagcggcatgagattattacacgtggtggagaaaatgcagcgcagtaaggggagagagcacccacctctccaaccccctgccctgccgcgactccaggctccgctcctgggtgggggtttattttctcttggcatcacgggacagaagaatcgatgcataccctttccggctattcagaccttgcggggtatgaagttttaaagaggggtgggggcaccggcaggtgcagagtaacattctttttttgttcttgaaagcaaagtgtgagggacccggtggagctgtcgaatcccttgctgaaattcacagctctctgcccccgcagtcgctcgctcaaggtctgtgttagagaaggtcatttgggaggctgctttcgtcttaatacctgcttctcgggaaaagatctttacgctaaaaataatta

SEQ ID NO: 85484 - DNA, 20 bp, Homo sapiens
  chr2:173927306-173927326
  hypo
tccaataggccggtgcgttg

SEQ ID NO: 85485 - DNA, 85 bp, Homo sapiens
  chr2:174219158-174219243
  hyper
ttaaatcttgtaaaccgcacgcagcaatgaaagtgctaaacgccatggtgcgtgacccgcgccaccctcacgctgctctccttta

SEQ ID NO: 85486 - DNA, 588 bp, Homo sapiens
  chr2:1746445-1747033
  hyper
cagggaaacctcacccggctccattctaaaagtccactgctgttgagtgagatgcccccgagtcgtccggcctgggctgaccattcacgggctctggaaagaaagccttggtctctctgcggaggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatc

SEQ ID NO: 85487 - DNA, 8 bp, Homo sapiens
  chr2:1747305-1747313
  hyper
gggaactg

SEQ ID NO: 85488 - DNA, 383 bp, Homo sapiens
  chr2:1747625-1748008
  hyper
gagcggaggaggggccgcgaaccagggggaagcgggaggccggcggagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccgg

SEQ ID NO: 85489 - DNA, 411 bp, Homo sapiens
  chr2:1748396-1748807
  hyper
ggggcgagaacccggggccccagcgtccggcctgagcgccctcatcccggtggggcggcccgcatggccaaggcgagcgctcgggggcgcggaggagagcattggcacccctgattctgcgctcgagactcggggctcgggaccctggggcctacgcgaagcttctccacttctcttacccgtggtttctgcctgcgctcactacgggttttttagttggcgccttaatgtttgtaacacttttagagcgcttgctctgatccgggcacgattccaggcgcgcaggcgcgctcctctctttctccttctccctacccgcaaccacgtaggaaattatttaacgttccaaaaaagcccctcattccttttgaggaaactgaggcccaagccccaaagcgcacagcaagggag

SEQ ID NO: 85490 - DNA, 21 bp, Homo sapiens
  chr2:174932048-174932069
  hypo
tgtagtcccagctaccgggga

SEQ ID NO: 85491 - DNA, 80 bp, Homo sapiens
  chr2:174932189-174932269
  hypo
aaaaaaaaaaaagccaaagccaaaaatgcggttgctaggaacgtttaaattacatgtatgtgccccgttaagggtctatc

SEQ ID NO: 85492 - DNA, 1202 bp, Homo sapiens; identical to SEQ ID NO: 27664
  chr2:175190771-175191973
  hyper

SEQ ID NO: 85493 - DNA, 384 bp, Homo sapiens; identical to SEQ ID NO: 27665
  chr2:175192084-175192468
  hyper

SEQ ID NO: 85494 - DNA, 288 bp, Homo sapiens
  chr2:175193089-175193377
  hyper
ttcagagctgaaggccgactgtgggaggaggaggttaaacaaagggaatcctcctcctctgggacgggtgaagtgcgtttgtcttctccttgcaggctctggaaaaactggcaggaatttccttgtcgtgagaagatggacgagtgtgtctgcagccgaggagacaactacaaacagactttgggcagggaaggcgggcgggcgggggtgggggtgggggcgggggcctgctttgatcgctccagctctgttgtaattttgtcttcgccagatagattagctggaacc

SEQ ID NO: 85495 - DNA, 267 bp, Homo sapiens; identical to SEQ ID NO: 225
  chr2:175193378-175193645
  hyper

SEQ ID NO: 85496 - DNA, 154 bp, Homo sapiens
  chr2:175193808-175193962
  hyper
cgggtggttctaagctatgacgaactagaggctgggcccggttcttctccagaacagcgtgtggatgtaaaggagatgaaatcgtcctcccccactgctttctttttcttccccatataaatcagtcatataattcattcgcattgtttaaggt

SEQ ID NO: 85497 - DNA, 30 bp, Homo sapiens
  chr2:175196266-175196296
  hyper
tcagatcaaagctcccgggagaggcaagat

SEQ ID NO: 85498 - DNA, 61 bp, Homo sapiens
  chr2:175196514-175196575
  hyper
ttctcaccccactttcgctgctcagtcagatttgtttatgcagaatcgacatttaatagtg

SEQ ID NO: 85499 - DNA, 298 bp, Homo sapiens; identical to SEQ ID NO: 27669
  chr2:175196967-175197265
  hyper

SEQ ID NO: 85500 - DNA, 149 bp, Homo sapiens
  chr2:175197915-175198064
  hyper
gctccatcacagggccgagagcagcgccactctggtcgtacttttgggtcaagagatcttgcaaaagaggagagaaaacacgggaggcacagttccacatccttgtcacttgcaccggctccgcgacaactcgtcgtttgcacccgagg

SEQ ID NO: 85501 - DNA, 187 bp, Homo sapiens
  chr2:175199368-175199555
  hyper
ggggtgcttgtggctcggtttcattggtacttaaacctggcttggtgcgtgagtgtaaatttttaattgcactgtaatttcttcagtccccagcccgccctcgccccccccccgcaagtatcccccactactcccccccacccccgcggccctagctagctgacttgactggcacgcgccgggagcc

SEQ ID NO: 85502 - DNA, 14 bp, Homo sapiens
  chr2:175199921-175199935
  hyper
ggagaaactgttgc

SEQ ID NO: 85503 - DNA, 269 bp, Homo sapiens; identical to SEQ ID NO: 27673
  chr2:175200172-175200441
  hyper

SEQ ID NO: 85504 - DNA, 144 bp, Homo sapiens; identical to SEQ ID NO: 230
  chr2:175200709-175200853
  hyper

SEQ ID NO: 85505 - DNA, 267 bp, Homo sapiens; identical to SEQ ID NO: 231
  chr2:175200916-175201183
  hyper

SEQ ID NO: 85506 - DNA, 183 bp, Homo sapiens; identical to SEQ ID NO: 232
  chr2:175201359-175201542
  hyper

SEQ ID NO: 85507 - DNA, 54 bp, Homo sapiens; identical to SEQ ID NO: 233
  chr2:175201775-175201829
  hyper

SEQ ID NO: 85508 - DNA, 120 bp, Homo sapiens; identical to SEQ ID NO: 234
  chr2:175202126-175202246
  hyper

SEQ ID NO: 85509 - DNA, 33 bp, Homo sapiens; identical to SEQ ID NO: 235
  chr2:175202568-175202601
  hyper

SEQ ID NO: 85510 - DNA, 78 bp, Homo sapiens; identical to SEQ ID NO: 236
  chr2:175202633-175202711
  hyper

SEQ ID NO: 85511 - DNA, 309 bp, Homo sapiens
  chr2:175203142-175203451
  hyper
taaagaaattaaatgcgtttatctgtatcaagaaaatcttgacatcatattttcattttggtattattaaaggactctgaacaatacatttccttttttaaaaatcctgtttccccctcaataaccttttcgtgggtcgatttttttttcggttgggaaaaaattcccttaatgttagttgtaggtaatgtaaagtttatgtgggttataaaagccatactacatatacgtttttgagaagtcaaaattatttatttgtatatcaacaacataaattaaattgggttgtaaggacgtgtagttgtatta

SEQ ID NO: 85512 - DNA, 175 bp, Homo sapiens
  chr2:175204088-175204263
  hyper
tttccttttcaaagacggctgatctatgcaaatagtgaattggaaatgcctaggtccccgcgccgtcaaatggccctcgcaggttatttgaatatcagtggcgctgcttctgaaaaggttcaaggatgctctctgacttctttgtgattactcagtgcggcgtcttattctgaag

SEQ ID NO: 85513 - DNA, 455 bp, Homo sapiens
  chr2:175204492-175204947
  hyper
gataatttcgcaattcgaaaaaaatgttaatttagaaaataaagtacatatttacagaataaaaatatttctaaaagatttcccacacaagaggaaatacaagcgaagtcagcaccaacatattttttttttccatttttgattactgtccgccttgggaatttgagcgaagattttgatttttaggaaagaaaaaataaattcttgttattaacaatcagcaaaatgttttctcggaaactgttctgaaacaccaagtcgcaaagtagcgataaaacagaacgaaggtccccagcagggagtttgcagcgtgacattcaatggcttcttccttctccttcttgagctccccgcggccaggctgccccgctcttcttactcgagtttttcttcactttggccattttctctccccgatcaagctgttcataaccgggagccccccactccctaag

SEQ ID NO: 85514 - DNA, 189 bp, Homo sapiens
  chr2:175206717-175206906
  hyper
ttgagagggctgaagcgttgtcggcggcgacgtggaccccaggatgtggggatccagctgtggacgcagacccctctgactctgcatccgtggctcccggcccgcgaggcccgcgtggactacccggggcccggctggaaccaggccgattcaaacaggccaccaaaccatcccacccccctaccccct

SEQ ID NO: 85515 - DNA, 693 bp, Homo sapiens; identical to SEQ ID NO: 27685
  chr2:175206960-175207653
  hyper

SEQ ID NO: 85516 - DNA, 888 bp, Homo sapiens; identical to SEQ ID NO: 27686
  chr2:175207981-175208869
  hyper

SEQ ID NO: 85517 - DNA, 139 bp, Homo sapiens; identical to SEQ ID NO: 27687
  chr2:175208996-175209135
  hyper

SEQ ID NO: 85518 - DNA, 60 bp, Homo sapiens
  chr2:175351002-175351062
  hyper
ctccaagataaggggcgcagagagttcctaaccgaataggctgctcggagagcagctgcc

SEQ ID NO: 85519 - DNA, 1280 bp, Homo sapiens
  chr2:175546788-175548068
  hyper
gaaaaaggtaggggacgcgagactgaagtgaagctgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggtgccagaacttgagccggccccaggggatgcccgaacgtccccctctgtcctagctggggtgtaggtgcagccccagggcatcgccgcgaagcccctgctcgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcgtcaccggtgccaggcggcacttccgtgccccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaacttcgccgagatgtgggccctcccctccggcgccgccgcccccccgccgccccgccacatgtggacgcgccgcgaggccccgccggcccgcgccctgccctccgcgcgcccgcctgccccgccagcaatggggctctgcgcctgcagcttcggcccgcagaggatcgcggcggggcgggatggtcggggctggagtccgcagtttcctcagtcccgctcccctgcgcggcgaggggaccgaggcaagaggacaggagtttgcagaggggcgggaactggaaggggagtctagcccagggcctttccccccaactcttgaatcttctccaccttcttgcggctgctggcggggggatcgggtgggggtgttccctctgttcgagccggaaggaacgccttttcccacgctttcccgtctgctctcaaaa

SEQ ID NO: 85520 - DNA, 30 bp, Homo sapiens
  chr2:175791881-175791911
  hypo
cagactcctgcctcccgagcacgcatcctt

SEQ ID NO: 85521 - DNA, 153 bp, Homo sapiens
  chr2:1758012-1758165
  hypo
gcctccccactcctgcggaagtaactgctggggcccaggactcactgttgccccaaatgcccagcacttagccctcctcgtgcaagactcagctgtaacctcaggtcctttgaaggctcccatgcactggcccacctgcggggaaagctggtc

SEQ ID NO: 85522 - DNA, 24 bp, Homo sapiens
  chr2:176030420-176030444
  hypo
ggagtctcgctgtgtcgcccaggt

SEQ ID NO: 85523 - DNA, 79 bp, Homo sapiens; identical to SEQ ID NO: 39714
  chr2:176430829-176430908
  hypo

SEQ ID NO: 85524 - DNA, 30 bp, Homo sapiens
  chr2:176688101-176688131
  hypo
atcaagcacccagcacgaggaccgctccat

SEQ ID NO: 85525 - DNA, 34 bp, Homo sapiens
  chr2:176914363-176914397
  hypo
aaagtttgcaatttacgtaattttttttttttaa

SEQ ID NO: 85526 - DNA, 474 bp, Homo sapiens
  chr2:176940167-176940641
  hyper
aattgcagagggtagcgattgtttcatcaaatgtttcatatttctgagtttggagggcggggatgccagggtaagcttcctccgagcgactaaggagcagcaacaagctctggaatttcctctcggggtggtccgttccaccttaaataacttgggctttttggtcccaaacgcgccctgtagttcaggtttttttgtcctccctgcagcagctgtcaccctgcattactcgcagtcagctaaatgaaacattattctaaacatatgcatcgtaatcagttcggtcacacttacaagaacacgcgttaataaggcaatcaatcaccctggaacaagcaagttgttctgtaacagctcataaacagtgtgtaatgaagaattggaggttaccgtgacatgcgttgatcagataatcaatgtcaaagatgcgatgaatgtcagtaaatgtagttttcatgtcgtttctataaaatc

SEQ ID NO: 85527 - DNA, 589 bp, Homo sapiens
  chr2:176943178-176943767
  hyper
agccaagtggctctgcggggagcattatggaaatatctgggcttgatttaatgaggctgttcacactggtggaatatcaacttaacagagaaaagtctacccagggcgtccaagttaccaaaatgaaaatcggcaattgagatgataagaacgtggctttcttctgcgaaatcacttcaggtaacagagataacattaaataacatacattctatgcaccaagaacaatgttttatgtaccgagtctcttatccgtctctcctaatgacttcccttagcgggttgttagtacttgacagcaggtctccgtgcggggaacttttctccaattccacattcaaaggaggtccatcagagagcatgattggcaattttcgtcataatctgcacattattagcatcaaacttgacgtggcagttaacactagtgggttttgatgtacctttcttcaagttcaaggaaacccctccagtagccgggttggcagagcgggtctcagcaacccagcggtggctttgcagaggcgaaggcgcaatagacatgcgtgagaaatatgccaagaaccatttcacccgaggaaaaggaaag

SEQ ID NO: 85528 - DNA, 333 bp, Homo sapiens
  chr2:176944072-176944405
  hyper
agaaaggtgttggaccgaaaaggaggcggcgcaacggccaccccttccagcacctcggctttgtccttcccggggaaggcggccacatccctacccgccttgctcctgaacgtagtaaacaatctcacaaacaaccaccgctgcccacgctctccatccgtcctcccggccttatcagacctccgttctcccgcactcttcgggcagggtccctaataagctcaggctgaaagaacgtttgccacctcccccaccctcgttgaaagaaaaggaagaaaaacagcagcagcgagaaacctccggggcgactcctcccccgcccccaagcaccag

SEQ ID NO: 85529 - DNA, 391 bp, Homo sapiens; identical to SEQ ID NO: 241
  chr2:176944456-176944847
  hyper

SEQ ID NO: 85530 - DNA, 132 bp, Homo sapiens; identical to SEQ ID NO: 242
  chr2:176945137-176945269
  hyper

SEQ ID NO: 85531 - DNA, 1287 bp, Homo sapiens
  chr2:176945581-176946868
  hyper
cgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctctcccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaattaataacctaaagttatatataaataaggacaatttcgttgcatttttccccgcaggaggttgcccttttttcgttgcccaagaggaaaatgttcaggaaactactgtctcaaaccaatcgattttaaagatacagtatccttttctccgtgtaacgatttatgcggaaaataaatctccaagctcaagagcaaatgaaaagtttcacctctggttcctgcttgaggaacaaagaccaactgggcttgccgcctaggggaaagtggggccgtgggtatgggcgagggggcatctggccaggcgttgggcacaatggagcaggggcgagtgctttcagcattggagtcaccattcgggggccttcttagatccgtcaggccggacaaccgttcggattcggtggccgggaaataaataagccaattcctttggtgactaccccccgcggatttccagacccttagctaaatctagccacccagaaaggggaaaggggaaaaagaaacaatcaacccagatgcccc

SEQ ID NO: 85532 - DNA, 370 bp, Homo sapiens
  chr2:176947284-176947654
  hyper
ggaattgatggggtctgtcatgcttacaaattgctgccgttaatggaatcaataaagtttggggagcccttcataagcaaataatagaaacggaattaggagatttcttttttaataattagaaattttcaaccaaggaggaaaagtggccgagggaaaatgcctacctctgggcgcagtttgggaagctctgggtttcccatggtctggagaccgcagggcagctttttatacggcctctaacctttatctgagtcttcggggtttcaaatattttaagagttccaacacagcagtagctcaaacccaagccaatagggggtgaaatatacttttcaactctttctcccgctgacctaaacagagacgc

SEQ ID NO: 85533 - DNA, 177 bp, Homo sapiens; identical to SEQ ID NO: 27700
  chr2:176947763-176947940
  hyper

SEQ ID NO: 85534 - DNA, 74 bp, Homo sapiens; identical to SEQ ID NO: 27701
  chr2:176947941-176948015
  hyper

SEQ ID NO: 85535 - DNA, 724 bp, Homo sapiens
  chr2:176948351-176949075
  hyper
cgggcttaggcgagccgggtgctgcgaattttccagggcctcgagcacagcattgccagccgagttggacaaattggagaatctcttgcccgccgtagggctgtgcagccctctctccatcagaatcatctcttttcttattctttccatcatctcagctttcttaaaaatgtcacagtggccctgctgtcccgtcctaatgataggctgcgcctagggctaattctcattcagccccagcgaacgcctctaaatattattatcgctttcggagggaggcggaaaaattgtgggatgccagagcgagggaatgactggtcaaaatgacccatacatccttccgatcccgagatgtcattcatcaaaaagtagcgcccgctcgtcattaaggtacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 85536 - DNA, 630 bp, Homo sapiens
  chr2:176949372-176950002
  hyper
gctctcctcccaccccgggagagagagagagcggaagagagggagagagggagagagggagaaagggagagggagacggagtgagagaaagagagagagagagagagagagaaatagaaatatcctagagttttgaaagcgctttcttgctacgtggccgcggaggtgcattgggcccgcgcctccaaacggaaatcattaggtcctctctgattttctaacaccgtctgcagagtgagatctgaactcgaagtccccggttttttacttttataatcctgctgatagaaagccttctcgcctacgcattttcctgaggggaaacgaactaggctggacgatttgatagcagaattcgacagctaactttaaacacagtggagatttacagcgccatacgggcgctccgaatccacgctcacgttgccagattttcccctccctcctcaaatagaattatttgcggcaaaggcgctggatttcgaggtcaaaagaggaaagaggagacagccttcttcccctacctccccgctgccctcccttcccctttgcttttcttccttctctctttcctcccctcatcaaccccagccccttacctgcggccacaggtattcccagcgttgggtc

SEQ ID NO: 85537 - DNA, 407 bp, Homo sapiens
  chr2:176950074-176950481
  hyper
cgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggaggacggggatgggacgcggaggtccgcccgtgagcttctgaagcggctgagagaccctgacaatctgggcgctgggcgcgggtcctgcatccccacatttagcctcaatccgaaccccaaccagggccccctcttctttctgccgacacacccagaacattggggtgtgttagggggcaagctcgagatctattcgcctatagctcttggcgctttccttttaac

SEQ ID NO: 85538 - DNA, 586 bp, Homo sapiens
  chr2:176952724-176953310
  hyper
aagccgtagctgcagcgaagccccgcgtctgccgctgccggagcctggctctcctcttacgcggggggctgcgggcaattggggccgacaacttgcggtcccgccttgggacgcatgcttgctcgagagctggggctgcagggtgcagtgggacagtaggaccgcgaaagcctgggcttcgagcctcgggctccctgtcttcaggcgaagtgcggtttccacgggtgcaggtttcgctgcataagggaagactcagatttcgagccctcggcaggccagcttctagctctctgtcccttccgggtctctccggttgcttctgtctttcctcctcccactcccgtcgcaatcccgcgccccacggaggaaggtcgtggtgcgggagttgggggatactttcttcctgggctcggtctacgcagacccatcgcctgcctcgagttcctgtgccctcagacgccacgggaaaacttgcagggacatctagcgccaggcgtggggaactgcgcgccgccgggccgggaagtggagccgaacactgcccctccgcctccctttcggctccccccttcgtgcttgggcactt

SEQ ID NO: 85539 - DNA, 487 bp, Homo sapiens; identical to SEQ ID NO: 27707
  chr2:176956928-176957415
  hyper

SEQ ID NO: 85540 - DNA, 53 bp, Homo sapiens; identical to SEQ ID NO: 245
  chr2:176957576-176957629
  hyper

SEQ ID NO: 85541 - DNA, 723 bp, Homo sapiens
  chr2:176957914-176958637
  hyper
ggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggtaggggcgatggagaaaagggaccgacacgagggagggggagagagaaggagaaaagaaaggactaagagtatgcgcccctacttgggagtgggagttgtgcctgtgctccacacgtgaccagggttaacccagtggaaatttgtccagttcgtgtgaaatctgtaaattcctcctctgatttcaactgcctccgtcactgccctttctttcctgtgtgcagcgcagacacgttttt

SEQ ID NO: 85542 - DNA, 415 bp, Homo sapiens
  chr2:176959096-176959511
  hyper
ctgcacccctgcaaacgcacacacacacacacacacacacacacacacaatcctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 85543 - DNA, 30 bp, Homo sapiens
  chr2:176961663-176961693
  hyper
cacttcgggaagggtcgttaccgtttttgt

SEQ ID NO: 85544 - DNA, 37 bp, Homo sapiens
  chr2:176962204-176962241
  hyper
ggggaacgaggtccccgtgtcgcgtgattcaagaggc

SEQ ID NO: 85545 - DNA, 30 bp, Homo sapiens
  chr2:176962587-176962617
  hyper
cactactttccaccccgatcctccctcgat

SEQ ID NO: 85546 - DNA, 96 bp, Homo sapiens
  chr2:176963158-176963254
  hyper
gcaggaggaagaggccgattgcgttccccagagccacccaattggtcgccataactcacacaataaagtggcagcgcggcggtcagtcttgccctc

SEQ ID NO: 85547 - DNA, 447 bp, Homo sapiens
  chr2:176963321-176963768
  hyper
cgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttgcagtgtgtagtcctggagaggactcctgaagataaaaggaatgtagcctttggccacgattggtggatcga

SEQ ID NO: 85548 - DNA, 100 bp, Homo sapiens
  chr2:176964050-176964150
  hyper
agctcctggtgccgccggaccgcgccctctccggataagtcgagaggcgccggttaatggaaaatgcctccgctgcaacttaaagccggtagaagcaagc

SEQ ID NO: 85549 - DNA, 155 bp, Homo sapiens
  chr2:176964179-176964334
  hyper
cgcaaagccaatcacgaccaagaagagtcccaggggacacttgggcagagtcaccctcttgcccgatgtccccagctgctgaagccgggcctggaaacccgcagacagttagtcttcgctcaacctgatttggctctgctggcagcctcgtcctt

SEQ ID NO: 85550 - DNA, 379 bp, Homo sapiens
  chr2:176964389-176964768
  hyper
cggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctc

SEQ ID NO: 85551 - DNA, 258 bp, Homo sapiens
  chr2:176965264-176965522
  hyper
cggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcc

SEQ ID NO: 85552 - DNA, 265 bp, Homo sapiens
  chr2:176968485-176968750
  hyper
aaaaaaaaaaaaagccgaagagaaaggacgctaaaatctgagtgctcaacattcccttcagaaagacaaatgtgtcctctgaaatgctgcagtccaagcgggcctcttgaccaagaaaacagttttaaaacgagaaaaaaacagcttcatctggcattcaatcagttgggaactcagagggcggcggggaaggggggacgcttttaaggcctgggggttctcccccagggaggcgggctgaggaggcttccgggatgccggcggg

SEQ ID NO: 85553 - DNA, 515 bp, Homo sapiens
  chr2:176969099-176969614
  hyper
cccagtcagcttttacgagagctgccagacagtgtctgttcacgttctccagataccaggggcgccctgacaaagttaaggtcaagttagtgtcttatcttgggtgactcaaaatcaccgcatcgcgtcctggcgctgtgcggaaagctctttctcgcggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctgggactggaatgaaagcgctctgggttgtggagtgggtcggggggcaagggtccgcgctaaggagccgaaaggggccggccgcccccttcccctatgcaccggcgcgccactgcagatggctcaccctcccccgccaaatcgctgctcccgc

SEQ ID NO: 85554 - DNA, 232 bp, Homo sapiens
  chr2:176969676-176969908
  hyper
cggtcagcaggctccatactgggggcgccgggctgcctgcaccccaccccgtgccgccagtagagagaaggtgcgagaattttgcgaatccccagacacataaagacccgggttgaagtcctcgcagctgccctgggtcctgagctaccgcagggccagtgtgcagcgtccagggagccattttaggagagagatccaggggcgtcgaccacgagcccgaaagggagaggct

SEQ ID NO: 85555 - DNA, 68 bp, Homo sapiens; identical to SEQ ID NO: 27718
  chr2:176970219-176970287
  hyper

SEQ ID NO: 85556 - DNA, 30 bp, Homo sapiens; identical to SEQ ID NO: 27719
  chr2:176970603-176970633
  hyper

SEQ ID NO: 85557 - DNA, 213 bp, Homo sapiens
  chr2:176971223-176971436
  hyper
agagccgggtgggcacgaaggccccggcctgggtgagtgcctaggtggtgaatggcctgggtttttccgaggccagcactcgcacccttggggtcagaaccggaaagagccaagtcactccactctgaacgcgctgggcagaaaaatatgtaaatcagggctccctgcgccctggagagtggcgaaattactcccgcccggtgaacaagaagc

SEQ ID NO: 85558 - DNA, 246 bp, Homo sapiens
  chr2:176972742-176972988
  hyper
cgggggcagtccctgcaccaaggcgacccctggctcggagcccaagggggcagcagaaggcagcggtggcgacggcgagggccccccgggagaggcgggggccgagaagagcagcagcgcaggtaggcaccgggtactgggcaagcggtgggcccgggggccgcgggggagggggggggggcggaggcctccctctgcttgcgcctttttatgtgctactttataagcattcgaagaggtttatac

SEQ ID NO: 85559 - DNA, 79 bp, Homo sapiens
  chr2:176974033-176974112
  hyper
gcctgcggacgaggccgggacttggccgagcggatcctaataaggggaaaatggtaaatgcaaacgtcccgttacaatt

SEQ ID NO: 85560 - DNA, 311 bp, Homo sapiens
  chr2:176976029-176976340
  hyper
aaaactgcatctaaacgtagcaagcttgtgtgcccaccacccaaggcaagccgaacccgagataccattttccgtttgcaggggcctggagatccacacgagggcgcgctcacgttccagaagccgcgtttgaccaagaggccgcggtaccttgtctgtccaacactggattctaataggcgacctcaaccccttagaaacaggcggcagctaaggtgtttgctagtttatttgttctaagcagccatgaggtgtgagaagttgtatagagacagaaaacggagcaactagattcacgaaacagcctaatc

SEQ ID NO: 85561 - DNA, 147 bp, Homo sapiens
  chr2:176976597-176976744
  hyper
tctcagacctcctgggatgattaaaaggcttttgtttataacagatcagggagcgggccacttagccaaatgtctctcagaaaaaaataagacgcatgggggactgggagaatcgttctgggagcccgcggccgtgcctggagtgcg

SEQ ID NO: 85562 - DNA, 35 bp, Homo sapiens
  chr2:176976975-176977010
  hyper
cagaagcagtgcattcgttgcgtgccctccttcct

SEQ ID NO: 85563 - DNA, 220 bp, Homo sapiens
  chr2:176980718-176980938
  hyper
ccagaggtccggccccgcagaggtcagggtgtggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggc

SEQ ID NO: 85564 - DNA, 130 bp, Homo sapiens; identical to SEQ ID NO: 249
  chr2:176981376-176981506
  hyper

SEQ ID NO: 85565 - DNA, 127 bp, Homo sapiens
  chr2:176982293-176982420
  hyper
aaggaaagcaaaggtcggtatgagcagagttgccaccccagcggggcgcgcagcccgggaacccggcagagagggagtgccggggtgcccagcgccgagccggagcccgacttggcaggtgctgctc

SEQ ID NO: 85566 - DNA, 198 bp, Homo sapiens
  chr2:176982517-176982715
  hyper
cgcccgggcagaggaaaagcttgccggttttatttttcctgagctagacctgaacacaacaaaagagcgcaaaggagacctgcggctcataaacacgaccacagagcctcttttctcctgctcagatttgcagttccagttttgccttgagcccaatgatcatgttaaggtgatccagggcaccgtgttcgtgttcaa

SEQ ID NO: 85567 - DNA, 83 bp, Homo sapiens
  chr2:176983753-176983836
  hyper
acactaagcaccaaacgctggaattagaaaaagagttcttgttcaatatgtacctcacccgcgagcgccgcctagagatcagt

SEQ ID NO: 85568 - DNA, 504 bp, Homo sapiens; identical to SEQ ID NO: 2125
  chr2:176986711-176987215
  hyper

SEQ ID NO: 85569 - DNA, 916 bp, Homo sapiens; identical to SEQ ID NO: 27729
  chr2:176993464-176994380
  hyper

SEQ ID NO: 85570 - DNA, 60 bp, Homo sapiens
  chr2:17699403-17699463
  hyper
tgatttctccacacacgagtctgtggagttatcgaaaatagcattcgttgaaacaaggag

SEQ ID NO: 85571 - DNA, 125 bp, Homo sapiens
  chr2:176994497-176994622
  hyper
cgccggtgcgcaccgggtcggcagcctcggcggcgggggcgagattggcgggaggggggcgcggggggggcgcggtaagaggtggcggcgggcagagggtgttttttttcttttccctccagagc

SEQ ID NO: 85572 - DNA, 200 bp, Homo sapiens
  chr2:176995070-176995270
  hyper
ggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgc

SEQ ID NO: 85573 - DNA, 337 bp, Homo sapiens; identical to SEQ ID NO: 27732
  chr2:176995331-176995668
  hyper

SEQ ID NO: 85574 - DNA, 38 bp, Homo sapiens; identical to SEQ ID NO: 6554
  chr2:176996261-176996299
  hyper

SEQ ID NO: 85575 - DNA, 185 bp, Homo sapiens; identical to SEQ ID NO: 27734
  chr2:176997536-176997721
  hyper

SEQ ID NO: 85576 - DNA, 215 bp, Homo sapiens
  chr2:177000663-177000878
  hyper
gggaggaggggaaaccgaaagtggttggctgcctctggggacaggccttttcctgaggggagaggaggagaagccaagtgactagcacagggtgagagatgggaggaggtagctgtggggatcgcttccccagagcgtgagcagtacattgagttcatttccctccttcacgatggccaactgcgcagaggttttgagccaaaccaaagaaaaga

SEQ ID NO: 85577 - DNA, 34 bp, Homo sapiens
  chr2:177000938-177000972
  hyper
gaaaaagaaacagaggaggcggggagggagggaa

SEQ ID NO: 85578 - DNA, 57 bp, Homo sapiens; identical to SEQ ID NO: 250
  chr2:177001206-177001263
  hyper

SEQ ID NO: 85579 - DNA, 432 bp, Homo sapiens; identical to SEQ ID NO: 251
  chr2:177001264-177001696
  hyper

SEQ ID NO: 85580 - DNA, 267 bp, Homo sapiens; identical to SEQ ID NO: 27738
  chr2:177001781-177002048
  hyper

SEQ ID NO: 85581 - DNA, 329 bp, Homo sapiens
  chr2:177003734-177004063
  hyper
cgatagcatgtccgggccttggtgacgacgggtcaggccatgaactgggcttgagatctctggcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaagctggggaga

SEQ ID NO: 85582 - DNA, 61 bp, Homo sapiens
  chr2:177004437-177004498
  hyper
tcctctgcatccaggcgtagaagcagtgcgcggtaccttatccgcactgcgcggtgcaagc

SEQ ID NO: 85583 - DNA, 151 bp, Homo sapiens; identical to SEQ ID NO: 27741
  chr2:177004555-177004706
  hyper

SEQ ID NO: 85584 - DNA, 697 bp, Homo sapiens; identical to SEQ ID NO: 27742
  chr2:177004982-177005679
  hyper

SEQ ID NO: 85585 - DNA, 271 bp, Homo sapiens
  chr2:177042532-177042803
  hyper
ctccattgttcacagcgctgccctacaaataccatatccgtccccacctcctctgcaagggtcgagcggaagagtaggtctggtgagctgagctctagggagctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctg

SEQ ID NO: 85586 - DNA, 86 bp, Homo sapiens; identical to SEQ ID NO: 27744
  chr2:177042913-177042999
  hyper

SEQ ID NO: 85587 - DNA, 290 bp, Homo sapiens; identical to SEQ ID NO: 27745
  chr2:177043266-177043556
  hyper

SEQ ID NO: 85588 - DNA, 152 bp, Homo sapiens
  chr2:177052592-177052744
  hyper
ttccaacaacccagccggaggggaaaatctgctaaaccaccccacaaggcagaaactttatcaaaatctggcactacaacactggccctcatcacgccgccacaaattgcgagggatagaagaaagctgcaaagtcacgttaaaaggaagcc

SEQ ID NO: 85589 - DNA, 472 bp, Homo sapiens
  chr2:177052963-177053435
  hyper
gcagtctccaccggccgcgcgtcacgctcccatttaaccttttccatgccgcgacgcccacactccgccctcgagggactagccccccccacgatccagagcagaagcggctcgccccgctgcatccacgggccctcacccaagcgtccagtcctgcctttctccccccacctcgcccaatacctgtccgagagcaggcgttctgccctctcgccccgcccttgcccaggcagcccccggtcgcgacggctctcctcggggctcgggggcgctgggcggcggccctgggctgctttggctaacttggctgcggggcaggcgcgaggagcggcgcgccgaccgggccgagcggagaggccgcccattggccggccagcgccacgtggccgcccccgccggtatattaggccactatttacctccggctcactcgccatgggttggagagggcagctcgggtagagagggctgg

SEQ ID NO: 85590 - DNA, 85 bp, Homo sapiens; identical to SEQ ID NO: 6564
  chr2:177053618-177053703
  hyper

SEQ ID NO: 85591 - DNA, 48 bp, Homo sapiens; identical to SEQ ID NO: 27749
  chr2:177053906-177053954
  hyper

SEQ ID NO: 85592 - DNA, 364 bp, Homo sapiens; identical to SEQ ID NO: 254
  chr2:177053999-177054363
  hyper

SEQ ID NO: 85593 - DNA, 130 bp, Homo sapiens
  chr2:177133417-177133547
  hypo
tgccccgttcacccccgaaaggtgagaagtgtgtgaaactaaagtatcttattctccaagctgagcatcatttcgggtgtatggagttgaaggacaaattaccttctggcttaggcgctgctcaagcctc

SEQ ID NO: 85594 - DNA, 753 bp, Homo sapiens
  chr2:17719677-17720430
  hyper
taaacattacaatatcgcatttaggacgcaaacagcgctgcagtgcaaatggaactttaaaaaatctgcccgcccacgtagacaaagctactttacaaaagcgcacgcgtcgatatcaatcgtaccctacaacagagcatggtttaaagtatcagtgtacattttttcctaaacacaagttgcaagtaagttatctaaaatcgaacaccgccacgaaagagacctccagggtgcaataaataggtatatctcgttgaagtggagaaatggcatcatgaccctttgggttgatgcagattacagtgcggaggctgttctcgagagagaaactagaactcagcgtaaaatgctgtagtaggggaaatcgaccaaagacgagattttgaaagccttttgaaagtcgtttttctagctaaaaagaaaaagtgacttattcaggactgactccccctgccagtcccaggaaacaggagcagcccggcgcgcccgggagccccgcagcgcagtgcgcactgcggctccagagcgaagggctggcgcccgccagattctaaacgtgctcggctgccgcagcccgccggggccgcgcgccgtggtccgcgcgactccgcgctccgggtttccgcggtcaccagcactggcggaagagccctgccgagaggggacagccgcgggcggtgtcccgggagtcccgagagcgcgctccccctttgcgcaaccttcccgaggcgtcctgcccgggaagccagttcc

SEQ ID NO: 85595 - DNA, 157 bp, Homo sapiens; identical to SEQ ID NO: 27065
  chr2:17721522-17721679
  hyper

SEQ ID NO: 85596 - DNA, 117 bp, Homo sapiens; identical to SEQ ID NO: 27066
  chr2:17721750-17721867
  hyper

SEQ ID NO: 85597 - DNA, 101 bp, Homo sapiens
  chr2:177498024-177498125
  hypo
gagcactagttactccggttctaaaaagctatgaattttgatatatagcctacgttatgaaagcttacctctttatggcttcaaccaggtgagtgtatggc

SEQ ID NO: 85598 - DNA, 695 bp, Homo sapiens
  chr2:177502225-177502920
  hyper
ttggtgggagctgctcgtcttcagcaaagcgagggccggctgcaaaggcgcaggctggcagttcgggtcatttcctgccgattccccattcccctcggagcagcttggagaggaagtcggacttcttttccaggcggagcctccacgatgggcgtgggcgcctcgtgcgtgggccgggggcctcgtgcgtgggcggggatcggggcctgggaaaaacgggaacccggtacccgcccgcgccctcgcgcgtcggccaggaacctcggccccatgcgggcgggccagcgcggccaggagggccgggaagaggggtccccggggccccggatgcgctgaactccggggaggggatgggcaggagagagagcacactcctggagccgcgacgtccaaacccggacgcacttgaacccgcagcgaggcccgtggctcgcggccttcggagagcacccgcgccccgcgcagaccggacgccggccttgcccgatcctcggcatccttcggcggggcggccagtcccagggcgctcgctgagggccacaccctggccccagagtttagcaccgccgcgggcagggcgctccgctcccggaccccgaatctgaaagcggagaccaagggctgcctgcggcaaagctcgacatacacttgattttcttccgatttggagaaaatgtcacgggcgagagcaaaaa

SEQ ID NO: 85599 - DNA, 155 bp, Homo sapiens
  chr2:177502980-177503135
  hyper
cgcggcgtgcgcgcggcggcgggtggcgggcggcgcgggcgcccttgcggggattcccggtctctcagcgcgccctagtggacgccctgcctttcgctggctccccgtgctcgttacaatctgcaatatattatttcttccgaagtattgacaat

SEQ ID NO: 85600 - DNA, 210 bp, Homo sapiens
  chr2:177580925-177581135
  hypo
catgccaatctaagtcgctttgaggtgttgtgtctgccctcgagcagaaataatttaactttggctaaatcaaatgcgggagaacaggactcttcgaatggctcctggattctgtcattggcacaaagtgcctggaccctaaatagaagctccgactttactggcaccagtgtccatctgccggacagcgcctctcggaaccctgatgtg

SEQ ID NO: 85601 - DNA, 30 bp, Homo sapiens
  chr2:177842306-177842336
  hypo
aatgaggtgaaaaagcgagactgcaacaac

SEQ ID NO: 85602 - DNA, 192 bp, Homo sapiens
  chr2:177895144-177895336
  hypo
ttcacattaatggggcgttatgctaatttgtcccagcagctctgccaaaccaccattacctcctacactccttagctgcactctgtttgtgcccttcatgtccttgtctgccaattaactaggcctgttagtctgctgcaagcaaaacgcgccagagcagcagcccagacaataagccgctgttgcctaagg

SEQ ID NO: 85603 - DNA, 32 bp, Homo sapiens; identical to SEQ ID NO: 39717
  chr2:178089350-178089382
  hypo

SEQ ID NO: 85604 - DNA, 220 bp, Homo sapiens
  chr2:178119023-178119243
  hypo
cactttcattatattcgatgacctctgtcccatcacctgcttcaggttaggataaaaggtataaacaagctgccacctggtgagatggcaggcttccctacaaaaaacaagaaagtaatattctgccatttcctaagaacaagcagcaatgtcctggcttcaaatggtctctagaagtccatgcaccaccgtgcttccactggggcggttgtatcaccca

SEQ ID NO: 85605 - DNA, 30 bp, Homo sapiens; identical to SEQ ID NO: 39718
  chr2:178131780-178131810
  hypo

SEQ ID NO: 85606 - DNA, 30 bp, Homo sapiens
  chr2:17830678-17830708
  hypo
ctttccttatggagacgcctccaagtttgc

SEQ ID NO: 85607 - DNA, 238 bp, Homo sapiens
  chr2:178972992-178973230
  hypo
cctggccagagtccacgcctcaacttcgaggctggcgatccagaaagagcacctcacgccctgggctgcaagcgcagccggacgcgcgcgaccagtgatcgccagccaatggcaagccgggacccggtcccactgctgattggcccccagatcccgtgggatctcacctctcgcagaggcttaaagccttgtacttgctgtgcagtgcttggctctgcgtgcccgctgtccagtagct

SEQ ID NO: 85608 - DNA, 137 bp, Homo sapiens
  chr2:179058613-179058750
  hyper
ggaagtttttgctcccgagcgagtcagggacgggagcaggcacgcacagtcgcgtaagtgtatgaaatgacgacctcagaagggcgcccagggacatgggtttggcagccccgagcggaggccgccaggcagccgtt

SEQ ID NO: 85609 - DNA, 688 bp, Homo sapiens
  chr2:179278181-179278869
  hyper
caaagtgctgggattacaggcgtgagccaccgcccctggctcccccaccggcaatttctaaaatgtatcggtctcctcccaagcccttgttccttcatcccccacccggggcagattcagacaagcatttattttagttcctaagccgcgcggtgctcccagcttccgcgcctctgggcggcccacacccctccccatcctctcctccgcgccgccgtcttcgttgctcttgggtggccgcggcgcccgctccctctgaattcgccgggcagggatacagccgcccggggcctcttgctcgtgcttggttttccggaccttgcttcctaaagggtctttaggggttcccggactcctccgcctgggagcctctatccgcctgggagcctctatgcgccccgcaaagcccccggcagagccgaggggaggcttcattggcgacctggtggggcctcgcggccctgctccctgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtaagtattgatatcgtcctatagcattt

SEQ ID NO: 85610 - DNA, 19 bp, Homo sapiens
  chr2:179317038-179317057
  hypo
aaagcgatttgttgttttg

SEQ ID NO: 85611 - DNA, 71 bp, Homo sapiens
  chr2:179413207-179413278
  hypo
ggattcgggcaccaccgtcaagaagaggggcatcccacatcaatgtagcagatccccgggtcacatctttg

SEQ ID NO: 85612 - DNA, 30 bp, Homo sapiens
  chr2:179440837-179440867
  hypo
ccatctcccgttctacgatttcaacatctg

SEQ ID NO: 85613 - DNA, 38 bp, Homo sapiens
  chr2:179564040-179564078
  hypo
gttataccttaaccacggttcctaatcatacttgatta

SEQ ID NO: 85614 - DNA, 30 bp, Homo sapiens; identical to SEQ ID NO: 39721
  chr2:179672126-179672156
  hypo

SEQ ID NO: 85615 - DNA, 195 bp, Homo sapiens
  chr2:179893525-179893720
  hypo
cagtctaaattccaacgtctattaatagtctccaaatacttattttaactccccaaatttcccattcaagtccatcccacatatagttataaaggcaaccttcgtaaaactctattttgttaaatctacccccgctttaaaaacccactcttggccacaatcaaatctaactgtgtagcccggtgggtactgcca

SEQ ID NO: 85616 - DNA, 284 bp, Homo sapiens
  chr2:18011883-18012167
  hyper
actggctgcagatcccgcaaccctcgggtgttcaagtgcgcggggtggtgcgggcgctcccgcagtccgcgcttggctcgtgggaggcctcgggcgccccctccaggattccgtgctaactgcaaacgatcgcgctcgcagggaggcccccagtgcttggaaaactccaggaatcccttcagagcactttatttccaggccagcacgcggcgctctgcagacctagtactgggctgtggataaggaagagcagagcggatgggttacgccgaggatgcccaggc

SEQ ID NO: 85617 - DNA, 1227 bp, Homo sapiens
  chr2:18058914-18060141
  hyper
gggcagctggcagggcgtatgctgcgggtaggaacccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttac

SEQ ID NO: 85618 - DNA, 309 bp, Homo sapiens
  chr2:18060617-18060926
  hyper
tgcagctgtgctaggcgccccgcgacagttgcagggaagagcgaacccagggcccttgctctcgtgcagcgctgcgccctgggtggggacggcgtgaggcttgcagcgcaggtgtggagtcacttgcggactctgcgtttggatcagtggcagtggtggggaagggtcaccccggggtcaggaactcctcttttttttttcgcgcctttctgggtggctgcccgacctcctgaggcaccttggctagcaagcgagccagtcttgccggcaggggccgcggcgagcctggctgggcgcctttcgcattgc

SEQ ID NO: 85619 - DNA, 1539 bp, Homo sapiens
  chr2:180725172-180726711
  hyper
ccctccccttctcctcgtcccttccgcagtcccacagtgtcctcccacccttccctgacaccttcaccagcgcttagtggccgaggccgcccgtcagggctcccaacaagtgcaaacttcggggaccttctctctgctcctctgcccccatctcatctgggttctgctgcagaactctcccacgaccccaagcttcgaccgctaccctcctcacacacctcggtcccctaactacccatttcccggtcattgagagaaagacaaaccccaaacttccagcccaggtgacgaggcgctgcggctaaacatagcggggcactctcctcgtcctttcccctctccatccgtccttgggaattggagcctaccctggggaacagaggagtatgctcctgtggcttccacgacctaatcctaactccagggactcgcaggagttaggattaggtcgtggaagccacaggcgcctgggcgccctcctctacaagtgggaccttgagacaaagtgcaaactctaccgggaggggggctcctggccattccctcgggcggcgcgcccaggtgcaggctcgctctgcggaggagggcgggggccgggcaagcagagggcgcccagtccgggggcgccggtctgggctgggcgcccagagcttacctcggcgcgcgggccgcgggcgcgtggggcagtggctcctccagccgggaagctgttgctcacgctccggtggttgctgcggtcccgccagggctgcaccggggcttcgcgcagacgttctcccgcgatctgctgcagcccaggcggtggcggtggcggtagcagcggcggcggtggaggtggcgcgggcgacagctcggcccggcgcggcccctgaactgtccaactcttgcccgcgccgggcttaagcgcccggccgctgcccccgcgctgagcgcctgcgcaccgggcctcgcccaggtgaggggcgtgtgcccggagcccgctgggcgcgcccggcccggcccggccccgccgcacgcccgcccccctggcctggccgaggaccccggggtttggacgtgccaacgccactctcgcgcgccgaagctgtgacggtttactaagcagagacttgcgaggcacacagagagggaatgaggcggaaccgttcgggggctcgttgacactgcagagcctcccgcagcatcgctgccttaaatcccgcctttccaggcgtgcgcgcacagcgagccagaggaggctccgtcccgacctggggtcccccgcggtcctcagcccgggggctcgggtccccgaagagatccttggcaatggcagaggtcccaaagcctagatgccaagccccgcgatggggcggatgcttccaatattagtcaacccagagtgaaactctcttcttggagatcgtcagaccaactatttgtttttcctctttgaccacccctgggctagcagagcacagctagcagcttcggcatatttggcggagccgggaaggcccggagcgcaagaaggcatcgcagcctcgcagcagatctgaa

SEQ ID NO: 85620 - DNA, 183 bp, Homo sapiens
  chr2:180886727-180886910
  hypo
tatcactccccacatcgcgagggaggggatgtacaccgcccgccgccacgcgaggtggttcgtaatatccagtgggggagagggtgatatcacacccacatcgcggggggtgggagggcatgtacacaggatattatgttggttgaggttactgactctgaggcaaggcggccagaatatgta

SEQ ID NO: 85621 - DNA, 30 bp, Homo sapiens
  chr2:182059306-182059336
  hypo
atacatgttaggctacgagcagctgtacag

SEQ ID NO: 85622 - DNA, 39 bp, Homo sapiens
  chr2:182116902-182116941
  hypo
tgggattataggtgtgagccaccacgccaggccaatttc

SEQ ID NO: 85623 - DNA, 195 bp, Homo sapiens
  chr2:182155914-182156109
  hypo
gggcatacaggttggcgccaacccaatccaaaccaccggtctgagcaggaatgctgtgggtggggtttgagttttaaacgaagagatgctaggtagaaaaagtaagagaattttatttatactaaattcttctttctttccctaaactatgattcatctaaagcactagctcatccccatcgatgctctttaaac

SEQ ID NO: 85624 - DNA, 30 bp, Homo sapiens
  chr2:182303713-182303743
  hypo
ctgaccttctctgtccgcctatctgaaatg

SEQ ID NO: 85625 - DNA, 481 bp, Homo sapiens
  chr2:182321357-182321838
  hyper
gcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctggg

SEQ ID NO: 85626 - DNA, 154 bp, Homo sapiens; identical to SEQ ID NO: 257
  chr2:182322038-182322192
  hyper

SEQ ID NO: 85627 - DNA, 696 bp, Homo sapiens
  chr2:182322399-182323095
  hyper
cgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtgg

SEQ ID NO: 85628 - DNA, 160 bp, Homo sapiens
  chr2:182387465-182387625
  hypo
attctttatcaaattcgctcatcttttgtccagggaccacaccttcataccaatagtgacctttgacctctcacgaatatctgttaccttctttctctagtgtttgcgctacttgcaaaagtaacagtggaaactcagatattcacggacagtattttta

SEQ ID NO: 85629 - DNA, 30 bp, Homo sapiens
  chr2:182388455-182388485
  hypo
gtggcatgtttacatcgaaatgggcatgtg

SEQ ID NO: 85630 - DNA, 89 bp, Homo sapiens
  chr2:182395490-182395579
  hypo
taggtagtattcttgcgtggaaggaacaagcatggttggaaagttgagatagacccagggtctatcccatatataaacatgttggccgg

SEQ ID NO: 85631 - DNA, 148 bp, Homo sapiens; identical to SEQ ID NO: 39723
  chr2:182422221-182422369
  hypo

SEQ ID NO: 85632 - DNA, 271 bp, Homo sapiens
  chr2:182521375-182521646
  hyper
cacggggaggggaggcgagaaaaggggagggtggagcaaaagctcgtgggtgtaggccttgggccggggagagggaggaagcgcggagggaggcgaagacgcttggggccgggcactcacccgccgggcgctcgggctgaatgggccgccaccgcagtgctcgctcgctcagcaccacgtcacaactgtccctcccgatctcgaagatgccccggagcagaatccgctcggccgccgcctccgtctgctgcggggacgttaacagcgccgg

SEQ ID NO: 85633 - DNA, 171 bp, Homo sapiens
  chr2:1825400-1825571
  hypo
cttgccttcagtggccggagtccttggctgttcacgcatacatcccagacattggtgcctggaggccctttatcttgaatctgttggttctagagaagaggcccctgctctgtctggagtggcggggagtggagaaggcagaggagcaggaggagccgctggattcccgga

SEQ ID NO: 85634 - DNA, 37 bp, Homo sapiens; identical to SEQ ID NO: 27763
  chr2:182542469-182542506
  hyper

SEQ ID NO: 85635 - DNA, 16 bp, Homo sapiens
  chr2:182542848-182542864
  hyper
gcggcggaggcttaac

SEQ ID NO: 85636 - DNA, 453 bp, Homo sapiens
  chr2:182542865-182543318
  hyper
tggaagacatgggagctgtccatggtaccgtaaggcggactgggcagcccaggcgactggtaggagtaggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 85637 - DNA, 344 bp, Homo sapiens; identical to SEQ ID NO: 27765
  chr2:182543758-182544102
  hyper

SEQ ID NO: 85638 - DNA, 188 bp, Homo sapiens
  chr2:182544428-182544616
  hyper
gggcttttcaaagttcgcctcaaacctccctttaaaagattgagtaattataatggtcagcgattggcaaccgcgaagttgccgcttctagtaaggaaaataaaaagcctttagtaaaacaactgaatttctggctccagtagtggctgctggggacttggccgcctctggagcggtaacaggtagca

SEQ ID NO: 85639 - DNA, 755 bp, Homo sapiens
  chr2:182545193-182545948
  hyper
taaccctggggcctccggacgccgcgcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattgg

SEQ ID NO: 85640 - DNA, 84 bp, Homo sapiens; identical to SEQ ID NO: 2141
  chr2:182546001-182546085
  hyper

SEQ ID NO: 85641 - DNA, 243 bp, Homo sapiens
  chr2:182546292-182546535
  hyper
tggggacttctttgacggttgtattctgccttttaaccatggccactgggttgctggaaagggcaccctcactcagccagtccagggacgcttctggttccctggccagcccgccctggacggcctcggctctctagtccaggcattgaccacaagtacggtggtggacacctcgccacagccggacctgcgctcttgctcccctcagtctcgggtctgtataagatacttgattcagacaag

SEQ ID NO: 85642 - DNA, 189 bp, Homo sapiens; identical to SEQ ID NO: 27770
  chr2:182547199-182547388
  hyper

SEQ ID NO: 85643 - DNA, 495 bp, Homo sapiens; identical to SEQ ID NO: 259
  chr2:182547437-182547932
  hyper

SEQ ID NO: 85644 - DNA, 728 bp, Homo sapiens
  chr2:182548061-182548789
  hyper
cgagagaagagagtcagccggatcccggagaggacagagctgaaggcgcggcggggcttagcactgaggaccttctccgcggccccgctcctcctccttattttcttctctttggacttgtttggacggttgcacacttttccccctcctgattccctaagttttttgtctctcccctcgctgcccgttagctgtactcccccagctcccgtccctactgggcgctgcaggctacccagcggcacgcgaaccgcacgcgcggacaacaaaagcctctttcatgactcactgccctcgagcaatgccccaaatctgccgcctcccgggtccccgctctgagcgcgcggcgcgggccgggcgtcccggccgttacagcggcagccggagcgcccgcgggaaggggggcgggaggaggcgtgtggccaggggtggggagaggggagtgtggcctgggccgggcggaggggaagggggaggcatgtgggaggatgggggtggggaagggatggaggcgtgtggcccggacgtagggggtgggaagcgtgtggctggaggcgaaagcggggagcgggaggtcgggggcgaagcattcacagggccaagataaagcgcaggggccgggccggcgtccctggcggtgacctgtttctcagggaaacagatgctcgctcttgcaaagggaggtttgcgttcaatgaaaggatcaagtgtggccagggcagcccggc

SEQ ID NO: 85645 - DNA, 207 bp, Homo sapiens; identical to SEQ ID NO: 27774
  chr2:182548819-182549026
  hyper

SEQ ID NO: 85646 - DNA, 508 bp, Homo sapiens; identical to SEQ ID NO: 27775
  chr2:182549037-182549545
  hyper

SEQ ID NO: 85647 - DNA, 131 bp, Homo sapiens; identical to SEQ ID NO: 27776
  chr2:182549876-182550007
  hyper

SEQ ID NO: 85648 - DNA, 71 bp, Homo sapiens; identical to SEQ ID NO: 27777
  chr2:182550053-182550124
  hyper

SEQ ID NO: 85649 - DNA, 319 bp, Homo sapiens; identical to SEQ ID NO: 27778
  chr2:182819030-182819349
  hyper

SEQ ID NO: 85650 - DNA, 159 bp, Homo sapiens; identical to SEQ ID NO: 27779
  chr2:183731173-183731332
  hyper

SEQ ID NO: 85651 - DNA, 640 bp, Homo sapiens; identical to SEQ ID NO: 2146
  chr2:183731466-183732106
  hyper

SEQ ID NO: 85652 - DNA, 17 bp, Homo sapiens
  chr2:183991037-183991054
  hypo
tgcgccttctactgtgt

SEQ ID NO: 85653 - DNA, 220 bp, Homo sapiens
  chr2:184406833-184407053
  hypo
taaatatcctttatacgctccatctttctgtatgattaacagtttatggttttataatcaactatgctaagttctagaagcagttataaaattttagatgaatgaaatagttgcgtcacacacagattcttggaagtgtttgaatcgcatgagtattgtttgaactgcataatagttaattttatgtgtcaatttgcgtgagccacgggctatcgattaa

SEQ ID NO: 85654 - DNA, 68 bp, Homo sapiens; identical to SEQ ID NO: 39471
  chr2:18453289-18453357
  hypo

SEQ ID NO: 85655 - DNA, 1197 bp, Homo sapiens
  chr2:185462620-185463817
  hyper
cacttgtactcgcatcgccacaactaccctcccccgaaactatcatcaacacaagcacttacggtatctacaaatgtgtgggagcaggggtgggtggggggcatattttctttcctcgcctttccctaagactgaacagggtaccagcctccataccaaacacacattaaataacaaaatcaaataagccaaacccagtggatagcaattatcttgagaaagaagccgctgctggcaccggcctggattcgctgcagtcggaagcgggtggctttcggtattgaattattaatttatttatccccctcgcccccacccccacgccgactgccaggcaagaaatcgcggcctcttcgcttcctctccgcccccaccttccaggagtctcccacttggcggtggccgtcgcgtccccggccctctgcggcagcggcgccgcgcggggcgctcccactcgcgctcgggctggcgcggccgcgggtcccggcggcggggtgggcgggggaggcagcgggtgacagatgtactcctctgacagctctcagtatcagcccagtggctccctgccattggctcagtgcaatggaccggcaacgccgctcactataataacactcatgcctgccagcagcagcaactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaagggagttttccggggccctctcagcaagaacgggaacaaaactctggtaatcgcttctgttttcct

SEQ ID NO: 85656 - DNA, 96 bp, Homo sapiens
  chr2:1858658-1858754
  hyper
caacgtcctcactagcgcccagagcagagacatgctggaaacactggctgtgtctccctgagataaccagcccccggttttcgggggtggtaattc

SEQ ID NO: 85657 - DNA, 210 bp, Homo sapiens; identical to SEQ ID NO: 27782
  chr2:186603443-186603653
  hyper

SEQ ID NO: 85658 - DNA, 132 bp, Homo sapiens
  chr2:1880288-1880420
  hypo
gcctacccctcaccccggcaacctttccccatggcccgtggccagagtggacctctgggtgactctcctggatgctgttcgcccacactgagtccccgcagctgaccctatgcgtgccgccattgaaacctc

SEQ ID NO: 85659 - DNA, 141 bp, Homo sapiens; identical to SEQ ID NO: 39725
  chr2:188235961-188236102
  hypo

SEQ ID NO: 85660 - DNA, 146 bp, Homo sapiens
  chr2:188418955-188419101
  hyper
atgtttttttcaaaacggagttgaggttattttgtttttccttccaggtattgaagacaggatttatcttctctacttcttcttttagaagcagatcaagaaactggcgattgaagagtaactgaaagaaacgcaatctgatctta

SEQ ID NO: 85661 - DNA, 91 bp, Homo sapiens
  chr2:188809066-188809157
  hypo
aggctactttcttcccgtataccatttccttgctgctcttcttttgtttttctcttcccaatctttgtctcatatgttttcagggcccaaa

SEQ ID NO: 85662 - DNA, 36 bp, Homo sapiens
  chr2:189075849-189075885
  hypo
ggaattacaggcatgagccaccgcacccggtctgtg

SEQ ID NO: 85663 - DNA, 30 bp, Homo sapiens
  chr2:1891322-1891352
  hypo
acctccccgggataccgtctttcttctaga

SEQ ID NO: 85664 - DNA, 210 bp, Homo sapiens; identical to SEQ ID NO: 27783
  chr2:189156634-189156844
  hyper

SEQ ID NO: 85665 - DNA, 30 bp, Homo sapiens
  chr2:189157587-189157617
  hyper
gagcccttgggttctcgctccgactgctaa

SEQ ID NO: 85666 - DNA, 41 bp, Homo sapiens; identical to SEQ ID NO: 39399
  chr2:1893020-1893061
  hypo

SEQ ID NO: 85667 - DNA, 32 bp, Homo sapiens
  chr2:189764815-189764847
  hypo
ccaacaagattgaaacgcgagcaagactcatc

SEQ ID NO: 85668 - DNA, 75 bp, Homo sapiens; identical to SEQ ID NO: 27784
  chr2:190445180-190445255
  hyper

SEQ ID NO: 85669 - DNA, 35 bp, Homo sapiens
  chr2:190446074-190446109
  hyper
ctggccgtcccattccggcccgcctgcagcagaga

SEQ ID NO: 85670 - DNA, 120 bp, Homo sapiens
  chr2:191045074-191045194
  hyper
ccaaggcaggccccgcgggggagaggccttggagggcagcgccccctctcaccagggcggagctcaggagagttcgcagcccagggggccgagaccaggggcagggccagcgaaatgcct

SEQ ID NO: 85671 - DNA, 51 bp, Homo sapiens
  chr2:191045258-191045309
  hyper
cgggtctgttcccgctgcggcgccggcagctgcttggtagttgcggggggc

SEQ ID NO: 85672 - DNA, 195 bp, Homo sapiens
  chr2:191045310-191045505
  hyper
tgagggcggtggcccagaccaaccggctggcagcccagctccgctccgcccgcccctgcctcggaccctgcgcctgaggaagtatcgaggcaaccctctgccacccgaagttcgtgggtcgctcccagagggcgcgccctggagccgagcgcccttgggcggccatctggaggccaggtgcgggccgcgaacccg

SEQ ID NO: 85673 - DNA, 55 bp, Homo sapiens
  chr2:192015371-192015426
  hyper
ctcactttcagcctccgcgaggacacacctccgcagccgccgcagctcccctggc

SEQ ID NO: 85674 - DNA, 126 bp, Homo sapiens
  chr2:192110177-192110303
  hyper
gaggcagtaccagagcgcgcggcgcgcagtcggccggcagccgcgggacagccttggcagaacagccgcggcgggagccccgcagccccgggctgggcccgcgtcccggagcgccaccggagagcg

SEQ ID NO: 85675 - DNA, 307 bp, Homo sapiens; identical to SEQ ID NO: 27787
  chr2:193059011-193059318
  hyper

SEQ ID NO: 85676 - DNA, 205 bp, Homo sapiens; identical to SEQ ID NO: 27788
  chr2:193059344-193059549
  hyper

SEQ ID NO: 85677 - DNA, 56 bp, Homo sapiens; identical to SEQ ID NO: 27789
  chr2:193059661-193059717
  hyper

SEQ ID NO: 85678 - DNA, 1228 bp, Homo sapiens; identical to SEQ ID NO: 27790
  chr2:193059718-193060946
  hyper

SEQ ID NO: 85679 - DNA, 40 bp, Homo sapiens
  chr2:193061440-193061480
  hyper
tttatcttacatctccgcctccgtccgagactgtccctct

SEQ ID NO: 85680 - DNA, 97 bp, Homo sapiens
  chr2:193363553-193363650
  hypo
ttagtgagacgaccacgttgaaacggctccccggcaaaactccagctgggctttgcaccgggaagaatgcacactggggtggagccacagaagttca

SEQ ID NO: 85681 - DNA, 36 bp, Homo sapiens
  chr2:193363710-193363746
  hypo
aactgcaaagcgggaagcacacgagcaaggactctg

SEQ ID NO: 85682 - DNA, 42 bp, Homo sapiens
  chr2:1941410-1941452
  hypo
aggccctaacatccgcggccatcagatcgcacatcgagaagg

SEQ ID NO: 85683 - DNA, 39 bp, Homo sapiens
  chr2:1946870-1946909
  hypo
cccggtccccctcctcgtcctcctcgtcctcatcccctg

SEQ ID NO: 85684 - DNA, 30 bp, Homo sapiens; identical to SEQ ID NO: 39400
  chr2:1950712-1950742
  hypo

SEQ ID NO: 85685 - DNA, 292 bp, Homo sapiens
  chr2:19550039-19550331
  hyper
gccagcagggggcagcgtggctctgagcgtggaggccagggctggtccgcgccggcagggccagcctccagtgcccagttgggttcccgggcctcgaagttctagcccgcacaggactcaggagcgttcccggaggaggtggggatggggtggtgaaagcccagagcgttttaacttctgcatcccctgccgctttctcagccagcagggcccggcttgaggctgggatttttggtgcctgcagcagggaagcttatagtccagttgtcatccgcggccgccgcgctccggg

SEQ ID NO: 85686 - DNA, 287 bp, Homo sapiens
  chr2:19551162-19551449
  hyper
cgtccagcagagaaacctggtcctctcaaagagaggacccaaccggtttcctgcgtttaggagggaaattacccatcctgcaatgcctgtaaaataaccgtttatttaatagttaaaaaaaaaaaaaactccagtgataaatgtccgttaccgatggtcagcataaagtgccaatcgcaatataacgcccggctcttggctggctgctccctcgcagtgtcgcggcagcggaggccgggccccctgcagaccccaggcccgaggtccccgtcccgctctcctagtcc

SEQ ID NO: 85687 - DNA, 157 bp, Homo sapiens; identical to SEQ ID NO: 27071
  chr2:19551499-19551656
  hyper

SEQ ID NO: 85688 - DNA, 34 bp, Homo sapiens
  chr2:19555853-19555887
  hyper
ccaaggccaagccagcggccgtggctgtgggact

SEQ ID NO: 85689 - DNA, 354 bp, Homo sapiens
  chr2:19556318-19556672
  hyper
ggatgagtgagcccccggctcctccggctccggtttcccagaccgcggaaccccagggcgaatactttcgatctttaaacacaggatggaaaacccttccccaggctaggcacccattcctcaaacagcttgggcctcaggacctgcgggaaagaataaggggacccgaccacgcacagcagacgcaattcgcgctcgggatcccgagtccctgcgcagtgcgggcactcgcgtccctcgcgcggtggagcgccaatcccaggtctgcggccagtcctatgctgggcattaatgaagtgtgcagagtctattaaagtggtttattcggggctaattgagcgtgagcaagttaac

SEQ ID NO: 85690 - DNA, 118 bp, Homo sapiens
  chr2:19556980-19557098
  hyper
cgccgccggtcgctgctagtcccctccagcgcttctcttccctagggggttgtgaacctgggacacctagccttgcacgtggttttgttccgcagagccaatgcgcagctcttagcct

SEQ ID NO: 85691 - DNA, 30 bp, Homo sapiens
  chr2:19557459-19557489
  hyper
cgctccaggccttgacgacacagagcaatc

SEQ ID NO: 85692 - DNA, 80 bp, Homo sapiens
  chr2:19557961-19558041
  hyper
aagtcctacagcattcgtttggcaagagcttccttcaggggcattgagagagaggaggcacccgccgagcagtgacaagg

SEQ ID NO: 85693 - DNA, 603 bp, Homo sapiens
  chr2:19558381-19558984
  hyper
ctcatcccttagcaccgagccgcctacttattttaatccaccaccctccctcctccaccacccccacccccgccccttgcctcaggattcctcccctccctcccctgccccccaaccctgccctgcgcctgcgcaatgaaagacaaagtttttgctgacccgggcagcagactttggcagctgctctcgcttggacccggcctctcccaacctgcgtcccctcctcttcagtcccgcgcgacccctgctgcctttttaggtccagagcggcacgcctggcgcactggaggaaacggtccctagcagatgagagcgggctggcaccgcacgtttcgaggtcctatacttgggctcctaggacacagcccgtgctctttgggaggagggagggaggggcagtagctctgtgcaccgggatccccacaccgcggcttgggtttcaacgcactttggcgcctgacagagtcgcatctcctcccagaatctctttccagaggcggcagaccccgagtgtggagcagctcctggctatccaagcgtgctcggggccagggtgttaacccaggcagcgctggttaattcctggtgcgggagggccagggt

SEQ ID NO: 85694 - DNA, 402 bp, Homo sapiens
  chr2:19561071-19561473
  hyper
ttgacaagggaaggacgcaggacacctaagagcaacaagggtactttttaagcgaggttacatgtgtttaggactcgcgaggacgtcacgtttcgaatttggtaaaagtcctcggtagctaggacccaacagttctgccctcctggaaacccaatgaaggtgacaaaactcccatctcattactgggagtccagcgcactccgccaccgcggctgcagcttctgctagctcggagcctgcggactccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtc

SEQ ID NO: 85695 - DNA, 184 bp, Homo sapiens; identical to SEQ ID NO: 27078
  chr2:19561523-19561707
  hyper

SEQ ID NO: 85696 - DNA, 122 bp, Homo sapiens
  chr2:19563311-19563433
  hyper
ctgcatttgcaagctcggtccgcgtgcccctcccggcacacccggaggtgagaagtgccctccggtgcctccgtccgcagcccctcgtaggtctgcacgtcctgcttcggatcccaaatcct

SEQ ID NO: 85697 - DNA, 75 bp, Homo sapiens
  chr2:196302358-196302433
  hypo
gccgcaggtcacttcagctgtgaagcccggtaggagccctctgggtgtagccctgcctgccgggtggagccccgc

SEQ ID NO: 85698 - DNA, 78 bp, Homo sapiens
  chr2:196319761-196319839
  hypo
atctttaaatcatctcgagttaattttcgtgtattttgtgtgtagtaggaatttaacttaaaagttgtttccctcctg

SEQ ID NO: 85699 - DNA, 156 bp, Homo sapiens; identical to SEQ ID NO: 39401
  chr2:1972852-1973008
  hypo

SEQ ID NO: 85700 - DNA, 33 bp, Homo sapiens
  chr2:197298088-197298121
  hypo
cgcatctggggatttcgacgcctcacaaaaagc

SEQ ID NO: 85701 - DNA, 1352 bp, Homo sapiens
  chr2:197457183-197458535
  hyper
agacctctgcagtctcgcgtcctcggaaacgtctacgtctaaatctgcagccccagtttgctccaggccccaagctccagcagaggatgttcacggcacattcccaaccaaaaaggaaatgaagcgtcctctccctcaactgatgctcaaatagaccccaaagtcccagtttccctggagaaccaaaccatccaacacatcctgggcagcggaaaccgaaatggcaaatgaatgaccgcgccggggcgcaagggaggaaaaacaaagccacctcccgccgtccgctacctgcggcgagggccgcgcgctcacctgggctttgcgcccgtcgccacaagctgcgggtggggacccggccgcggggcgggagggcgcccccaaagtcgcccggacccgcggccccggcgccctgcggccggtccgtgcgcgccgaggagaaagcaggcggccgggggcgccgccgcgcgttgcatgcagctcacggctgctgcggccgctgccacggagccgagagtctctgcgctgcagtccccgaccccgagaccgcgagaagcgcccggagagacgcggcgcaggggcagagcgcgctcggcgcgcccctcagcggctcttcccgccgccctccgcagcgggctgggtctcggctcgcctttgtgctggcatcttcctagctcccagcgacacccagagctctcgaggcggctccgcgccgccacccacccccgggttacgccacggcccccgcgcgacccgccgattgtgtcgagtcagcagcggcagcggggacgcgcgaagccatggctcccgcccgcgctcgggagggcgccgggggtcctgcgcctccgggaggtttgtggccgagcgcggcgcggccccgagcggccccgcagcgcccggctccccgccgctcgctctccaggcgccgacccgcctgcgtcgccaccctctcgccgctccctgccgccaccttcctcccgcccgggtgccgggcgtccgctccagccgcggtgccccggtccgcggagagcgaagagtccggcctcctcacctccagccgcgccggcgcccttcccgctagacgcttcggcggcatctgcccgcaccgccctgcgggacgctgggctgggagctggcggcacgtcggggaccggtggaagggaggcgggggcagaggacaggagggacagccagaccttggccagcgggacctccctgaggaaggtgcggaagaacggggcgggtgcggctgggcggaggacgagtcccgaggctgcggcggagcctgagttgctctccttctgcgaagtcgaaggacaggaggattcctagaggtgtcgcggagggtggaggag

SEQ ID NO: 85702 - DNA, 30 bp, Homo sapiens; identical to SEQ ID NO: 39728
  chr2:197503336-197503366
  hypo

SEQ ID NO: 85703 - DNA, 26 bp, Homo sapiens
  chr2:197503796-197503822
  hypo
tccacccttggcgacagaggaagacc

SEQ ID NO: 85704 - DNA, 185 bp, Homo sapiens
  chr2:198174643-198174828
  hyper
tagacacaggcagaccgtagcccaccgcctgtgagtggaggctccgagccgacttcacctcctcctcagagggaccggcccgatccgaaagggcggtctccaggggtccccatcccgcaccacgcacacagcctggcgcaactaaagaggaagtcggatgtcacatccaacggataaataaagac

SEQ ID NO: 85705 - DNA, 37 bp, Homo sapiens
  chr2:198317068-198317105
  hypo
tacaggcgtgagccaccgcgcccggcccattttctcc

SEQ ID NO: 85706 - DNA, 88 bp, Homo sapiens
  chr2:198456603-198456691
  hypo
cttgcaagcactgtgcgcagaactggttcctgccccgtgcctctccctccacgcctctccctccacccctccctgcaagccgagggag

SEQ ID NO: 85707 - DNA, 142 bp, Homo sapiens
  chr2:198651498-198651640
  hyper
gccccaagcgggtcccggccccgctgagcacctccagcagtggcacagcctctggaggggtccgggacgaagccacccgcgcggtagggggcgacttagcggtttcagcctccaacagccttgggatcgcctttggaagaag

SEQ ID NO: 85708 - DNA, 35 bp, Homo sapiens; identical to SEQ ID NO: 27793
  chr2:198670222-198670257
  hyper

SEQ ID NO: 85709 - DNA, 30 bp, Homo sapiens
  chr2:199113318-199113348
  hypo
cacaaagtaccctaacgcattgactactca

SEQ ID NO: 85710 - DNA, 115 bp, Homo sapiens
  chr2:200321883-200321998
  hyper
gtgaaaggaaggatgcgagatgaagacacggagcaggagggctgagggcgaggcttccgcctgcattccccgacttcgcggtccgagaggccgagagcggcggggaggggacttc

SEQ ID NO: 85711 - DNA, 113 bp, Homo sapiens
  chr2:200322498-200322611
  hyper
gctcgcgaggaggcgcggccagagcggtgggaccggtaacaccaagagccgagaagacgcagggacccgggaccgcgcgcgggaggaaacgcggcggccgcccaagctgtcac

SEQ ID NO: 85712 - DNA, 30 bp, Homo sapiens
  chr2:200326625-200326655
  hyper
tgttgtgcgtgctttcgaccctggtcaacc

SEQ ID NO: 85713 - DNA, 92 bp, Homo sapiens
  chr2:200326868-200326960
  hyper
ctcaaccctggaacacgcagggaaaactatgggaatcgcccgcgtcaaaagctttcgacggcttctaggaacccaagcgggcctgcctcttc

SEQ ID NO: 85714 - DNA, 15 bp, Homo sapiens
  chr2:200327239-200327254
  hyper
cgtctggggactgac

SEQ ID NO: 85715 - DNA, 29 bp, Homo sapiens
  chr2:200327423-200327452
  hyper
ggaggtagagactgtggaggtcctcctcc

SEQ ID NO: 85716 - DNA, 219 bp, Homo sapiens; identical to SEQ ID NO: 27796
  chr2:200327575-200327794
  hyper

SEQ ID NO: 85717 - DNA, 222 bp, Homo sapiens
  chr2:200328171-200328393
  hyper
ggcccaaggtggctgcgaagagccccgaggcctcggcttggcgtcaatgtcccgccaccctcgagcccgggtcactgcccgggtcccggcccggagccccagcgtcctctcccgacagcgccaccgcgtgggctgaggccgaaaccttcggcgccggctctgccggtcgcgtcccggagccaacccttccgcgtcgcctgcagtccacgggttaaggatgtg

SEQ ID NO: 85718 - DNA, 18 bp, Homo sapiens
  chr2:200328667-200328685
  hyper
gaggctatgggcccacgc

SEQ ID NO: 85719 - DNA, 365 bp, Homo sapiens; identical to SEQ ID NO: 2153
  chr2:200329029-200329394
  hyper

SEQ ID NO: 85720 - DNA, 313 bp, Homo sapiens; identical to SEQ ID NO: 27800
  chr2:200329432-200329745
  hyper

SEQ ID NO: 85721 - DNA, 30 bp, Homo sapiens
  chr2:200331923-200331953
  hyper
agccctcttgttggccggtggctaaggagc

SEQ ID NO: 85722 - DNA, 25 bp, Homo sapiens
  chr2:200333734-200333759
  hyper
gaagggactggtctgcgtgcctcac

SEQ ID NO: 85723 - DNA, 34 bp, Homo sapiens; identical to SEQ ID NO: 27802
  chr2:200333800-200333834
  hyper

SEQ ID NO: 85724 - DNA, 252 bp, Homo sapiens
  chr2:200334149-200334401
  hyper
taggaaagccagccccggcatcgctcactactcctgcacctcagctctgggatacccgctcagtacagacagaccatcaaccaaaaaagaaaagaagaaaagaaaagtggtggtgggggtgggggtgggcagggagcgtaaagtagcgagatcacttatttgactcttctgttttcttaggaacctgatcctggcccccggcagagcataagggcccgaggccagggacctagaggccggaccaagttcgcg

SEQ ID NO: 85725 - DNA, 267 bp, Homo sapiens
  chr2:200334964-200335231
  hyper
cttccacacacaggtcgcagcccctgccgcggaggatccccaggaagatgctggggacgctctgagcatcggcctttctttacccccgactccctggagcttggtctcgggatgccaacttggggcacggaggcgacgggctgctccgaagctggagggtttctgcttgggtcagagggatcacgacctcagcagagccaggagaggttgggtgacacccactgcgtattgcacttgactcaaaactgccctcggcctgcggaagag

SEQ ID NO: 85726 - DNA, 15 bp, Homo sapiens
  chr2:200335437-200335452
  hyper
acaccagtgggtacc

SEQ ID NO: 85727 - DNA, 835 bp, Homo sapiens
  chr2:200335591-200336426
  hyper
cgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctgagatcagccctaatcccttggtaacttaagcgcctctgaactcggggagcgcttggtggggcgcctccctgcatccacccctacccctggctccttcccaggcccagcatctttcccaccattctcacccccaccacccccacggccccgcccgtttagaggcgtgcggtgggcacttggtttacagaaccggcgtttcagatgtttatttgcaactaatttcttgtgctggaaaatgcttgttacccgggcggagcgcttccgctctgcgcggtccggcccggcgggcggtagctcgctgatccctccggcgaagcctccaaggagcgggcggctgggagaggttgtgccacccgggaccaagccatcggcgctgctccggactcccggtagggggagccgccgcgggcgccaggccggattgtgttctggcctcggggcggccctgctgccagcggccgggactctcagcac

SEQ ID NO: 85728 - DNA, 311 bp, Homo sapiens
  chr2:200523986-200524297
  hyper
cctacacttggggaacgcggcgccccggccgccgcagagccgagccgagccaggcgagcccccgcggcgcccaagcgcgggccccccagccgccgccgggcgcggcatttttattcaagcgagataacggagcccggccgcgcccggtgcattgtgggaacggcccgcggcccgttttcgggaggaggcggagggcgcgaagcgagctggtggatccgtaaagaacccagccaacccccagagggaggggaggggctgagctgtgaggagagcggggcacaagaaccatgtgtacgcgggagtccttttaa

SEQ ID NO: 85729 - DNA, 159 bp, Homo sapiens
  chr2:200524603-200524762
  hypo
gtgacctctacgcaacgggggtcatggaatgcgacaatatgctgatgctcctcggagtcagtaataaaatgactgacagggaaagggataaagtgatgcctcagattatccaaggttttaaagacgcagctgaagacgcaggagcgtctgtaacaggcg

SEQ ID NO: 85730 - DNA, 477 bp, Homo sapiens
  chr2:20068489-20068966
  hyper
taaagccccgggcagcgcgtgacccgccccagcccagtagtggagtccccgccgcgggccccttgcttgcagggtaggtgtggcccggtcgtcccactctccgccccctcctgctcctcctcgccgtgcccaacccgcccgcttctcctgcctaggctcttctttctgctcctgtcgccatggccccggcctcggcgctcaagcgaccctctcgctccgcccaggtcagtgaaggatgggatgcaagtgcccgccaagccccccgtttcccacgtggagttcccacagggcagcagggaggggccgcgccttctctaactgacccgaaccgacccgggcttcacaggcttcgtggagagcagctgccccgccggcatcttccggatgaggctctctagacaacaaagccttctacgcggaagttactggtgacaggggaaggactcatgggtttttgcagcccggtgtccccaaaac

SEQ ID NO: 85731 - DNA, 30 bp, Homo sapiens
  chr2:200699425-200699455
  hypo
tgtgggaaaggaagacgtgtattatttgtc

SEQ ID NO: 85732 - DNA, 21 bp, Homo sapiens
  chr2:2007674-2007695
  hypo
ttgattcatgcctttcgtgca

SEQ ID NO: 85733 - DNA, 28 bp, Homo sapiens
  chr2:200818848-200818876
  hypo
agggtctcaccctctcgcccatgctgga

SEQ ID NO: 85734 - DNA, 253 bp, Homo sapiens; identical to SEQ ID NO: 27809
  chr2:201450490-201450743
  hyper

SEQ ID NO: 85735 - DNA, 178 bp, Homo sapiens; identical to SEQ ID NO: 27810
  chr2:201450744-201450922
  hyper

SEQ ID NO: 85736 - DNA, 65 bp, Homo sapiens; identical to SEQ ID NO: 27811
  chr2:201451013-201451078
  hyper

SEQ ID NO: 85737 - DNA, 30 bp, Homo sapiens
  chr2:201652312-201652342
  hypo
atggctcatgtcctgcgttaggctgacgca

SEQ ID NO: 85738 - DNA, 35 bp, Homo sapiens
  chr2:202041399-202041434
  hypo
actcagaccaagtgccgtggctcatgcctgtaatc

SEQ ID NO: 85739 - DNA, 337 bp, Homo sapiens
  chr2:20212448-20212785
  hyper
cggatttaaaggtcccgcggcctcgggccccgccccgccccggggcctcgagcgccaggccggcccggcgaaccccgcccaaggccaacaaggagccttgtccgcgcattccagcggcagaaacggaatgtctgggcgaggcggccagcggcgcggtggtcacctcccgcccctgccctaagccccgagccggctgcaactgggtgggctcggctgctgtcgcaacctccgtcctcccagtaacaccggggcagggggggcagccatccgcggctgcagcctgcccggccctccactctccctcccaccccagcggggcctgcgccccaggtacggg

SEQ ID NO: 85740 - DNA, 16 bp, Homo sapiens
  chr2:202490069-202490085
  hypo
gcgagactccatctcc

SEQ ID NO: 85741 - DNA, 39 bp, Homo sapiens; identical to SEQ ID NO: 39472
  chr2:20253274-20253313
  hypo

SEQ ID NO: 85742 - DNA, 132 bp, Homo sapiens
  chr2:202897471-202897603
  hyper
gaacgaggataaccccgctttgtgttttgaaaactctttaattagcctggtttctaagacgcattaaaacattcctacgcagattctaaatggaggatcaaatggttgcttctgcaacgaagatgggatccc

SEQ ID NO: 85743 - DNA, 364 bp, Homo sapiens
  chr2:202899687-202900051
  hyper
tgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgag

SEQ ID NO: 85744 - DNA, 6 bp, Homo sapiens
  chr2:202900071-202900077
  hyper
cgaacc

SEQ ID NO: 85745 - DNA, 30 bp, Homo sapiens; identical to SEQ ID NO: 39402
  chr2:2030884-2030914
  hypo

SEQ ID NO: 85746 - DNA, 234 bp, Homo sapiens
  chr2:203129128-203129362
  hypo
ccagacagaagggaacggccaggaatgctcacaaatatagtgacagtaatggtgtcattctgaggccttcgcctcaaggcagggcttgaaaggggataaagtctaatggcactagctggcatttcaaattctagatgcctgaggcagactggcaccgaaacagctcctcgtttctctcaaagtgaacatataattcatagagggttaacaaaataatatcgtgaagtttttccc

SEQ ID NO: 85747 - DNA, 16 bp, Homo sapiens
  chr2:203206750-203206766
  hypo
ccgtctcaaaaaaaca

SEQ ID NO: 85748 - DNA, 30 bp, Homo sapiens
  chr2:203231652-203231682
  hypo
gcccagctaacctgccgagactcctgacag

SEQ ID NO: 85749 - DNA, 41 bp, Homo sapiens
  chr2:203484358-203484399
  hypo
agttatcagagggactagccagttcccgaaacccccaatta

SEQ ID NO: 85750 - DNA, 215 bp, Homo sapiens
  chr2:20431241-20431456
  hypo
ggaggaggtgggatgcgatgaggcttggagaaggatgaaggagaggaacagtgcaatgtggaaaatccttggtgagggtccatttccacctggtttacgtaaacagctagcgtcagaggggccgaatcagtgtgtaaagtggctgcctaggctggggcagcactgggtgctgaagtcctttggtagatcaccccggggctcgtgactcagttcta

SEQ ID NO: 85751 - DNA, 142 bp, Homo sapiens; identical to SEQ ID NO: 14395
  chr2:20432683-20432825
  hypo

SEQ ID NO: 85752 - DNA, 104 bp, Homo sapiens
  chr2:20442320-20442424
  hypo
agggcgtcacccaggcgggtcagttgcttttttaaaaaaaattatttttattttttttatagggaaggcaggggcatctcgccatgtttcccaggctggcctcg

SEQ ID NO: 85753 - DNA, 44 bp, Homo sapiens
  chr2:20442484-20442528
  hypo
gcacagccacttttgcagctttctaaggccgcccccaggccctt

SEQ ID NO: 85754 - DNA, 30 bp, Homo sapiens; identical to SEQ ID NO: 14396
  chr2:20456198-20456228
  hypo

SEQ ID NO: 85755 - DNA, 37 bp, Homo sapiens
  chr2:205205376-205205413
  hypo
attatcatgtaagaattttgtacgtagccaaattttg

SEQ ID NO: 85756 - DNA, 30 bp, Homo sapiens; identical to SEQ ID NO: 39477
  chr2:20553860-20553890
  hypo

SEQ ID NO: 85757 - DNA, 33 bp, Homo sapiens
  chr2:20641885-20641918
  hypo
gcctcagttcttccacgtgaaataatatagcta

SEQ ID NO: 85758 - DNA, 33 bp, Homo sapiens
  chr2:20642218-20642251
  hypo
ggcatgagccaccgctcccggccaacttttcca

SEQ ID NO: 85759 - DNA, 163 bp, Homo sapiens
  chr2:20642613-20642776
  hypo
gcgtgagccaccgcgcccggcggaaatatttttaaattaaatgcctgtcaggaatgtctattgcattgctggttcctagtacatgaattattattacttctaactataccagagtatccagcaatggctttcttaactggggcaaaaacggaatgatttttgt

SEQ ID NO: 85760 - DNA, 43 bp, Homo sapiens
  chr2:20647266-20647309
  hyper
gcgcgtgtggcaagacgtgcctgctgatcgtgttcagtaagga

SEQ ID NO: 85761 - DNA, 81 bp, Homo sapiens
  chr2:206546689-206546770
  hyper
agctgccgaccggctcgctaccccaaacaccgtacgccacccaactcctcttgtaacgccatcgcgcgtggcattgtgttg

SEQ ID NO: 85762 - DNA, 789 bp, Homo sapiens
  chr2:206550029-206550818
  hyper
cagctccccaaaatgcgatctcaagccgtgagctgctcaggctttcaggcggagcaaagcactggcaccctgggagccggcagcgggtggccagggcgaggccaagccacatacctctgactcacccggtgtgcgccggccgggaagggggcctggttcagccgccgccgccggcgacgagaaccaattctgggaaggagcaagatggggcagaaggtgcgcgcgggggagcaactgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtgaagagcacgcggcgtgcggccatccacgtggtggggacgtgatagcccctcagctctcctcctagccctccctccccttccccgccccccagcgccttctctaacgccgcatcgatttgtttgggcta

SEQ ID NO: 85763 - DNA, 126 bp, Homo sapiens
  chr2:206550889-206551015
  hyper
cgaggctgaagcctccgcgaagttggccgcctccaactactccatgcttgtgccctcctcctcctcctcctcctaaggacacccccagggaaaagcctgcggcatttcttcaacgctgccctatgc

SEQ ID NO: 85764 - DNA, 292 bp, Homo sapiens; identical to SEQ ID NO: 27817
  chr2:206551071-206551363
  hyper

SEQ ID NO: 85765 - DNA, 30 bp, Homo sapiens
  chr2:206551450-206551480
  hyper
cggcttctgcggctccggctgaatttcttc

SEQ ID NO: 85766 - DNA, 187 bp, Homo sapiens
  chr2:206585987-206586174
  hypo
aaacacccagtttatcgagtatttctggttggttgtgttttttatgcttagagtgtctattatcctcctcaaaaatcctgcttccttttcttcttttaaaatctgaacataacgagtgaaatcaattctaattgtccagcactttcattcattgcgtgaatgtgcatgagctcgtgcttcgtgggtc

SEQ ID NO: 85767 - DNA, 106 bp, Homo sapiens; identical to SEQ ID NO: 39732
  chr2:206757186-206757292
  hypo

SEQ ID NO: 85768 - DNA, 30 bp, Homo sapiens
  chr2:206830630-206830660
  hypo
atttccctgaccttgcgtgccaaggcagaa

SEQ ID NO: 85769 - DNA, 30 bp, Homo sapiens; identical to SEQ ID NO: 39733
  chr2:206859091-206859121
  hypo

SEQ ID NO: 85770 - DNA, 105 bp, Homo sapiens; identical to SEQ ID NO: 27819
  chr2:207139050-207139155
  hyper

SEQ ID NO: 85771 - DNA, 1118 bp, Homo sapiens
  chr2:207139217-207140335
  hyper
cggagtggggccctgaccagggaggaagtgtccgctttaagagcttctggaggggaggaaggggctcctccgcccgggtgggagagtgagtgagtgggtgggcgggcagggggcggtcccgccgctcctgcgtcagaaggggtctggttttcgcaccttccctgacgtcaaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccaccccgcgtccctttctgcccctgctgcgtgagaggtgtcggcggctccgggccgggatcgaggtggcggggcgagggaaggaggtggggcgcaggctgcattgcgcttctgtccggggccctgggtcagaggggccggcggacgaggcctcgggtccgggcttggggagggggcggtctgcggggtcggattgagggccgggaacccgcggagtcttgcccctgggcacctgtggggccgagatcccgagccacctgtccacacacccccttcccccagtgccctgcgttgggtccagctggccccagacctaggcctttcccagcctcgggcgattatagtttatttgaaaacgtttgatttttgtgttaatgattcttttactaccgccgtgcaacagttgtgtaaatgtggtcgtgttacgccatcgtttttacttgctcctaagaagggccttaccagctcctgcgattatctcacgcgatgattcttggtagctcgtgaaaaaaatgca

SEQ ID NO: 85772 - DNA, 15 bp, Homo sapiens
  chr2:207307463-207307478
  hyper
tctgtattgcttccc

SEQ ID NO: 85773 - DNA, 1413 bp, Homo sapiens
  chr2:207307547-207308960
  hyper
cggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccctccctgcctgtctttccacccttctcgttcccaaaccccc

SEQ ID NO: 85774 - DNA, 39 bp, Homo sapiens
  chr2:207309199-207309238
  hyper
tgtttcctcaaatttcgtatccggcgcattcagtgcggt

SEQ ID NO: 85775 - DNA, 30 bp, Homo sapiens
  chr2:207398286-207398316
  hypo
acacaatattttccacgtaactaaagaaca

SEQ ID NO: 85776 - DNA, 619 bp, Homo sapiens
  chr2:207506691-207507310
  hyper
gcccttgctgagtgtcgagaggcagctcatgtccctcctccgaccccaagagtccacagtcttccctcacacccctttattctcggacgaggcccgtgtggtgagcgggaacccctgctgtcccctggaccagcgcggagctgggccctaactttgcagttcccgccgcatcggcacgcacccgcgaggtgggagcgggaagcccagccgcattagaggctcaattccggcaggtgcagagtgggtgcgggtcaaggccaatgagagtgtgtgtggccaagcccgctggtttcctgaaccgaaattctccggggagggagagaagaggagggtgcgggagacggacttggaggcgagaggtggcggcagtttccaggagctttgacgtagacttggagaggcgccgagcactcccactgcttaagtagaggcacggtagcctccaggacgcggaagctggggacagccactcgctcgggagcagcctgagcgtttcctctccgcgtactcgagggaactctctccacgcgttcgagggaacccggaaggggccaggcgggtgagtgcggagggaagcccttgtgccatctgggagtagagccgccgagtcaggaggtga

SEQ ID NO: 85777 - DNA, 107 bp, Homo sapiens; identical to SEQ ID NO: 39735
  chr2:207557814-207557921
  hypo

SEQ ID NO: 85778 - DNA, 514 bp, Homo sapiens
  chr2:208029820-208030334
  hyper
gtccctgtcagcaatcgctcctaacaccccaaaccaccttcccacccggctcctccgaaccccagaagttcggcaggtctctgataggggacagcaaacccgacaacgtgtgcgcagggatgtgtgttggcgactgaaacgcaggcagctcgcaccggctgctcagctcggcactctacgaggttaggggtgggtggagaggtaagcgcagatgactgtttcagaaaacattttcaacaacagacagccaaaaaggaagaaaaaaaagtcaaacaaacaaacaaaaatttcaacccagagcccacaccaacgcagcccctgcgtctccgccgccaccacacgatttacacaagtaatttaaatcattcacctgctgccaggtctcctccagggatggtaaagctgagaagtagccggtgtcgtggacaagttgtagctcctggaatatactataactagccaacacgtccatgctgctgctgccgggcaaaacgggaggcgaaaccctcccccg

SEQ ID NO: 85779 - DNA, 106 bp, Homo sapiens
  chr2:208031833-208031939
  hyper
gcgagggggcctttacgtgatgaggctcaccatggggtctccagcgaggtgtctgcagagcttcgatggtgagaggaggaactcgatttctcgttttctggagttg

SEQ ID NO: 85780 - DNA, 58 bp, Homo sapiens
  chr2:208140340-208140398
  hypo
ccactgtgtataattcggaagctacaggagtagagtggtccagcgtagctccttcaaa

SEQ ID NO: 85781 - DNA, 87 bp, Homo sapiens; identical to SEQ ID NO: 27827
  chr2:208546197-208546284
  hyper

SEQ ID NO: 85782 - DNA, 240 bp, Homo sapiens
  chr2:208574906-208575146
  hypo
tcaaaaaaaaaaaaacaaaaaaaaaacaatcccattttgcaggttttatagaagaaattgggacgcagaagttaagttacttccgcaagcttacatgactgctcagggtgagggtccctgatcatgatgatcagaaaataaaggtagaaatcaagcttagggaggaagtgacattgtgtgtatatatatatatttgtttatttatttttatttttatgttttatttttttgaaacggagc

SEQ ID NO: 85783 - DNA, 30 bp, Homo sapiens; identical to SEQ ID NO: 27828
  chr2:208633276-208633306
  hyper

SEQ ID NO: 85784 - DNA, 153 bp, Homo sapiens
  chr2:208635621-208635774
  hyper
ttcacctccgtattccgatcacctggcacatagtagccgcccaaatggcaaccctgggattcgaacccaggtagttggtcagcggcactcaccatcgtagccgcccctccccccatactatcgcagcctccctggcttcgacctttacttttg

SEQ ID NO: 85785 - DNA, 189 bp, Homo sapiens
  chr2:20865658-20865847
  hyper
gtgatcacgacgtgccgacccagtctagattttgagttctgcagaaaatgcaattttaaaggaaaaggacccgcctgcccttcttcggcagttcgtttggcccaggccttcgatcagctgaaagtttccgatctagggggatgtccaggctgccggcggagcagagccgataacccccctctcctgcgc

SEQ ID NO: 85786 - DNA, 812 bp, Homo sapiens
  chr2:20865848-20866660
  hyper
ttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgcttttacgacgggcggtccgcgtccaaaggtctcttacaggcctgccctttcagctcctcgccctcccttcctcccctaccggccccctcccctgctctggccgcccgctgcaatcctttggggtctgtggctgagtggggaaccgccgacccgcgatccggaacgcgactttgaggccgccgggagcatcctgtggcctctctctgcgcggccacccggccgcggcgcgaagcggtctggagggcgagcccttccgcggccccaactctgccgccccgttcccggcattgggaaccagggcagggagggggcgggtgtttctctgcgggggagtggggaggaagctgggcgggtgcgcgcggtgccccgagcctggaaccacggagggcgcgttggtcttgggcg

SEQ ID NO: 85787 - DNA, 204 bp, Homo sapiens
  chr2:20867109-20867313
  hyper
ccggagcccagggggcggcggcggcggcggcggcggcgggcggactcttgcccaggctgcgggcgccgcggctgtcccggccgccgcggttccccgggcccgcgccgcgcgccgcgccgcgggctccggcttcaggaacggctcggtggtgccgcaccacttcatgatgtcgctttaccggagcctggccgggagggctccggc

SEQ ID NO: 85788 - DNA, 30 bp, Homo sapiens
  chr2:20867534-20867564
  hyper
caacactctccagcccgctgcacctggact

SEQ ID NO: 85789 - DNA, 30 bp, Homo sapiens
  chr2:208694549-208694579
  hypo
tttgctttttcacagcgtcttgagtttcag

SEQ ID NO: 85790 - DNA, 24 bp, Homo sapiens
  chr2:209094651-209094675
  hypo
gatgcaggctgggggcggtggctc

SEQ ID NO: 85791 - DNA, 234 bp, Homo sapiens
  chr2:209225159-209225393
  hypo
tgggcatgcctggggcgcagaaccgcagctctgggccagacccggctgagactgtgcttgtgcggcgagtggaggccgctcccggggccctgccgccctctcgctcgctcggggctctggagtctggcgggccgcaagccgcgctgccggctctacctggctttgtccatccagccacccaccaagcgccagggtaaaacagcacccggaagcagtcgtcgcctgctgccacca

SEQ ID NO: 85792 - DNA, 73 bp, Homo sapiens
  chr2:209271264-209271337
  hyper
ctggaagacccagggcgcccctagagacagggccctggaacccgggacagagtggagggaagcagaaacattg

SEQ ID NO: 85793 - DNA, 20 bp, Homo sapiens
  chr2:209313347-209313367
  hypo
gaatccgtctcaaaaaaaaa

SEQ ID NO: 85794 - DNA, 197 bp, Homo sapiens
  chr2:209876323-209876520
  hypo
gagccactgcacctggcaactttcattaactcaaaggtttcatccggactttgctttgttcaacatgctcagtcatttaaataaaaaaggtatgtaatatatatatacaagtaagataaacatgctcgataatttaaatttaaaaagtatgtaattttattatgaatcatttccttttatatcgtgaatgaaataga

SEQ ID NO: 85795 - DNA, 349 bp, Homo sapiens; identical to SEQ ID NO: 27085
  chr2:21022707-21023056
  hyper

SEQ ID NO: 85796 - DNA, 30 bp, Homo sapiens
  chr2:210359777-210359807
  hypo
gtaaacaaagccacccgaagtttggactgg

SEQ ID NO: 85797 - DNA, 53 bp, Homo sapiens
  chr2:210636329-210636382
  hyper
ctcctgagtgcagctcggagcggggaaagccgaattccgggggctgaagaggc

SEQ ID NO: 85798 - DNA, 261 bp, Homo sapiens; identical to SEQ ID NO: 27832
  chr2:210636429-210636690
  hyper

SEQ ID NO: 85799 - DNA, 140 bp, Homo sapiens; identical to SEQ ID NO: 6623
  chr2:210636737-210636877
  hyper

SEQ ID NO: 85800 - DNA, 129 bp, Homo sapiens
  chr2:210636933-210637062
  hyper
cgctcctggggccgcccgggtcgccgctgccgccgccgccgctgaggccgcgccacagcctgcagctccctctctggggctggaaaacaagccctctgcaccagcttaaaaacacgcattaaaatatgt

SEQ ID NO: 85801 - DNA, 18 bp, Homo sapiens
  chr2:21089512-21089530
  hypo
tgttttaagacagagcgt

SEQ ID NO: 85802 - DNA, 549 bp, Homo sapiens
  chr2:211089524-211090073
  hyper
cgcgctcctgcagccgggcccagggggtgaccacctcctcccaaaacgcaggctcccgggtcccactgcaggccgctgaactagacgggttggattggggctccggaatgaacttctggagaaatctttcggctttccccgacgtgggctcggcggtctgttctcggggcggcacggctgacacccctttttcctccgcccagatgctggttgcacccagtccgcgggatccaggaaaggaggccagctctagcccggcgccggagttggggagcactcccagccgcgcgcgcaccgccctgcttcaagccagcgacaggagtgactcgctgccccaccccacagcctcccggcctgcagccgcggaagtcccggctggcactcaccgcgcggcgggcagctggcgcggcgcacggtggccgcccaggacgcgtagggaccctcggagaaggcgtgcggccatgtccgaaacacaggggcggcggggcgacggaggcgactctgcggctactcggcgactcggggcagggtccccgggagggaggacga

SEQ ID NO: 85803 - DNA, 159 bp, Homo sapiens
  chr2:2125816-2125975
  hypo
tcagcagggcggcaccgtcatctggcgatgatgtgcacgtggacctgattatggcactggtgagatcccacactatccaatgtgactagcaatgccgtgcagtcaactgcctgtatctcccactcactttaagagtgtgggcaccggctccagactgtc

SEQ ID NO: 85804 - DNA, 386 bp, Homo sapiens
  chr2:213401179-213401565
  hyper
tgaacaagtgaggctcgcctttgtgcccccagaatttcaagtacagagtcacacacggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtc

SEQ ID NO: 85805 - DNA, 444 bp, Homo sapiens
  chr2:213401566-213402010
  hyper
ccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcgctccctatcgccactcccgggggctttatcacctcaagctacttcccacgctccagtcaccat

SEQ ID NO: 85806 - DNA, 1402 bp, Homo sapiens
  chr2:213402608-213404010
  hyper
gctgcccgggctgggcgcgagttgcgtctgacgccacaaggctcgggcgactgggggcgcagcggtcgccagcagcacacacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtgggggtgcgaggggggcgggcgcggcgcgcgcggtgtggcgactcccagggcgggcgaccgagtccgcgcccgcgggtccagggccggggcccgaggagggggcgagtgtgagcgcgtgtgtgcgcgtgtgggagtgtgctcggtgtgtgcgcttggcgctctgggccggactgtgcagctatttccccgcgtgagccttcgcttgctcgctccctcctcactttctctctctctcactggttggtcaacaataaaaaaggaaggggggcgaaaggtttccaaaaaaagttgattgcaaagaggcggtaggtttccggcctctccccgcagccgggctatgttctgctccttcttcagtttccttgcacctccagtccaaatcgggaggggagcggggcggggggagcttctcgcttctccccggatcccgtccttctttttcctctcagctttcctcacacttgtccggcggctgcggtaattaaagctccgagcgtcatttccagcgctccgcggtctccagctgcagcccacagagaaattaataagactccagaaaaaaaaaaaaaaaaggtgcggggggcggtgggaataaaacaaccctccacgcaaccaggccggctctgctcagccgcgcaaaccccgcccatgctctgac

SEQ ID NO: 85807 - DNA, 16 bp, Homo sapiens
  chr2:213586068-213586084
  hypo
ccggcctgccactcta

SEQ ID NO: 85808 - DNA, 175 bp, Homo sapiens; identical to SEQ ID NO: 39740
  chr2:214080302-214080477
  hypo

SEQ ID NO: 85809 - DNA, 79 bp, Homo sapiens
  chr2:214149050-214149129
  hyper
tcccggtaacccttacgtgcccggggctggtccgtggggcggggtgagagatgccggaatctcgcgagagctcccgggg

SEQ ID NO: 85810 - DNA, 30 bp, Homo sapiens
  chr2:216162594-216162624
  hypo
cccagtccttgcccccgtactcctgctatt

SEQ ID NO: 85811 - DNA, 209 bp, Homo sapiens
  chr2:216300169-216300378
  hyper
tcgtcctccaatgcacggtcttatcatcccaggccctcagaaccagcgtgctcaaaactcggtccttttgtgtgcacagctggtttctctcagtaaagcgcgcacacactcgcacacacgcgcgcgcacaaaacttcagccccaactttggtcggctttagggtcccatccctgaggcagcctgtttcagcccgcggtcagtactcacg

SEQ ID NO: 85812 - DNA, 197 bp, Homo sapiens
  chr2:216300975-216301172
  hyper
gggggactgtgggttcgcagcgaacaaaagagatgctgatggcccgccaggactggggcaagacaactttttttcggtttcctttgcggtcatcaaactttttaggggatgggggaagggatgggaagcggctgggaggaaagggagtggctggacttgtgtgaagcgaaggggttgcaagacgctcccccttccct

SEQ ID NO: 85813 - DNA, 370 bp, Homo sapiens
  chr2:216301417-216301787
  hyper
tcacagctccctgttcggacttcttcccttctcagcgctgtgcctgtctggctctgagaaagggccagcgggcgaacggggagcaaaggggaacagagacctttaatgagcttctactaagtaccgggagttccgcggggcgctttgcagatcccggggaagttcagagaatgaagttttcttttgcaaggacaaagtaacagtttacttttttacacatgcaggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacaca

SEQ ID NO: 85814 - DNA, 30 bp, Homo sapiens
  chr2:2163389-2163419
  hypo
tgggagctgccttagcgagggggcgtggat

SEQ ID NO: 85815 - DNA, 30 bp, Homo sapiens
  chr2:2166008-2166038
  hypo
tgcagacagtgcctgcggtccacagagaag

SEQ ID NO: 85816 - DNA, 178 bp, Homo sapiens
  chr2:217236010-217236188
  hyper
cacccctgctgcagtcggcaaatccgtggcgccctcccctcggttccatcaaaggtcccttcggtcgaggggcaagagccgagagaagggcaggtccgggcgggcgagtggcctcgccttctcctcctcttcctcctctgggtcgcggtcgccctcctcctccggctccgggtcggcc

SEQ ID NO: 85817 - DNA, 22 bp, Homo sapiens
  chr2:217236231-217236253
  hyper
cggcgtccgggtgtctccgggg

SEQ ID NO: 85818 - DNA, 41 bp, Homo sapiens
  chr2:217236563-217236604
  hyper
tacccccaccaagggcggcctcggcccgctctctgcccccc

SEQ ID NO: 85819 - DNA, 201 bp, Homo sapiens
  chr2:217236943-217237144
  hyper
gaggtggcggggcggcgagctgaccgtccgagaactggaaacaaggttcttgcagcgagggaggctctcggctatctccgccgccggcgccgcggccgccgctgctgcattcagcaccccgggcgagtggacagctcccacccagaccccgcgcgtcacgctcgtgggggcctgacgcagacgccgcggagggatggagga

SEQ ID NO: 85820 - DNA, 481 bp, Homo sapiens
  chr2:217497788-217498269
  hyper
cggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccc

SEQ ID NO: 85821 - DNA, 204 bp, Homo sapiens
  chr2:217498283-217498487
  hyper
cgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccggg

SEQ ID NO: 85822 - DNA, 49 bp, Homo sapiens
  chr2:217556962-217557011
  hyper
gtgctggggagggggcgggtagaagaggcggcttcgggttggcccaaag

SEQ ID NO: 85823 - DNA, 71 bp, Homo sapiens; identical to SEQ ID NO: 27846
  chr2:217557250-217557321
  hyper

SEQ ID NO: 85824 - DNA, 652 bp, Homo sapiens
  chr2:217558904-217559556
  hyper
agtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctcggggtggggcaggagagcgagagtgcagggat

SEQ ID NO: 85825 - DNA, 173 bp, Homo sapiens
  chr2:217675049-217675222
  hypo
gggtagggctctctacggccggaggtggctgtgggggagacgggcgggaggcccagaccggcagggagctttctgcagggaagctggaaggatggtggggccggtaacccaacatggggcccaggagcgggagacatggccggaggggcggcgaggaacgcaccggggtgggc

SEQ ID NO: 85826 - DNA, 152 bp, Homo sapiens
  chr2:218339252-218339404
  hypo
aagatgtgaatttcccgatggagctggagggagaaagtttcccatggagggtccttgtttctggctctctctttgcttcctggcaagacctcaattggcactcctccgaacgacccaccctactgtaaacttctccccggcagctcaccttc

SEQ ID NO: 85827 - DNA, 30 bp, Homo sapiens
  chr2:218664369-218664399
  hypo
agatggtggggaggccgctgggaggatttg

SEQ ID NO: 85828 - DNA, 30 bp, Homo sapiens
  chr2:218665208-218665238
  hypo
cagcacctccaaccccgactcccaagttcc

SEQ ID NO: 85829 - DNA, 48 bp, Homo sapiens
  chr2:218697889-218697937
  hypo
aaccaactggtgcagcggaggcgcaggtgggcccgtgaggaggtgaag

SEQ ID NO: 85830 - DNA, 213 bp, Homo sapiens
  chr2:218806147-218806360
  hyper
ggaagcagctgggtgcggacctggtaggcagttgagccacgggtgtgagggaggggcacagtgccagggcagagcgtcgggctcttggttccttacacattggcaggaaggagggggcccctgcgagtggtctgcgcccacgccccaggccagaggacacagcttcctgatcccccattctggtgtcagagaactccccgactccaagtatcc

SEQ ID NO: 85831 - DNA, 37 bp, Homo sapiens
  chr2:218874667-218874704
  hyper
tgagaaccaggctgacgatggccgagacggagggtcc

SEQ ID NO: 85832 - DNA, 16 bp, Homo sapiens
  chr2:218955815-218955831
  hypo
cttttttttttgagac

SEQ ID NO: 85833 - DNA, 149 bp, Homo sapiens
  chr2:2190096-2190245
  hypo
attatgtgagggggacgcagccgggccttcccgagtcctgcggtccttactggttaactgtagtcccgcactgttaatgtttttcgttttttgaagccaagatagcgtgctcaccgcaaaagaaatatggacctcgatgaacagataat

SEQ ID NO: 85834 - DNA, 15 bp, Homo sapiens
  chr2:219232545-219232560
  hyper
ggacgtggtcacctt

SEQ ID NO: 85835 - DNA, 204 bp, Homo sapiens
  chr2:219232655-219232859
  hyper
cggagggagacgcccgctcgggggcggcctaagcggggcccaggcccggacagggcaggaaaccaggggtcgggctgggacgcgggcgggacgcgccggggcgggtgcgctttccgggctgcggttttgggggaataaatggggccctcccgcttctctgcagcgcccgtcgacagcgtccctggctagcgtctagtgtctcgg

SEQ ID NO: 85836 - DNA, 92 bp, Homo sapiens
  chr2:219250043-219250135
  hypo
cattttcagcttccacgatcaaataaatacatcatctcacatggggcatcccaagtctgtttgtttttgttgttgtttgtttgtttttcagt

SEQ ID NO: 85837 - DNA, 30 bp, Homo sapiens; identical to SEQ ID NO: 39743
  chr2:219251809-219251839
  hypo

SEQ ID NO: 85838 - DNA, 96 bp, Homo sapiens
  chr2:219253096-219253192
  hypo
aaaaaaaaaaaagaaaagaaaaagtgtctactgtgcgctgggaggaacagaccgtcaaggcctctgcccttctagagtttccgtgctagtggggta

SEQ ID NO: 85839 - DNA, 36 bp, Homo sapiens
  chr2:219255964-219256000
  hypo
cttccccatgaacaacgccaccgtggccgtggacat

SEQ ID NO: 85840 - DNA, 23 bp, Homo sapiens
  chr2:219282664-219282687
  hypo
aaactccaggtgggccgggtgca

SEQ ID NO: 85841 - DNA, 185 bp, Homo sapiens; identical to SEQ ID NO: 39744
  chr2:219284495-219284680
  hypo

SEQ ID NO: 85842 - DNA, 39 bp, Homo sapiens
  chr2:219294028-219294067
  hypo
atccgagaccaggagcggggagggcgcacctatgtaggc

SEQ ID NO: 85843 - DNA, 203 bp, Homo sapiens
  chr2:219431996-219432199
  hypo
tcatggcttgcaagacgcatcctcctctattggttattaaacagcaggaattcgtcaatgctccatcctaggtgcctttattttacagcactatactctttttcggcaatttcatccacatccatggcttcaattactatcaatatggcagatgacaaacacatacacacaccgcgcacatttacgtacgcagcccagaactc

SEQ ID NO: 85844 - DNA, 34 bp, Homo sapiens
  chr2:219586056-219586090
  hypo
tgttgggattacaggtgtgcgtcaccgcgcctgg

SEQ ID NO: 85845 - DNA, 30 bp, Homo sapiens; identical to SEQ ID NO: 39746
  chr2:219611841-219611871
  hypo

SEQ ID NO: 85846 - DNA, 252 bp, Homo sapiens
  chr2:219723919-219724171
  hyper
tcaaggagaggctgacgaaggggcatgaggcatcgaacagggacacggaaagagatgacccctccagcatccgcctgtcgggcggtccagtttgacaaccctcgccgaagcaccccgcgccccaggccaacttcctctcttgcctccgcgccagcatctccctccgcaccgccccccgccccaaactccctcattcctgggaagttttctctctttacagtcaacaaacctgtcaaacgtctcccttccagc

SEQ ID NO: 85847 - DNA, 361 bp, Homo sapiens
  chr2:219724722-219725083
  hyper
cgccccctgcccacccgggcggccgtagggcggtcacgatgctgccgcccttaccctcccgcctcgggctgctgctgctgctgctcctgtgcccggcgcacgtcggcggactgtggtggtgagtccggctgtcctggcgcggctctggaccctggagggtggggaccccgggacccaggacagactggggtgttccgcagcctcccggctctacctgctctccgagcccagctttctggcctcggccgggggcgtttctgaactccacttcgacgttcctaaccctcgggaacattctattgtgtttcctcctcccgggttctctcccaccccccgccaagttatgcgctcacccagctca

SEQ ID NO: 85848 - DNA, 30 bp, Homo sapiens
  chr2:219725453-219725483
  hyper
aaaatatgtgcagcccgggagatacgggac

SEQ ID NO: 85849 - DNA, 820 bp, Homo sapiens
  chr2:219735785-219736605
  hyper
atctgcaggaaggcacggcggctggccgggcggcaggccgagttgtgccaggctgagccggaagtggtggcagagctagctcggggcgcccggctcggggtgcgagagtgccagttccagttccgcttccgccgctggaattgctccagccacagcaaggcctttggacgcatcctgcaacagggtcagtgtggggagggggcggaagtggggctgctttctccctgctgtgggacccgaggagaggagaactggttcgctgaagttgcctgagccccacttccccctcacatgtgtctgggcaccctgcaaggaccctgcctcccaggcccctggggcagccctcccgccgcaggtttcaggtcccaggccccagctgaccgccccagcccgcgctgattgcacctgtctgcattcacagacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggtgcgtacgggcaggatggagtgagtgtgtgcggaaatgtgagtgtgcgcgcaggagtgtgctt

SEQ ID NO: 85850 - DNA, 35 bp, Homo sapiens
  chr2:219745580-219745615
  hyper
ccgggagccctgacccgagtcggagctgtgtgtcg

SEQ ID NO: 85851 - DNA, 49 bp, Homo sapiens
  chr2:219757965-219758014
  hyper
caccgagtgggtcagcgtctgcaagtgagcggcccggggtcccctgggc

SEQ ID NO: 85852 - DNA, 108 bp, Homo sapiens
  chr2:219773253-219773361
  hypo
tagaaatctaggaaccgaaggacttcttgacaaactgctctacgacagtaacgaggccttagagctgcagccagactgacttcgagtttcggccgcatccttttctgt

SEQ ID NO: 85853 - DNA, 230 bp, Homo sapiens
  chr2:219773687-219773917
  hyper
cctgggggaaagccccgatcccaagcgccaacagagcagccgacctcagccaacctcaaccaacacgtaggcgaggatgcccagggtgagcgccagcggcgagaagacgcgctatcgcgagatcggtgggacctacgcgtttacaggccggaagtgaggggcgggcctaagggggcgcgctccttttgaaacctgagacggagacctgcggagggcgagggctggttgga

SEQ ID NO: 85854 - DNA, 104 bp, Homo sapiens
  chr2:219823873-219823977
  hyper
ggggcgaggtggggtcgcgaagaggaaacagacctgacagtcacattggaggagccagtgcaacgcgacccatctgggacctgggcatccggtgagggcactca

SEQ ID NO: 85855 - DNA, 239 bp, Homo sapiens
  chr2:219824213-219824452
  hyper
gggtggggattggggcgggacttgaaattgaagtgcgagagtctattggtcattggagctgcccatcaggagtgcaactcgggagcggattggccgcgtgaggcggggcacggcgcgacgaaaaaaggggcccaaggggtggggctgacgctgcagctggcgcagctcaggattagagcagcggagccgcctagcagccaccttcccccgccagtccgcgcgcccgggccggggctagg

SEQ ID NO: 85856 - DNA, 307 bp, Homo sapiens; identical to SEQ ID NO: 27857
  chr2:219824786-219825093
  hyper

SEQ ID NO: 85857 - DNA, 809 bp, Homo sapiens
  chr2:219825130-219825939
  hyper
cgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctccccctt

SEQ ID NO: 85858 - DNA, 196 bp, Homo sapiens
  chr2:219826727-219826923
  hyper
ggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggttttgcgccggtctttctttgggccccgggagggagggagt

SEQ ID NO: 85859 - DNA, 237 bp, Homo sapiens
  chr2:219827646-219827883
  hyper
tcaacagagtgcccgcggctccgaccctagtctggccgtggccgagaagatccggaaagaacccggggggacctgccaagacgaggcccgggttcgctgtccgtggtgctgaatggcgcgctcgggcggggtcggggcttgtaagggcaggaagagttgcagactcggcctcaactaggtcttccggataatttgggaatagggtgtcatctattctggcggcgagttatagaagtc

SEQ ID NO: 85860 - DNA, 474 bp, Homo sapiens
  chr2:219846397-219846871
  hyper
atggccccccaagtgcgaggctgcggccacggccccgaagggcccgggcgggggctgcaagctgggactggggtagagcgcggcggtggcggcggcagcggtggcggcggggcccgggcccggccagtaggagaagccggcgggcgcgaccccggccgaggcggccatgaggttgagtttggagaggccggggaagggcagcggggcgaggccggcgggcagcttgtagagcgcgccgtcctgggcggccgcggcggcggcagcagctgcggcggcggcatgagcgtgcgcgggcggcggctggcaggcctgcgccaggccctggaagtcgaagcggtaggcgtagcgcttgccatgcaccttgctcatgatgttcttgtcgtagtagtagcgcagggcgcggctcagcttgtcgtagttcatgttgggcttgctcttgcgctcgccccaccgccgcgccacctcgtccgggtc

SEQ ID NO: 85861 - DNA, 339 bp, Homo sapiens
  chr2:219846894-219847233
  hyper
cgccctcccacgcgatgcagccggcgttcgcgcggtcagccagcagctccagcagaaactgccacagctggatctgtccgctgcctgtggggaggggggcggtcagccacaggcgggagcggggaggcgggaactggggaagagtgctggcgggaaactgacccaccccggcaggaaccggcactgggggaggaaaagtgcaagtcaaactgcagctgcgttcggcgggagaggccggccccggaggggctgatcagcagagtggtgtgtagccttaccgcgcttttgcacaatggaaatgcggcttccactgaagagcacgtagctttccagatgcac

SEQ ID NO: 85862 - DNA, 382 bp, Homo sapiens
  chr2:219847234-219847616
  hyper
gttttgtggaacttgggggttggggggaaggggaagcattgcctccccccacgtgagcgcagcggcgcaccaaggcacttggctttccaaggcgagcaaggacagatatccgccgccactctccatctcagccgggcgcccttatttagggaaaagacgcacaaccgtacagggcggccttgggcagaatgatcggactgccccatcccagctggaccacatccagaggtgggaagggacaggcgtgcagcaggacgaccccaaccactgctggacaaggcccagctagtcccgagtccccaaagacgtagttggacaggctactcctgaggtggagtggtggctggctcccttgggacaccacatccgacaggagtaggaa

SEQ ID NO: 85863 - DNA, 83 bp, Homo sapiens; identical to SEQ ID NO: 6640
  chr2:219848809-219848892
  hyper

SEQ ID NO: 85864 - DNA, 542 bp, Homo sapiens; identical to SEQ ID NO: 6641
  chr2:219848935-219849477
  hyper

SEQ ID NO: 85865 - DNA, 414 bp, Homo sapiens
  chr2:219849858-219850272
  hyper
tgcgctcggtggcaccgatccccgcccgaagcgaccgcgggtgacaaggaggagaagacggcgccgggtccggcagggcctggcgggagggggcagcccgggcgtggcgggggttgcgggggggtcctggagaaacgcttccagctaaggggccgcttggaaccctccggcccccgcgcggcccggggccgcaatttccgttttaattaaagcgctgccgcctcggcccccaggaccccgcccccgcccctcttatcgtcccatcgcaataaagtctccaacgcgccgcgccacagccaagcgcacccggcagccccccgcgccccgcagccggggagacgcgcgggggatgggcccgggccatgtgccctgatgggagcctagagcgcgtgtcttttccgcctccctgactct

SEQ ID NO: 85866 - DNA, 30 bp, Homo sapiens; identical to SEQ ID NO: 27865
  chr2:219850482-219850512
  hyper

SEQ ID NO: 85867 - DNA, 12 bp, Homo sapiens
  chr2:219857726-219857738
  hyper
caatcactcaca

SEQ ID NO: 85868 - DNA, 688 bp, Homo sapiens
  chr2:219857780-219858468
  hyper
cgcgctcgcagacgttcgcacagtcgcttagcagccgacagcgacggccctggaagtcctcctcgtcccagagcgtgaggctggcgggcgccgggcccggcgcgggggcgctgctcatgccgctgcggacaggaagggtggcaccacgcgctcagcgtctcaagagccccgtttcgagccacacacagcctgcccaacctgggtagcggatgaagaacccgggggctggacccggcctagctctggacccggctgccaggggctcgcagtcttcccgcgctcccctcccttccccaccccagcagagggcattcaccgggtgggtgagcgcggcacgcgagggaaatggaccggctgcgaggctgcgcgcggccgggcgggccgagctttatacctgggccttgtccccctgtccgcaccctttccctcgggggtggggtcgctgagtcagcaggcaggctgcggtcggctctggtctccgctggggagccgaggcctctcccgcagccgccgctgtggccccagcccgcgggaaagacaacagaaagtgctgaggcgcgcaccccgcgcccgccgcagcccaggctgactccgcgctttctttctttccagcctgagccaggcagggcacgccaggcctcggggcagaacgcgccctccctgtcccggccctcggggacgaagggac

SEQ ID NO: 85869 - DNA, 36 bp, Homo sapiens
  chr2:219858715-219858751
  hyper
cccccggggtgtcctcgggcccgggaaggagaggag

SEQ ID NO: 85870 - DNA, 176 bp, Homo sapiens
  chr2:219866437-219866613
  hyper
ggagggcccggggcctggcggtcgccctcggtgatctcctggtcctggtcttccgcgagctcagtgctgcacagcgccccgctagcctccgccctcacctgaacgcatctgcggctgacacgtcggcggccgcggcggccaccgcaggtgcgcacctggcccgcccctcctttccc

SEQ ID NO: 85871 - DNA, 430 bp, Homo sapiens
  chr2:219867582-219868012
  hyper
agatgcttttactggcggtggagagggggccaggcgtgacccctagcggcatgtcggagaggctgggcgcgggcatttacggaaggtcggtaggaagtggcaccaccgggtggagtacctctgcttgctgcgtcggcagcagcgtgtccggggtcagactcctggaagacaaaaagtcccaggtaggcgtgggggcgaggcttcgggcagagcctggctgcccccgtggcccctctcgcgcggtctgcgcggccgctggtcccggcgcccttacctgggcacgcagaacggcggcagggcgatgacgcgtggccgcgaggtgagtaccacctccccgcggctcgcctccaccaggatgttctggatcatgttctccagcagcgcctcctgcaggttggcgaaggccgggagcctgcgagggggcgggggc

SEQ ID NO: 85872 - DNA, 98 bp, Homo sapiens
  chr2:219923137-219923235
  hyper
gggggccacatgcaacgtcttcctctgcaaggcgcaaaaggggctgacaatcccagacctccaggacctctgcaccggtgccccgcccctataccgta

SEQ ID NO: 85873 - DNA, 42 bp, Homo sapiens
  chr2:219923695-219923737
  hyper
tcaggcttctagccccgcacctatgcccgcctgcagccctgg

SEQ ID NO: 85874 - DNA, 30 bp, Homo sapiens; identical to SEQ ID NO: 27869
  chr2:219924566-219924596
  hyper

SEQ ID NO: 85875 - DNA, 465 bp, Homo sapiens
  chr2:219925148-219925613
  hyper
aggcagaagtgcagtcggggccggagccgggcgggagacatggccggggagcccgggggagcggcgggcgaggtctcctggtgggctgatgggcaggcgcgtcgacgggagcgctgcgggggctcaggcgtccgggtggctccggggggctccaggcgggggcgccatgggcggcgtggtgcggccagggccggcgggactcaagtgcggggcgggggcccagggcccgagctggtggcggcgcgctgtccccctcggcgcctcgactctgagctgccgggctcgccggccgccaataaataggccggcccgtttgttttggcaacgcggcggcggcggggggcggcgggcggcggggctgcgggccgccgggctgggctgggctggccgggccggcgggctgcagggccccgcggttagcaccccggcccggcggtcaggcggctcgggcggagcgggagctgc

SEQ ID NO: 85876 - DNA, 315 bp, Homo sapiens
  chr2:219925828-219926143
  hyper
gcccgctgccctctgcgccccctgcgctgcccgagtttgccctccccgcctggacgcgccccaccccgccctggcctcgcctaccggctcttcgcggctctggggtgccccgccaggcgcaaacctcccggacaggagctgccacccccacggagaccgcaacccacggcgcggccggacgcgaggggcggggggcagtggccggaccgcacagccgcctacggtgtcccctgcggggaagcaaacccaaaaggcaggaggccactcataacctggtgccccaccctggcccgggcgacgcgccctttcagcttg

SEQ ID NO: 85877 - DNA, 197 bp, Homo sapiens
  chr2:220080662-220080859
  hypo
ctatccctgcttctccggctccaccctcccacatgccctttccactggggcggcacctgagcagccctgtgacactggatgtgccccgatccgcgatccgcagcacctcccctgtgcggcgccccaggtgccagcgcagtgagagctcgtgcaggtgggagaagatgagcagctccacccgccgagacgtgaactgc

SEQ ID NO: 85878 - DNA, 87 bp, Homo sapiens
  chr2:220083558-220083645
  hyper
cgcccactcccctagcgcacgcgccgccgccacgcactcacgcagggcacgtacgccgtctcagcacggccccgctggctctgggcc

SEQ ID NO: 85879 - DNA, 30 bp, Homo sapiens
  chr2:220096000-220096030
  hypo
ctcgggagagggctacgttggagaagttta

SEQ ID NO: 85880 - DNA, 30 bp, Homo sapiens
  chr2:220150841-220150871
  hypo
gtggcgggtgggggccgggtgggaggtggc

SEQ ID NO: 85881 - DNA, 30 bp, Homo sapiens
  chr2:220161540-220161570
  hypo
tcatctgcacagacccgacaccccacccca

SEQ ID NO: 85882 - DNA, 47 bp, Homo sapiens
  chr2:220173293-220173340
  hyper
ctgtccgtgagtcagcgctgactgtctctgtccgcacagatgtgagt

SEQ ID NO: 85883 - DNA, 265 bp, Homo sapiens
  chr2:220173772-220174037
  hyper
ccctttcctccgagacgccctctcaccttcctcatctcgcatgcctcccccaacccatattctccccgagcttcatgacatttcaccctcacccccaccgagtttcgctccaggccccaagctgctccccgccccccaccacccgccagcccaagtttcctcctgaccgtgggcactaacggcgctgcagccccccgggcggctgctcagcagcaggaggcagaggagcagccggagacccccggatcccccgagacccccaggc

SEQ ID NO: 85884 - DNA, 285 bp, Homo sapiens; identical to SEQ ID NO: 27874
  chr2:220174059-220174344
  hyper

SEQ ID NO: 85885 - DNA, 41 bp, Homo sapiens
  chr2:220180029-220180070
  hypo
tacaggcatgagccatcgtgccccgccgatgttgaatacct

SEQ ID NO: 85886 - DNA, 481 bp, Homo sapiens
  chr2:220196354-220196835
  hyper
gaagggaaagagcttcgggaaggggagctgattctctgaggcagcgttcccaggactggtgggaaggagtggtgacccgctcgggctcggcgtggacccggagcgcgcctggcgctgtccgtggtgctgagaggtggggaggccagcgtggcggcggcgctgggcggaatgtgggcgagacatctccgcaaggcttggcggtccttccccacggccctcatcctctcattgccaccaggcctcctcccacagctgttcctgaatccgctgcattggcctctaaaaccaaaaatcagggagagggggcgacagactaggagtttgcgctctcttccccatgcgctctgcgcaggagttctcgagtgtgcgcagtctggcacgtgagtcagcgcggggtctacgcggattggtgcgggggaaggggagaaggatggtcccattccccctccatcctgctttccctcagcggtccccttattgg

SEQ ID NO: 85887 - DNA, 413 bp, Homo sapiens
  chr2:220197187-220197600
  hyper
cccacttctcaggatcgctttcttggccctgcccgcaccccccagggttcctcctgaccgtgggcactagtgtcgctgcagccccccgggcagctgttcagcagcaggaagcagacaagcagctggagcccctcggagctcccaggccacagtgggtgctgtatcctcccaggctcggcgcgctcactccccggccaagtctcagtgaaggtagcggccacggccgaggggctgagcggggctgcagcttcccaccagcccgcgactccgaatctgtttaaccctcctcggcagttcagccaatcgtgagcgggccctgcccctgcggtcgcctccccagctccttcccctaccgcctccccaccctcatctcttggaattcctgacccggctcctttcgggcattagctggg

SEQ ID NO: 85888 - DNA, 780 bp, Homo sapiens
  chr2:220222920-220223700
  hyper
ccccgctgtcatcagcgctgacgccctggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagagaatcagaggcacccccgctgggccccgagccccatgcgcgcgcaggggcccc

SEQ ID NO: 85889 - DNA, 65 bp, Homo sapiens
  chr2:220283066-220283131
  hyper
ggatacaaatagtgccgacggctgggggccctgtctcccctcgccgcatccactctccggccggc

SEQ ID NO: 85890 - DNA, 118 bp, Homo sapiens; identical to SEQ ID NO: 27879
  chr2:220283172-220283290
  hyper

SEQ ID NO: 85891 - DNA, 264 bp, Homo sapiens; identical to SEQ ID NO: 27880
  chr2:220283362-220283626
  hyper

SEQ ID NO: 85892 - DNA, 42 bp, Homo sapiens
  chr2:220283711-220283753
  hyper
cgacgtcgagcgcgacaacctgctcgacgacctgcagcggct

SEQ ID NO: 85893 - DNA, 167 bp, Homo sapiens
  chr2:220299468-220299635
  hyper
tgccccctccctccacggctccctcgcaacccgagccggggggcctaaaaatagcccccaggcgcaatcgccggccgccccggtgaccttctgggtagcacaggccgaaggcgggcgggcagcaggaaggcaggccgccggccccccagacttgtctcctagggcac

SEQ ID NO: 85894 - DNA, 251 bp, Homo sapiens
  chr2:220299885-220300136
  hyper
cgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggaggtaaagggcaggtgggggccgcgcccggcaggggcggggtgctcagagg

SEQ ID NO: 85895 - DNA, 30 bp, Homo sapiens
  chr2:220309719-220309749
  hypo
accggggccgggccacggcacctgggggtg

SEQ ID NO: 85896 - DNA, 41 bp, Homo sapiens
  chr2:220316287-220316328
  hypo
gagattctcagtgggcgcctgtgggccgtggcgagccgggt

SEQ ID NO: 85897 - DNA, 743 bp, Homo sapiens; identical to SEQ ID NO: 27884
  chr2:220349054-220349797
  hyper

SEQ ID NO: 85898 - DNA, 48 bp, Homo sapiens; identical to SEQ ID NO: 27885
  chr2:220361419-220361467
  hyper

SEQ ID NO: 85899 - DNA, 76 bp, Homo sapiens; identical to SEQ ID NO: 27886
  chr2:220361826-220361902
  hyper

SEQ ID NO: 85900 - DNA, 366 bp, Homo sapiens
  chr2:220361983-220362349
  hyper
cgccgcgccagccaagtgcgtccttccctacctcgggatccagctccacccgggctgagcagtcagctgtggacttccatcacgcggctccgggtccccaaggtcacacagcaagccagaggcagagccagggttggacccgggtcttctggctcccaactctggcaatttccactacccggagcggtctctgaggcaccgcgagatgtgtgaacattcaggggctttcgcccgccttatctctcttgatcctctattcgaccccgagaagtaggagaggcagggataagtccctttaacagccaaggagatgaaaccagagaggctaatgatttgctcaacgtcacactgcgagtttaaatgcat

SEQ ID NO: 85901 - DNA, 67 bp, Homo sapiens
  chr2:220362553-220362620
  hyper
ggacggggaggacatcgaggaggatgacaggcgagggccgggacctgcggcacggccagggcctggg

SEQ ID NO: 85902 - DNA, 246 bp, Homo sapiens
  chr2:220379093-220379339
  hyper
ggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtt

SEQ ID NO: 85903 - DNA, 38 bp, Homo sapiens
  chr2:220383596-220383634
  hypo
agcttctgtgagcatcggtttgtgtattcttttttttg

SEQ ID NO: 85904 - DNA, 42 bp, Homo sapiens; identical to SEQ ID NO: 39750
  chr2:220384416-220384458
  hypo

SEQ ID NO: 85905 - DNA, 267 bp, Homo sapiens
  chr2:220387586-220387853
  hyper
gagagcggaggagcccgcaggagatgggagggagggcgctcgggagccgtgatggatgcctggcccgcgggagggagcggagggcggcgaggcgcgcgagccggtgggtgcggccctctgggtgcgggtgggccaggcctgggcggccaggctgtgtgtgcgggagagggcggggggccagggatcctggcaggcgcacacccacccacccaccgtccccgccgcctctttctgtcttgtctcctgaactcccgcctggctgtggga

SEQ ID NO: 85906 - DNA, 1406 bp, Homo sapiens
  chr2:220416306-220417712
  hyper
ccttggtcctcaggtcgaacgtcatggatgaccaggctgtgggtggggccgtggctgcgcatctcatacttatctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaaggcggcgcgtgccgagggcctggagcc

SEQ ID NO: 85907 - DNA, 865 bp, Homo sapiens
  chr2:220435389-220436254
  hyper
cggggccgtcctcggcgcggcccggctggagcgcgaagtggctgctgtcccacacttcgtccagggccatcccgtccttctcccagtacagtgtgggctcggggaggccccccgcccggcacgtcagcaccacctccgccccccgcagcacccactgggatcgaggccccgtgaggaagaccggggcgccctccccggaccccggcgatggcagcgggcgctcggcgggctgcagctcggggtcggaggccggcggctccagcacggtgacggcggccgccgcgtaggcctcgccggccgcgttgcgggcgcggcacacgtagacccccgcgtcggtgggcagtgcggcggtcagcagcaggccgtgctccgcgccgtccgccgggaagctcaggcgttccgaggccgccagctgctgcccgcccttctcccacaccactacaggcggcggctcccccaggaccacgcacttgagctcggcctcggcgccacttaccacccgcacaggccgcgggaagcgcaggaagcacggggggctcccctgatcccccgagctcgccttcatcgcggcggccgaccgcctgcagcggcgaacggtgggggggcaggggggggtgcggagggcgagccgaggcccggggcggcggggtcggggcgcggctggggactgggcgcggggacccgcggagctctcccgggcctcccgctcccggctcgcctccttaccctcggccccgagctgcagctctgcggcggcggcggcggcgattcccgggcccgaagcctggcgctcagggggcagtccttcctgtttgcctctccagcgagtggccccgcagcctcccctgcccgctgcctggcttcc

SEQ ID NO: 85908 - DNA, 92 bp, Homo sapiens
  chr2:221861740-221861832
  hypo
ggacactgagaacagcgagttgtttccagggaaagcagcccaagtacctgtgtgaaatctagcgtttcctgcatttaattgttcattgtggg

SEQ ID NO: 85909 - DNA, 24 bp, Homo sapiens
  chr2:222034371-222034395
  hypo
gcgagactccgtctcaaaaaaaaa

SEQ ID NO: 85910 - DNA, 84 bp, Homo sapiens
  chr2:222435773-222435857
  hyper
cactcaggacatctgcgcacagacatacaatcctccgcgtccgcttccacgcaggcattcgcgcacctacatacacgcagttgc

SEQ ID NO: 85911 - DNA, 984 bp, Homo sapiens
  chr2:222435977-222436961
  hyper
acacacacacacacacagttcgcctctccctgggtttctcagaaactaaatgatcaccgcccccccgccccgccccacctcccgacacagacacacaggcacatacaatcctcccagcacgtccgaacggatgcacagaaaactgagcacccagacgggtcccgtcgaccccgcacgttagctctaaactgtgtgcaattctggggcgaaaagctaaaactcgactgcgttcaacttgccggcgggttccccaagtctgcggggcgaagagctcgggcccctcaggcccgcaatcgcaccctcggggcgctgggcttggcgaggagaaaggtgtctgactccgggtgctagaaatcaggtcactggcgcctgacgagcggcgccacgaccgctgcgctgcggagcaggccccgcagcccggtcccgagaagcgcagggctcgggaaactttgcagaaaccagagctcgaaaggctttcgctagaatccgggagcaccaagccttcactgtgctccaggctgcgttttcccctcgccccgggctggctcaggagaggacgtggttcttgtaattttttttttaaatcccggcgttgtctcccgtgcatcccctcagggcgcctcgagcgggcctctctggcggatgctgataaactttggcctttggttacaaacttggacagacccgccgcgtgcacgggtcaccgcctcggggcaggctgtccggcggttccccgctgccccttcgccgatcccctcgcctcagcccccttctcccgaatcgggacgcaccattcacactgggctccccccgcaccacctggccctgcgctcctgaggacccctcacccgcgatggcccctcgctgtccccgaccacagaaaggccgtcccgctcttaccttcattcgcggggtataccctggaacctgtgacagcgtcgcaaatcccgaagagacacgaaaatagggcgaaatagaaaatcc

SEQ ID NO: 85912 - DNA, 54 bp, Homo sapiens
  chr2:222437367-222437421
  hyper
ccttttctcccaccacgggcggtttaagatggaggaaaacgctcttttattgaa

SEQ ID NO: 85913 - DNA, 30 bp, Homo sapiens
  chr2:222438857-222438887
  hyper
atgcaaactcagagccgagctaatgacatg

SEQ ID NO: 85914 - DNA, 36 bp, Homo sapiens; identical to SEQ ID NO: 27894
  chr2:223104874-223104910
  hyper

SEQ ID NO: 85915 - DNA, 30 bp, Homo sapiens
  chr2:223154920-223154950
  hyper
tttaatgcttttctgcgttttaaactgatt

SEQ ID NO: 85916 - DNA, 423 bp, Homo sapiens
  chr2:223155765-223156188
  hyper
gagtaggggagggggcggagcggcgcggcgctttggcgcagagcacaggagtgggggcccagcccattgtggcggcgcccgcgggcccgctaggccgagccgggggaggaacagaggcgcccattgagcggccgctgcgcagggcggtgcccacagccccggatgcctcggccaggacttggctcccccggctgcctctgctccagtctcagcgcgggccaggggctagggggattggggatagcgggcggggttcgtgttagtgaaccgcccagccctctcctttctcctgggctatggagctggagggatgtatccagcaagggtgcatcatgcttagcgcgcgcccgttagggagcgcgggcctgagcgcaccagcaccgctagcggctcagctcttgaattgagcgagggaaaagggaa

SEQ ID NO: 85917 - DNA, 1076 bp, Homo sapiens; identical to SEQ ID NO: 27896
  chr2:223158730-223159806
  hyper

SEQ ID NO: 85918 - DNA, 334 bp, Homo sapiens
  chr2:223159868-223160202
  hyper
cggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatattgcagggcctcgggagaggccacctcccaatagctgagatcgataattggggtgattacgtctgggtcgacgtgccggggtaatag

SEQ ID NO: 85919 - DNA, 174 bp, Homo sapiens
  chr2:223160250-223160424
  hyper
cggcacggtgtttcgatcacagaccgcgtccttgagtaatttgtctcggatttcccagctgaacatgcccgggttctctcttttgtattcctcaattttcttctccacgtcaggcgttgtcacctgctttaagagaacaggcgggcaggcgttggtacccggtaccctgggcca

SEQ ID NO: 85920 - DNA, 30 bp, Homo sapiens; identical to SEQ ID NO: 27899
  chr2:223161247-223161277
  hyper

SEQ ID NO: 85921 - DNA, 159 bp, Homo sapiens; identical to SEQ ID NO: 27900
  chr2:223161526-223161685
  hyper

SEQ ID NO: 85922 - DNA, 530 bp, Homo sapiens
  chr2:223161806-223162336
  hyper
cgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcgacatcggactcccagacccagacctcctttcaatcacatttgttcaaattattcagcaatatagcgcatgtaatcttgtgtaaagacagcaaatggggcaaaataattctccccagagaaagcgtcttccccttcgggcccggggagtggcaacttaggagaccctgcagctggtagagagtctagcttgctctagaaacagcctcctggcgaagagaagttcacccaggagctggccttgatgaactctgctcccaccgatccctgtccaat

SEQ ID NO: 85923 - DNA, 326 bp, Homo sapiens; identical to SEQ ID NO: 27902
  chr2:223162565-223162891
  hyper

SEQ ID NO: 85924 - DNA, 297 bp, Homo sapiens; identical to SEQ ID NO: 270
  chr2:223162928-223163225
  hyper

SEQ ID NO: 85925 - DNA, 337 bp, Homo sapiens; identical to SEQ ID NO: 271
  chr2:223163472-223163809
  hyper

SEQ ID NO: 85926 - DNA, 193 bp, Homo sapiens; identical to SEQ ID NO: 272
  chr2:223163810-223164003
  hyper

SEQ ID NO: 85927 - DNA, 233 bp, Homo sapiens
  chr2:223164384-223164617
  hyper
gaggagtccagggtgcgctgatgttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctg

SEQ ID NO: 85928 - DNA, 69 bp, Homo sapiens; identical to SEQ ID NO: 27907
  chr2:223165434-223165503
  hyper

SEQ ID NO: 85929 - DNA, 223 bp, Homo sapiens; identical to SEQ ID NO: 27908
  chr2:223166003-223166226
  hyper

SEQ ID NO: 85930 - DNA, 557 bp, Homo sapiens; identical to SEQ ID NO: 27909
  chr2:223166293-223166850
  hyper

SEQ ID NO: 85931 - DNA, 419 bp, Homo sapiens
  chr2:223167154-223167573
  hyper
tgacctagtggggagcgggggtggtgtctgccacccagacctttttcctcccgtctgaagggccgagctctggcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgggatgagttcggattaagggacta

SEQ ID NO: 85932 - DNA, 627 bp, Homo sapiens
  chr2:223168205-223168832
  hyper
aaaatctgatctgtgcggaggcaggtgaaggctgtgagtgaggtgggggcgggaacagagctggaggaagtgaataaaagaaaccttggggtccgttggtttccttgactcgtggagcaaaaaagtaggcgagtgaccactccaggaactcctgcctccgggcgccggtacataaagagctggggctgtgtgtcctgctcttgggggaggagggtactgggaagggggaactaacaggtctttctttcgctcggatcaggactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcc

SEQ ID NO: 85933 - DNA, 1295 bp, Homo sapiens
  chr2:223168916-223170211
  hyper
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttaccaaaacctttgaagccgcttttcggctctcgggccctccacgcggccagtgggtctctcccacctccccgcccccagctgctgctgggcagggagcatttgcttccccctccaacccgggaccagggtggaggagtctatggttaaagcgaaagtgtttcactgcggcaacgctggggaaaggaggttcttttttcctgggctgcagcaggtggacagtaaggcccgagaaaatgtaatattttaacaaaacgcaccactccccgaaacacacgta

SEQ ID NO: 85934 - DNA, 1285 bp, Homo sapiens
  chr2:223170271-223171556
  hyper
tcacacacacacaatcacgcagggcggggagggttctcagcgttccctgagcgccctttggccttagagacagggaataaattcttctttccatccctcggccccctcccagagggcagcgacgaaagccctggccgagcacaaggatcggtgatctgggctcctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttccaaatgcaaatcaaacacccttggcgccccgcttcttcattaattaagaggaacgtttcgacaaaaccggcgtaatctttattaattacgcagcccttagcgcgccgttcgcatcaatcacgcccaaagcgaaagtgcagggggcgcctaatcccttcccagagcgcgtttggagaaggagccgcgtggccggcgtttccaccgtgacttccacctttctgggctcgcctggcactggctgctcagccggcgcgcagggaggcctttccggaaacaccggctggctgcgcgctagcaggaccgctctagatcccctgacaggccggaaaataacccccactcactatttgggcacgcgctcgtacgcagaaactcgcacagggactcgcgtggacactttatggcccatttcctccgtcccctcacccttaggctcagtggggaccacgcggttctcagtcctcctcttccctaggaccctctaaaaaggagcctggggcgaaatgacagagggaggcagaaaacctcctgttgccccaggacgccccgaaaaactgctctgggggatggggcggggaagaccttagaagttgtcagggcgaccaactcctcccaggtgaccaggttgccataggaccagcacactgctcaggagtgagttttggggagagagagggatcctccagttattgccatagagaaccaggaaagttcgcagcctccgggtcgcaagtgggaaagttgactggagattgcggttagagggggtgggtgcaaactcagggtatttccgggtagccccgcag

SEQ ID NO: 85935 - DNA, 239 bp, Homo sapiens
  chr2:223171840-223172079
  hyper
gcctgcccaccctcacgtcctcgggcgcccttggctcgagggcctttcggagcctccgcgggaagcagaaagtcgcacctcacactgagcctttccttcgagcgctctgccgggagctactgagccccagcacgcagccttgggcacccggtggcgggcgaaggaacctgccccattgtgctgctgggctgcactagcggagacgagagtgcgtgtgggagtggcccactagcaccacc

SEQ ID NO: 85936 - DNA, 185 bp, Homo sapiens; identical to SEQ ID NO: 27915
  chr2:223173045-223173230
  hyper

SEQ ID NO: 85937 - DNA, 416 bp, Homo sapiens; identical to SEQ ID NO: 273
  chr2:223176096-223176512
  hyper

SEQ ID NO: 85938 - DNA, 489 bp, Homo sapiens; identical to SEQ ID NO: 27917
  chr2:223176719-223177208
  hyper

SEQ ID NO: 85939 - DNA, 434 bp, Homo sapiens
  chr2:223177244-223177678
  hyper
cgccctgccccttgggctcagctgcgagccaccgccggcgtgcgcacccacaaggagagaaatggaggtaatcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccctcgttgtcactgcattttgatgacacgggggacttggaaa

SEQ ID NO: 85940 - DNA, 325 bp, Homo sapiens
  chr2:223185130-223185455
  hyper
aggagatttggggtgcggctgcttataaagatgttgccttttaccccagcagtcccccgccccctacgcggggtggtggcaggaaaccggttcctgagttttccttctttctcttcctcgacacgacctccccaccagtgtgtttctgtttatcctcctcgcccgggggctgggtccctggcgaagcctcgttttcacccacccacccccaagccagagctcaccagtgatgtaatgcgggacccgcgcggggaggggaaacggcagcctcaaccgcctggcagcggcggtttcttctcttcgtgaaaatcgtgatctcatctct

SEQ ID NO: 85941 - DNA, 473 bp, Homo sapiens
  chr2:223536200-223536673
  hyper
actctcgccaacgcccggcgcgccagccaatgcgcccgggccgctgtagctgctccggggccagggcgctgggccagctctggcgcccggcgcttgtgattggctgcccccagcctcagcccagcgcgccctcccacccagggcgcagttgggtccccgctcgctgcctagcctctgccttttcctctccgcccagccagtgcccagcgcggggcccggatccggccgggcacttcccacaggcgccgcagagcagcgtgggtgcaggctgcagtggctggcgccgtcctcgcccggccaggccatgaaggtagagtttgcaccgctcaacatccagctggcgcggcggctgcagacggtggccgtgctgcagtgggtcctgaaatacctgctgctcggtaaggaccccgccccccgggccgcggggcttgggctccatatcctccctcgggacggtccggattccaggacct

SEQ ID NO: 85942 - DNA, 130 bp, Homo sapiens
  chr2:223753473-223753603
  hypo
gtgtatctttccagacgctttgtttgcgacgctttgtttgcgtatccaagattgccatcttttaatgaagtagatgtgatggaaaaaggaatatactttgtccactttaatagtacgcctcactttgttt

SEQ ID NO: 85943 - DNA, 18 bp, Homo sapiens
  chr2:223764729-223764747
  hypo
agtcgctctggttcaaac

SEQ ID NO: 85944 - DNA, 16 bp, Homo sapiens
  chr2:22404338-22404354
  hypo
ccgcccccacaaaaaa

SEQ ID NO: 85945 - DNA, 130 bp, Homo sapiens
  chr2:224909475-224909605
  hypo
ttccactgttcatcacgaaggttccgattccttggtttagtcagtcttctgtagaggttatgaacacaggctctgaagttagattgcctgtgttcaaatcccagtctcatcactacgcaatttttttcaa

SEQ ID NO: 85946 - DNA, 75 bp, Homo sapiens; identical to SEQ ID NO: 39754
  chr2:225394300-225394375
  hypo

SEQ ID NO: 85947 - DNA, 158 bp, Homo sapiens
  chr2:225906010-225906168
  hyper
ttccggtccaccaaacgcaggccaagagcgcggctgctgagccccggtcttgctgtgaggctgttgttcccactcgcttcccgtttccactagagttgatttgtctcttgccacctctccccggcagtgtggacctactgcaacgcaggaacatctgg

SEQ ID NO: 85948 - DNA, 375 bp, Homo sapiens; identical to SEQ ID NO: 6682
  chr2:225906404-225906779
  hyper

SEQ ID NO: 85949 - DNA, 572 bp, Homo sapiens; identical to SEQ ID NO: 27923
  chr2:225906790-225907362
  hyper

SEQ ID NO: 85950 - DNA, 181 bp, Homo sapiens
  chr2:225907439-225907620
  hyper
cggccggggctgtccacgccgcccgggggaactgcaggctgcgggggagggcggggggcggccgccgaggggctccgggcggggcctgtccaaggccgtcgcctgtccaaggccgtcagcctcatttggaggttgctgggagagttggagccctggatgcatttgccgtttagacttctat

SEQ ID NO: 85951 - DNA, 30 bp, Homo sapiens
  chr2:225975877-225975907
  hypo
gaatgtgtggctgggcgtggtgtctcatgc

SEQ ID NO: 85952 - DNA, 32 bp, Homo sapiens
  chr2:225987036-225987068
  hypo
gggacacagatccaaaccgtaccaacattata

SEQ ID NO: 85953 - DNA, 24 bp, Homo sapiens
  chr2:226298377-226298401
  hypo
aaaaaattagttgggcgtgatggc

SEQ ID NO: 85954 - DNA, 30 bp, Homo sapiens
  chr2:226845723-226845753
  hypo
ttgagggagaacagacgtcattcccaaatg

SEQ ID NO: 85955 - DNA, 433 bp, Homo sapiens
  chr2:226895900-226896333
  hyper
agacaggggaggctccgccctgcccctgcacccgccgccctctccccggccgcacgggagcccggatcccgcaggcatctgtgttcgcaggttctgccgtttgctttcgggaaggcgagcattgttttcctctggatgcaagcttttgctgacccacaccccccttccccaatgcctccgcttcccttcccccttcggggacttgggattgccctgcagactccctggacttgagcgttttggtctctggctgcagtgtttgtgagagaggctgcggatgcgacccagctccggctcagctgcgcgcgtttgcaaatgcggctgcgtccagacagggcatggaacacatttccaagctcacgtccccgtttcttgtttacagctgagattataagcaatctatgtgccctcttatcatcgtgtcaggcaatga

SEQ ID NO: 85956 - DNA, 96 bp, Homo sapiens
  chr2:227663424-227663520
  hyper
gaagccatcgctctccggagggctcgccatgctgccaccgccaccaccaacgctgagcagagggaggctccgaaaaacaaccgggtggggggcgga

SEQ ID NO: 85957 - DNA, 88 bp, Homo sapiens
  chr2:227820585-227820673
  hypo
acagtcacattgggggttagggtttccataaatgaattggtgggggggacatgatttagtccctaacaagtaacgattatctaccgag

SEQ ID NO: 85958 - DNA, 78 bp, Homo sapiens
  chr2:228029273-228029351
  hyper
ctgggtggggagggacgaaccgcgcgaccgagccctacaaaacccgccccggccgagtggcgaggcgagctttccagc

SEQ ID NO: 85959 - DNA, 250 bp, Homo sapiens
  chr2:228029372-228029622
  hyper
cgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggta

SEQ ID NO: 85960 - DNA, 30 bp, Homo sapiens
  chr2:228146693-228146723
  hypo
tatttctaaagtggccgggtgcagtggctc

SEQ ID NO: 85961 - DNA, 30 bp, Homo sapiens
  chr2:228253378-228253408
  hypo
gtgtctcttgccccacgacctcaaaacaag

SEQ ID NO: 85962 - DNA, 27 bp, Homo sapiens
  chr2:228264615-228264642
  hypo
aaatagccaccgcgcctggcctataaa

SEQ ID NO: 85963 - DNA, 92 bp, Homo sapiens
  chr2:228466753-228466845
  hypo
cctgtttgacgttggactaggaacatctgctcagtctgccctcagcctatgagaaccatttcctttttccgtttcctcgtttcccatcttta

SEQ ID NO: 85964 - DNA, 2 bp, Homo sapiens
  chr2:228582794-228582796
  hyper
ca

SEQ ID NO: 85965 - DNA, 15 bp, Homo sapiens
  chr2:228582819-228582834
  hyper
cgtccagacctttca

SEQ ID NO: 85966 - DNA, 32 bp, Homo sapiens
  chr2:228589295-228589327
  hypo
agcctccacagcagccgcggcagcaggggcag

SEQ ID NO: 85967 - DNA, 49 bp, Homo sapiens
  chr2:228735796-228735845
  hypo
cctgccttccattcccgcctatccatttaggctgcgacctctggtagtt

SEQ ID NO: 85968 - DNA, 142 bp, Homo sapiens
  chr2:228736154-228736296
  hyper
tagctcctctgaggtcgcccttagtgaggacacgaggtgccctcacctctttcactctagacacctccagaacactcgccccccgcgcgccggagccccgggtcgccaccaaccgcccgcggagccagacctcccagctctg

SEQ ID NO: 85969 - DNA, 248 bp, Homo sapiens
  chr2:228736335-228736583
  hyper
cgcgtcccgctgctgtttagccgtttccaaggctacgaagcccatcggccggggataagagagcaagaaaatgaagctcaagagcctcctgctccggtattacccgccaggtacgcaccagcccggccccgtcatccccacgtgggaccctgggctcccagactgggagggtttggggcggaggagggcgcagccactgaaaggcggcggggtccccaggtggggcaggaagtcgggcacttcccaac

SEQ ID NO: 85970 - DNA, 35 bp, Homo sapiens
  chr2:228882048-228882083
  hypo
aggtggtcacttttccggcacgcctgttgcatggc

SEQ ID NO: 85971 - DNA, 215 bp, Homo sapiens; identical to SEQ ID NO: 39759
  chr2:228888319-228888534
  hypo

SEQ ID NO: 85972 - DNA, 64 bp, Homo sapiens
  chr2:229044914-229044978
  hyper
gcacagaaaccacagcgggccttttctgaaccatttgctatccccgcagcgaagggacgcttaa

SEQ ID NO: 85973 - DNA, 30 bp, Homo sapiens
  chr2:229045852-229045882
  hyper
aaggtggaaggaaagcgggggtactttgcc

SEQ ID NO: 85974 - DNA, 638 bp, Homo sapiens
  chr2:229046107-229046745
  hyper
cccctgtagctccagcgaggctgggccggacttatttacaagtgcagtgacccctgtctcctcgctgggagccccgtgcaaaccgaagcgctctggggcaagttggtgagcgactcacaacgcggaacggagtttgatcgacatggtattgggcatagaaagaagcgggtcttaccttggtaccgagagcagggagttgccatccattgttggtgggcgcccagagaagaaagacggaaagtgcaggcgaaggataagtctgtggtgctaggacccagctcccagagtgccagactggcgcgcgccaggagagaggcgcgcaggctggggcggcggcggcgcccacggagactagctcctccctggccagcaagctctgtgcgctgcgaccgcccgctgtcccctcccgccgtcctctctgatcttgcaggagcgcgtggccaacgctcccacctttctgcctggctcctgcctcctgcaggcgggccccagtctcagttgctcgaggatcctgctctatcgctcattcgtgcccagaagcataggtgactccgacaaaattcctctctccccaaccaccatcgtctcccctccctttctcgctggcgtacagtaggtctgagccctgaagttgttca

SEQ ID NO: 85975 - DNA, 157 bp, Homo sapiens
  chr2:230135693-230135850
  hyper
ctccaggctggcccccggctcccgggtgccccttacctgcaggcgctccgtggccggctgccacatcttccagccctgggttttggcagaggagacgctggcgagactgtcgatcgcgccggggggcgaggggctggggtcccgctttacatctggg

SEQ ID NO: 85976 - DNA, 25 bp, Homo sapiens
  chr2:230174052-230174077
  hypo
ccatcgcgcccggccaggaaactgg

SEQ ID NO: 85977 - DNA, 1131 bp, Homo sapiens
  chr2:230578047-230579178
  hyper
aaaaccccaaattcacgggcggctgctggctacatcccatcgtcccatccctcgcaccgcccccacgctttctggcggcttcccggtgccctgctcacgccccggctgccagccccaagcgtgcgccccgtggagcgtccggcaggaagggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttacacacacagggtccagccggacgtggagcgtggaccacctggacattgaacacctcgccggggacgctcggagccggctcctccgcgctgccaaggcgggcaccgctcaagtggttcttggctcggcccggcctggaggggcgcgccactcagtggccaaccggagcgtctagagccccgcgcgagaagtgccgagccccggagcggcacaccccgagagcccggctggccccgcccgggaaccagggcgggtaagggaatcagggtcggcccgggggtccgcgtccacgcgggccaagagactggatccatcttcttcccaaagtgggaaagcctgtgtcaggcgtgcccattgtcgggcagcagcagcagggccggcgggaagaggctgctggtcccggaccagcgccccgcaccgcgcccgccgcttccactcacctggcagttggcgccggagatcccggcggggcaggtgcagctgtagccaggctcgccggcgggggccgggtgctgcgggtccggctcagggcgcgaggtgcacacacccccattccggcagggctgcgcggcgcacggcccgggcgcagacaggggcgcggcgggcaccgggttggccagggagctgcctcggggccccgctccgagcagcagcagcagcagggccagcgcgggcagcagctgcgcaccgggcgcctgggcgcggcggggctgcatggccggccgggagggcgcgggagccggagccaggacgca

SEQ ID NO: 85978 - DNA, 256 bp, Homo sapiens
  chr2:230579495-230579751
  hyper
cagggagccaggcgacgctggggcaggaaaggggctggagaggtccacgagtgagggaagcggggctttgaggggcttccagagccgggagcaccgagtgcgccccaaggcccgggcagggcagggcgcgggaggcggcagggcgcctcaagggaggggcggcgcgctcgcagcagccacctttggcctcttggcgcagaatctgcgagaccgccgcggggcccggccttgcctcatcccccgggactgctcccct

SEQ ID NO: 85979 - DNA, 117 bp, Homo sapiens
  chr2:230600571-230600688
  hypo
gctctgaggcacaagcgaagtgctggctgctgttcccaggactcgagaaccagcgaacacgggctactgcacctggggctgaggagtgaacaagcatgctgccgaggcacaaatggc

SEQ ID NO: 85980 - DNA, 73 bp, Homo sapiens
  chr2:230785500-230785573
  hyper
tgaggaagggagagacgccgaggaagacaggatttgaggttttactaccttcgttattcgaactcccctctaa

SEQ ID NO: 85981 - DNA, 100 bp, Homo sapiens; identical to SEQ ID NO: 39760
  chr2:230795535-230795635
  hypo

SEQ ID NO: 85982 - DNA, 217 bp, Homo sapiens
  chr2:230932847-230933064
  hyper
catcactgtccagttcgagtcccaaacgggcctagagagcagccgggcagcgaggctgggctccgggcagaacgcgcttctccagccggacgggggtgcccaggatgacgctcgcggggccccggccagcttgagcagcaaggcgcgcgtccccaagctccgcctggcggtctgccctgaaccgccggttaccctgcccgcccgcagctcccaagcc

SEQ ID NO: 85983 - DNA, 65 bp, Homo sapiens
  chr2:231170246-231170311
  hypo
ccttcctctgggagccgctgcaatggggctaggcccagctgcccgtagggcgtggtcaggcaggg

SEQ ID NO: 85984 - DNA, 40 bp, Homo sapiens
  chr2:231170527-231170567
  hypo
ggctgaacaaagggccgccagaggccgtgtccctaggatc

SEQ ID NO: 85985 - DNA, 33 bp, Homo sapiens
  chr2:231188088-231188121
  hypo
ggctgcagtgccctgcgtcgccaggagaggggg

SEQ ID NO: 85986 - DNA, 34 bp, Homo sapiens; identical to SEQ ID NO: 27934
  chr2:231191860-231191894
  hyper

SEQ ID NO: 85987 - DNA, 30 bp, Homo sapiens
  chr2:231268620-231268650
  hypo
cagagtattacccttcgttaaatggaatca

SEQ ID NO: 85988 - DNA, 30 bp, Homo sapiens
  chr2:231276161-231276191
  hyper
acttctctgaagtctcgtgtcttctaattc

SEQ ID NO: 85989 - DNA, 188 bp, Homo sapiens
  chr2:231620583-231620771
  hypo
cactggaacccttctcgaaccattgctacttccaacttgggcatctccatactctagggattgtcagtttcaaaactcagacatgtgcccatgtgctgcacatccttcaaggtcacagagcactctgaatggcttgatggtggaccaggccctttggaaggcagcgtcccccccgggagaaagcagta

SEQ ID NO: 85990 - DNA, 103 bp, Homo sapiens
  chr2:231693406-231693509
  hyper
cgccccagggctggggccttggagcctgggaaagcaaccgggggtctctggggagtcctgagcgcaggcgcccgcccacggccaagaccgtggcccagccctc

SEQ ID NO: 85991 - DNA, 132 bp, Homo sapiens
  chr2:231714877-231715009
  hyper
aatgacagaggaagccggggagggtgtttggccaggggctaggcaggattgatttatgttctcaagtgcgccccctggcggctgcggggagaacagccttggcgggggcggtggaggcgccaggtgagagac

SEQ ID NO: 85992 - DNA, 179 bp, Homo sapiens
  chr2:231902993-231903172
  hyper
tcccttattgagcaccgaggtaaactgaggctcagagcagggaggtgcctagagccaggcctcgcagctagcggagagcgggccgtgcgtagcggatcgagtctgtcccggaagggtccggagtgcacgggagatgcctagggggcgtgggaaagctgaggggccgagtagaaggcaga

SEQ ID NO: 85993 - DNA, 105 bp, Homo sapiens
  chr2:232243072-232243177
  hypo
catttctgtgatcaccgagggcttcttccagttgtcctgggtgtcacttggacaccttcctgcttggcacagtgttgctgctcacgctctcgctgtccctctggg

SEQ ID NO: 85994 - DNA, 279 bp, Homo sapiens
  chr2:232276822-232277101
  hyper
ccccccgcggctcctcgtcgccgggcagccaggagctgctgggtgggcgcgggcgtcccggggcgcggtgcgacccagagcccctcgcggaacccgcctgggctgtgcaggggacaacgcgttcggctgtcgagggtgggggagccctgtgtgtgtggtgggggtggcatccgatggatcccgggggcctgcggaggaggtgggcatctcggcgccacccggtgcgcgccccgagcgagggcatctcccctcgagaccagcccgcggagctgcgcgagg

SEQ ID NO: 85995 - DNA, 76 bp, Homo sapiens
  chr2:232283697-232283773
  hypo
gccggcgcccaaaagcgctcgctccagctcctgcacctgctcaactgtgtgctccctttcacgagggtcggaatgc

SEQ ID NO: 85996 - DNA, 18 bp, Homo sapiens
  chr2:232330287-232330305
  hypo
aaaatcacctcaggccgg

SEQ ID NO: 85997 - DNA, 30 bp, Homo sapiens
  chr2:232379667-232379697
  hyper
gtttgtgccacccagcgtactgggtgcttt

SEQ ID NO: 85998 - DNA, 104 bp, Homo sapiens
  chr2:232394918-232395022
  hyper
tgacccgagaagttgcgaggctccccggtggcggggacggggggcaccccgacggagccctcggacccttcccgccctaggacgaccctgcccgcaccgagccc

SEQ ID NO: 85999 - DNA, 426 bp, Homo sapiens
  chr2:232395054-232395480
  hyper
cgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggctcacatgtgattcccgccctccagcgtgctgagtttagcttaacgccgtcacggtgtccct

SEQ ID NO: 86000 - DNA, 169 bp, Homo sapiens
  chr2:232479285-232479454
  hyper
cgcctccaggacctgcgtcctcccagccccacatttgtgcgcaaagttgacggtcaccgggcccgcgcgcttcggcatctcgcgaaggcgctgcccgcgccctgagtccttccctggggctgtacgttggaaaggacagaggtctcctctgcttcgcagttgcaaaagg

SEQ ID NO: 86001 - DNA, 68 bp, Homo sapiens
  chr2:232485651-232485719
  hypo
cgttgttcctcatagcggcatctccgcagtatggatggagatgcggaacatcccgtggcagtcatcag

SEQ ID NO: 86002 - DNA, 79 bp, Homo sapiens
  chr2:232506690-232506769
  hypo
attacaggcgtgagccaccgcgcccggcagccttctcattcttcttgcaggaatcttttaaattcgttatttggaacca

SEQ ID NO: 86003 - DNA, 18 bp, Homo sapiens
  chr2:232526119-232526137
  hypo
aaaatttctactggccgg

SEQ ID NO: 86004 - DNA, 579 bp, Homo sapiens
  chr2:232526660-232527239
  hyper
caagaacgcttcatccgcccgctttaagcacgcgcaccgacgaaagagtttggggagcgagcgcctcgggcttccccggaggggaattttcacccccgccagaggaagagggcccagctgcgccattagcgcgtgcgagggaaaatggaggctcctggtcccacccgcgcaccggcgcctgcgccctgggcgcccaccccggcccgcgaggcggccacggccggagagagagggcaagggaaccagtgccgtgtcgcgccccaccctgcgcccgagcgcagtgccggcgagcccggctccggcccttgagagtccgctccaggccgctccacaccacgagccgctccgcaagtttgcagcgctccgtgctttccctccagccctttgtgttctagcgcgcgtcggaaggaacgcgggaacgcgcgccgtgctgtgcgcctgcgcaagggttcaggcggtgcgccaagcctggagtcaagagtgggcgaggctctcggccgctccgccccgggccgccttcgctccgcccctcgcccgccatttcgtgctccgccgcgtctcccgcgtctggggcgcggc

SEQ ID NO: 86005 - DNA, 63 bp, Homo sapiens
  chr2:232527687-232527750
  hypo
gctgtttgcgcggcccggggatgtacgtggaccctcgagtgctagccccgcctccgctgtctg

SEQ ID NO: 86006 - DNA, 57 bp, Homo sapiens
  chr2:232541188-232541245
  hypo
tgacaagcacacacacgacacacacagagagacacagacacacgcacacacaataca

SEQ ID NO: 86007 - DNA, 29 bp, Homo sapiens
  chr2:232544635-232544664
  hypo
tgagccactgcgcccggcctaaagccctc

SEQ ID NO: 86008 - DNA, 27 bp, Homo sapiens
  chr2:232546676-232546703
  hypo
attaaaagagctggccgggcgcggtga

SEQ ID NO: 86009 - DNA, 28 bp, Homo sapiens
  chr2:232570350-232570378
  hypo
cctgcatgggaataacgtcagaaaacag

SEQ ID NO: 86010 - DNA, 131 bp, Homo sapiens
  chr2:232790653-232790784
  hyper
tggggtagggggctgcgcatgggccgatgttctccggaggctggagaagtggacccccgaatccgcgcttcgagggctccccggctctcgcccacgcgcatctcggaggagacagccgcctgccttccctc

SEQ ID NO: 86011 - DNA, 93 bp, Homo sapiens
  chr2:232791047-232791140
  hyper
ggctgggctgcagggcgagcagggtcccagtgctgcgcggcgccggctgggtgcgctctgagcccgtgactctgctcgcgcctttataatcca

SEQ ID NO: 86012 - DNA, 576 bp, Homo sapiens
  chr2:232791530-232792106
  hyper
cgcagccctgcttgtcgccaaactcttccctgggcacctgacagccgcgggatggcattgcagctccgcctttcacctgccggtcagggcgggagcgcagaccacagcgacgtcgttaggttggggaggcagaggatggggttggaggactggggtgggaggcgcagggagagcggggttcgcctgggccgcaggggggagcgcaagtcttccacactggagagtgcaggggtgtcgccagcctgagtgtttgagcgcaaggcgggaacgaggggactgcgagcgcggaaccaagatattcatgctcatgcgtgtgctccgcggcatcgtatgctcgccagttactgctctaggttcacgttcagccggtttcggccacacagaacgtcccggggtctgactccgctggtgaactccctctgtgggaacaatgcgcacctgaccttgcctgcacccacgcgaggatccgctgctgggggaagcccgctccagtatcctgtgcactttcacaggctggggagagagcttcctagccagcggcccagtccagcctctgccagccgtgacaggtggtca

SEQ ID NO: 86013 - DNA, 33 bp, Homo sapiens
  chr2:232827152-232827185
  hypo
tttttttttttgagacggagtctcattctgtcg

SEQ ID NO: 86014 - DNA, 196 bp, Homo sapiens
  chr2:233165754-233165950
  hypo
tgatggtaatgacagcggctaccattgagcacctcctatgtgttaggcacagtactggggactttacatttgttatctcatttaatcttcataacaaccccggtgtgttattttattattgtcatatttgcagaagctaaggtctagggaactaaagtaattcactcagggtgactcaccacggctgtgagaagca

SEQ ID NO: 86015 - DNA, 30 bp, Homo sapiens
  chr2:233198553-233198583
  hypo
cactgtacttctgctcggggctgctgcagg

SEQ ID NO: 86016 - DNA, 648 bp, Homo sapiens
  chr2:233283249-233283897
  hyper
ccaatgcccagagagcgaccagacatccatgggtagagacccagaagcacgcagaccccagcccctctttccacccagacgagatgaccaaagccccatccctgactgtctcagcttacccctgaaagcctgcactttccctacctgtcgggggcacttgcgcagtgccgcactgacccttggggttcctggctttggcgccagccccagccctcacggagatgtcagcccagcccgccggcgcgtccctccctccctgccctcactgccttccagagggctgggaaattgcggctcccgcggctcggctgaacacttcagttaacccagggaaattacttgcgccttcctcccgcgctctgccgccaagcgctcccctcccctgctttccctttctctcctcttgcgcaccctcctcccacgcgcagggacccctagtcagggccacgccccgggtctgcggccgctggctgggcgctcgggaatcgcactcaggcggatgacgtagcgcgaggagttcctgtaatctaggctgatctagagagagaagagcgcggcggcactgtacacgccctgcaccttgtacagcagctggttgaggtcccagctggttgaggtcccgcgacccccggacgctccgccgcgccg

SEQ ID NO: 86017 - DNA, 79 bp, Homo sapiens
  chr2:233285052-233285131
  hyper
ctggacacagacagacgcttcgcaaaacggccaaagaaccaaactttgtcctcgtggaagtctgcgggatctaccactt

SEQ ID NO: 86018 - DNA, 242 bp, Homo sapiens
  chr2:233285766-233286008
  hyper
ctggctacctggcagcgcggcggcagcggggacctgggtcgggggccgcggagacaggcttccgagggtcgtgcgcgggctgcggtaggggactccggatccagtcgcatcccgggactagtgagggtagcgggtacacccggcaggagtcccctccgatcccgtgtccccactcggaaccgcccaccaaccggttggaaaggagctggagctacgcagctgggggccgtcatggtccagcc

SEQ ID NO: 86019 - DNA, 30 bp, Homo sapiens
  chr2:233302001-233302031
  hypo
ctgtcacagacatggcggctgagtgctggg

SEQ ID NO: 86020 - DNA, 102 bp, Homo sapiens
  chr2:233322912-233323014
  hypo
tggccttcctgcaggcggccgcatcgaccatggtcatcatgagggtgtggcttaccaggcactcactgaggcggtcatgttcgacgacgccattgagagggc

SEQ ID NO: 86021 - DNA, 332 bp, Homo sapiens
  chr2:233350208-233350540
  hyper
tctgtccggggcattcgtaggtcccccactgacagttgggacccctagctttggggccagctccagacctcgcggagacgtcaacccagcccgccggcgcgcctctccctcctggccctcactgcctgccagagggctgggaaattgcggctcccgcggctcctctaaacaccgcaattaccccagggaaattacttgcgccctcctcccgcgctctgcctctgtgcgctcccctcccctcccctctcctgctcgtctcttccctcctctcctctcacgcacccgcctcccgcgcgcagggacccctgggcaaggccactgcgccccggatc

SEQ ID NO: 86022 - DNA, 436 bp, Homo sapiens; identical to SEQ ID NO: 276
  chr2:233350843-233351279
  hyper

SEQ ID NO: 86023 - DNA, 319 bp, Homo sapiens; identical to SEQ ID NO: 27949
  chr2:233351415-233351734
  hyper

SEQ ID NO: 86024 - DNA, 218 bp, Homo sapiens; identical to SEQ ID NO: 27950
  chr2:233351789-233352007
  hyper

SEQ ID NO: 86025 - DNA, 351 bp, Homo sapiens; identical to SEQ ID NO: 278
  chr2:233352101-233352452
  hyper

SEQ ID NO: 86026 - DNA, 257 bp, Homo sapiens; identical to SEQ ID NO: 279
  chr2:233352506-233352763
  hyper

SEQ ID NO: 86027 - DNA, 175 bp, Homo sapiens
  chr2:233352775-233352950
  hyper
cgagtgagggcagcgagtactcccgtgaagggtcccctccgatccagtgtccccactcccagccgcccaccagccggctggaaaggggctggagctggagatgaggagccgaggactcctccgaagggctgggggcggtgtcagtagtgcctgtgtctgccggcacagtccctgg

SEQ ID NO: 86028 - DNA, 509 bp, Homo sapiens
  chr2:233367784-233368293
  hyper
caaacacgcactctgcggaaggccggggcgggcctggccgctgcgggactcctggcccggcgcccttgacgtcagcggctgggccgtgacgtcacctcaccgcccccgccgcgctcccgcccccgcccgcgggcactcagtctccgctaatggcaggcgacggggaatggcacatctgtcttgccgggaattagttcattgaatcaggcggcccgagctgcggcagcgaccttagccctggccccagggaggggtctgggcgggcggcgtgggggaggttcaggctggagggctgagtgcggggacgggaggaggggactcacctggactcgcgagggggactgagcgctctccaaatataggtcaatgtcccgctcagcctccctcccccagcaccgtgaggaccgaggcctggggcctggcgcccgcctggtggacctcgggggcaggctggggaccgggcccctgcgggacgcggcgcggcaggacgctccccgcgcctttctttc

SEQ ID NO: 86029 - DNA, 776 bp, Homo sapiens
  chr2:233388398-233389174
  hyper
aagcctgtctccttccggggaaggagtgagggggctagggccccaaacagagggtgagctgacccctgtcccgcccgcagcagcctcctccagccgcgagcccagctgcagggagcttctggcctgggaccccccccaggagctgcaggcagacgccgcccggctctgcgccttctatgcccgcctgtgcccggggtcccagggcgcctgtgcgcgcctggcgcaccagcagtgcctgcagcgccggcggcgatgcggtcagttctgttcacccggacccggacggggggcagaggggagggggcctggccagcctctgaccgccgctccgactcctgtccggtccgcagagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggtaccccgcgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccggaaagggcttacc

SEQ ID NO: 86030 - DNA, 94 bp, Homo sapiens
  chr2:233405327-233405421
  hypo
gcctgcgctgggatccgcgagactacgaaggcctgtgggtgctgagggtgccgtccaccatggtgtggcggccggatatcgtgctggagaacaa

SEQ ID NO: 86031 - DNA, 162 bp, Homo sapiens
  chr2:233474440-233474602
  hypo
tcacccaagatgagacggaaacagtcccgacacacaatcaatcctcacctttctggccttaccttttggcacacaacacaaaaactccaggtgtgccctgaggcctctgcagggacccggccaggggagtggtggctgaagctcctccgggtctcctttctc

SEQ ID NO: 86032 - DNA, 62 bp, Homo sapiens
  chr2:233497779-233497841
  hyper
gttttggaaacatttcgttccaatgagtgtttgaaaagcagctcccccgccccacgctccgg

SEQ ID NO: 86033 - DNA, 182 bp, Homo sapiens; identical to SEQ ID NO: 27957
  chr2:233498345-233498527
  hyper

SEQ ID NO: 86034 - DNA, 303 bp, Homo sapiens; identical to SEQ ID NO: 27958
  chr2:233498571-233498874
  hyper

SEQ ID NO: 86035 - DNA, 417 bp, Homo sapiens
  chr2:233498895-233499312
  hyper
cgaagaggggggacaccaggagcaggagctctccgggacggagcccaaaagttctcggcggctgccgggcccgagttccaggtcccccaaccccgaccactggtcccgccccctccgcccgccagtccggagatttgctccgaaagcaacttctaggaaagggagccgtcgccgcgcctcacctgccagctttcactgtatccccccaagggaaaaattagcccctgttggccttttatcttttaaaacaaaaggggaaagttaatccttggctgcagcgcggggtctgatgaatgagcggaggccgagaacggggagtttggtaaagtcgttgtaagagattcaggactttcctggagcaggcgcggcccgggagcctcctgggggcgcggggagggggggcggttgtgggaaccg

SEQ ID NO: 86036 - DNA, 30 bp, Homo sapiens
  chr2:233735535-233735565
  hypo
tgctggtttctgcgacgtccttagagaatg

SEQ ID NO: 86037 - DNA, 810 bp, Homo sapiens
  chr2:233740776-233741586
  hyper
cgtcgcgccaggacccgaggacagcaccgcgcaggagcggctggaccagggcggcggtacgggcggggcgggggagggaggggagagggagaaattaggaggggcggggggcggggggcgcggggagaagggccggccaggcgggggctagcaggtgacatggtcctccgtcctccgcagggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcctcacgcgcctgtatgtccgcgcgtgcgtgtccgcgcatgcaggtgtgccagagcgtgagcgcgcgcaggcgagcgctcagggcgggggtgcgcgcggggccgagggtgggtgccgtgcacgcgcgcgggtccggaggcgcgcccgaattccccgcaggggcgccggggcgtgcgtgagcgcacagcatgtccgagcccgcctgcgtgtggcgtgcacctgagcgcgcgcagggccgcgcggctcggcgtccccgtgcaccacggctggagtgcctcaggagcgcgccgcatgtgcgtgcccggtgcgcgtgcgccggggccgccagggcatcggagcgggtgtgcggccagcggtcttagcccgtccgggggcaccgtcacggtcagggccacgccacgggcggccccttctcccggcgccgcctcctctgcctgggcgcgggccgaggccctcgccgcgctccccggggc

SEQ ID NO: 86038 - DNA, 50 bp, Homo sapiens; identical to SEQ ID NO: 39772
  chr2:233750505-233750555
  hypo

SEQ ID NO: 86039 - DNA, 105 bp, Homo sapiens
  chr2:233846572-233846677
  hypo
acccactgggtgtttatacacctgctcgggaacaggcccctctaggtgctggggacagctcagtgagacaggcctggcctccttggagctcgcaggggccaccag

SEQ ID NO: 86040 - DNA, 30 bp, Homo sapiens; identical to SEQ ID NO: 14487
  chr2:233960620-233960650
  hypo

SEQ ID NO: 86041 - DNA, 30 bp, Homo sapiens
  chr2:233969832-233969862
  hypo
gtgcccaagggcagtcgtctgaggcaccag

SEQ ID NO: 86042 - DNA, 36 bp, Homo sapiens
  chr2:233970346-233970382
  hypo
taagagggtagtgaccgcaagcgggccgcctgctgg

SEQ ID NO: 86043 - DNA, 227 bp, Homo sapiens
  chr2:233986775-233987002
  hypo
gttggttaacatgtgcgtttgtttggatgttctgtcctcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacaggtagggagggagggacaggacggcaggaggtactt

SEQ ID NO: 86044 - DNA, 180 bp, Homo sapiens
  chr2:233990977-233991157
  hypo
tttctttgtgagaaacgctccattgccccccaaagaaatcctaatgacagggctgaagccgcatttccaacttgaaggatccatctgaggctgccagggctgccctcctcctactctctcacttggcaaaatatgaagtagatgccgatgggacacatacgccaccgggttgctatgata

SEQ ID NO: 86045 - DNA, 189 bp, Homo sapiens
  chr2:233997086-233997275
  hypo
acctcatcactatggcggtgccagcttccccaacttgtcttcttctcgggtatgtagtgccgatggagagagcttccttcagcttctagctgctccatgactctatttagaattaaagacaccgtcatgctctaaatttcccttgcacactcgtctttgctttcatcagtaaggcgacagccaggcttg

SEQ ID NO: 86046 - DNA, 30 bp, Homo sapiens
  chr2:234059490-234059520
  hypo
cgaggtggctctgaccgggatttgaaggat

SEQ ID NO: 86047 - DNA, 60 bp, Homo sapiens
  chr2:234077773-234077833
  hypo
cattttctcatctcccgctctctgcccagcggctcccaccctgcacgaccctgtttcgcc

SEQ ID NO: 86048 - DNA, 87 bp, Homo sapiens
  chr2:234079049-234079136
  hypo
ggtcatccagctgcccgcccccagccccgaagcttgtcaggcctggatcagcagggcttctcaccagaggcccgggcatgttcttgt

SEQ ID NO: 86049 - DNA, 210 bp, Homo sapiens
  chr2:234079595-234079805
  hypo
ttccagccatcctttcgtcccctttcccctgatttcctaccagaagaatagggaaaattggccagatgcaaaacctggggaatcagaattaaaacgaaagtctctctgtttcagaggaggaagaaatcacgtttgccccaacctaccgttttgagagactgactcgggacaaatacgcctacaccaagcagaaagcgacaggggtgagtc

SEQ ID NO: 86050 - DNA, 30 bp, Homo sapiens
  chr2:234090326-234090356
  hypo
tcctccactctctcccggttctatgaggca

SEQ ID NO: 86051 - DNA, 176 bp, Homo sapiens; identical to SEQ ID NO: 39778
  chr2:234109964-234110140
  hypo

SEQ ID NO: 86052 - DNA, 30 bp, Homo sapiens
  chr2:234199097-234199127
  hypo
atgagtttcggtacacgtatagtgttagct

SEQ ID NO: 86053 - DNA, 30 bp, Homo sapiens; identical to SEQ ID NO: 39779
  chr2:234330364-234330394
  hypo

SEQ ID NO: 86054 - DNA, 244 bp, Homo sapiens
  chr2:234331271-234331515
  hypo
tacacttttaacttgcgctgcccacatacgcccttgtccttaagaaacacagcattgttctggagttactccttggttttcccagtttaaacttaaatattgttgatggtggttacttatttttaattaaagcttttattttgagattctttgtaccctttacccagttgcatgcagtggtaacctcttgcacaactccagtacaatgtcacacccaggatactaacctcgttacagtggagat

SEQ ID NO: 86055 - DNA, 510 bp, Homo sapiens
  chr2:234369602-234370112
  hypo
ccttcactttgccctcgttttaccctgagaacaggcttgctctttgttctcaagtttactttaaaaaaaaaaaaaaaaaagacaactgctggggcatttcctctcacctgccttctagaaacacccctggagccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttcca

SEQ ID NO: 86056 - DNA, 30 bp, Homo sapiens
  chr2:234373355-234373385
  hypo
aagactccagctcgtcgcaggtctgggagg

SEQ ID NO: 86057 - DNA, 67 bp, Homo sapiens; identical to SEQ ID NO: 27961
  chr2:234475179-234475246
  hyper

SEQ ID NO: 86058 - DNA, 103 bp, Homo sapiens
  chr2:234475309-234475412
  hyper
cgggcgccagccgcacttactgcctaaagcccagacccccgccctggccaaaacgcgaagcgaacgaacccgccccaactgggcgccgccatgttggcgaggg

SEQ ID NO: 86059 - DNA, 30 bp, Homo sapiens; identical to SEQ ID NO: 27962
  chr2:234475473-234475503
  hyper

SEQ ID NO: 86060 - DNA, 78 bp, Homo sapiens
  chr2:234737331-234737409
  hypo
gctggagaagggtgccgaccaggaggaagacgaggccctgcgggtgctgtccctgcgcgccctcggcaacatggccct

SEQ ID NO: 86061 - DNA, 35 bp, Homo sapiens
  chr2:234776737-234776772
  hypo
tacgattttcactgggctcacgaagcacatgatct

SEQ ID NO: 86062 - DNA, 30 bp, Homo sapiens; identical to SEQ ID NO: 39782
  chr2:235382081-235382111
  hypo

SEQ ID NO: 86063 - DNA, 257 bp, Homo sapiens
  chr2:235404276-235404533
  hyper
tcgcttttgtctttccgacaactgagccttccacctggggctgggagggcggacagcaggaccggctcttccactccccaccgcggccccccgacctggtcagtagctctggcgttcagacaaaaggtcccctgagctgggggtggggggcaggtcgagagtaggccggtaaatcagacttcgcagctccttaagtcaccagtcctgcatttgggtgcagagattccgttttaaaaattcgaagcatcgctttggtt

SEQ ID NO: 86064 - DNA, 421 bp, Homo sapiens
  chr2:235404550-235404971
  hyper
cgcgggttctcgctcatccatccatccatccatccaaccatccatccatccattcattctttcttgacgcactcgctcgctccccggtcgctccgggcgcattaccgcttcttcttctgcttgagggacttcctgcgtttcaggatcatctcatagagcttgtccatgccctcggtgaggccctcgccgatgatggcgcacgccggctggacgtgataggtggtggccgggataagctcgtgcagcgccagctgcttctcaatctctgccaccggcagcgacttgggcaggtcctgcttgttggcgatgaccagcagcggcgtgccctggttctcggcgaacttggtcaccttgtgcagctccgtcttggcctcctccagccggtccacgtccaccgagtccaccacgtagatgatgccgt

SEQ ID NO: 86065 - DNA, 141 bp, Homo sapiens
  chr2:23546899-23547040
  hypo
cagatctgggacagtcgaggtggccaccagtcaccaggcgttctcaggattctctttcagtttgagaggccacccttatttggataaacatgcgtaccgaattcaagaggcactaataccacggtgcgatgaagtgaaaag

SEQ ID NO: 86066 - DNA, 196 bp, Homo sapiens
  chr2:23570208-23570404
  hypo
acagcatttgctccacggctttctccaagccaagaggaagcatgacgataagagggtgaacaacagccctcgacgtagagaaagtataaaagtctgacagcagaactttaaaagcagagacttcagtggccatggttttcagaatcaaacagttcatctcacccggcagcccgccaatggccgggaacaggcaatg

SEQ ID NO: 86067 - DNA, 30 bp, Homo sapiens
  chr2:23570986-23571016
  hypo
gaatggcgccgagggcggcacagctgctgc

SEQ ID NO: 86068 - DNA, 181 bp, Homo sapiens
  chr2:235859973-235860154
  hyper
ccgggggcccagaggcgcccaggtcagacaaagtgtaaacgattccgaccagagcccttcaatctgcattccgcttcgcaggaaactctcctccttttatgattttcagccggactgccttccctgttgttagtttgtaactttcgctccggcccccgcagcctcgcgcctgccttccctc

SEQ ID NO: 86069 - DNA, 59 bp, Homo sapiens
  chr2:235860892-235860951
  hyper
ctttgcactcccttgcgggcgcagatcgtgccgcgggcgccgatcgtgccaccgccgcc

SEQ ID NO: 86070 - DNA, 1172 bp, Homo sapiens
  chr2:23608475-23609647
  hyper
ggcggagagcaggaacgcgaggaggaggacctggatccgtttcctccggccaggacccgagcggccccagccaccgctacccgccggcgctgtccgctctccatcagccctcctgcgcccacccgcgaccccgggctctctgcgcgtcgggccggggccggagccgcgcgccggaggtaagagccgggccgggctggagcgcctcggatgcggcgccggagggagacccaggtcctggccgccgcgtggggccgggccgggccgggcgtgggagcggggccggaacccggaaccctgggctcggcttcggcggcggcggcggcgacaggagcctcccgcgtctggactcgcaggctgcaggagcccttgcgcctgcgctgctccagggggaaaaaaagggggggaaaaaacttcctgcccccgggtgtgtatgcaccggggctgcctggggccactgtcacggtgttcggaggtgctggaggcttgtgtgacccctggccggagcagcccccctgctgggcccggcggcgcgcgcccctctccaggccacgttcccctgagcggcccagggccccggccgggcaggagacctggaggcgacggagggctggcccccaggggcggccgcgcgcactgtcctttggggaggtgcgcgcctctgtgcagcgagaagccaggttggggttttctgcccctcgcgtcctctgatctcgcatttggggactgggtctctttactcaatcccaagtaactttcgaggtagatgagctcgaaaaccgtcgggagggaacccgcacagaccttattgtgacccaccccaccccgacacacacacgcacacttcccttgacaccttgtgggtgccagcgtgttgtggggggacgcggaaaggagagctcacggggacggcgaagcggccaggaggtggtgtcgttggggaggggttgttgatgtgtgggacagggtggacctggagatgtgtagtgtgggagtgtgaacgcgcgccccgatggcctcggggggccgggggagcccagggctcgcgtcccggtctccgtggcctggagcgggctgagagcgctagggttatctgcggtcgccgcgcgggtgcccgcgctgggcagcgtcggccccgggccccaagggagggacgtgctcgcctggggccggag

SEQ ID NO: 86071 - DNA, 174 bp, Homo sapiens; identical to SEQ ID NO: 27088
  chr2:23609896-23610070
  hyper

SEQ ID NO: 86072 - DNA, 90 bp, Homo sapiens
  chr2:236256461-236256551
  hypo
agtgtgatgagtcatcgcgacctcaaacattaccagattctgtgactcagcacagccagggagctccaagacaatcgtcattaggcatca

SEQ ID NO: 86073 - DNA, 436 bp, Homo sapiens
  chr2:236401968-236402404
  hyper
ccgtggagcaggcagcggcgctcaggaggcagcagcttgagatccacggctcgatttttaaaaattgtaagggagaaggatgcctcgaaagcctctgtggtattttgtcgcatctcgcacccctgtctaaacttcagtccactcgtggagtgtggacccccacgccgcatgggctcaggaggcgcttcgcctttggaaagaaatcgcatgtattaagggaaagcacgtgtgctactttgagaaaggaggcagaaagttaccaaacgcgggaaggggaggctcgccaaccaagcgaggccgtgggacactggcgagtcgcagaggctcctggagccagccgcttggaaacaaacaacaacgcggcgggcgaactcccgggcagcctcccccgtgccggggcgcgggggccgccgcgagaacccgggcaggagctggc

SEQ ID NO: 86074 - DNA, 100 bp, Homo sapiens
  chr2:236402701-236402801
  hyper
agggagggggccggccgggcaggcggcgggcggcgctcggagcgggctccgcggcttgcaaggcgcctgcgactcggtcccaggtcggcgggcggcgcac

SEQ ID NO: 86075 - DNA, 175 bp, Homo sapiens
  chr2:236403151-236403326
  hyper
cccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgcggctccgggcgcggcgcctg

SEQ ID NO: 86076 - DNA, 87 bp, Homo sapiens
  chr2:236403854-236403941
  hyper
caggccaggcctgggcgtcttgctggacgttgaagacgtgttctgagaagtgctgccgctgggggcgaggcccgggccggcgtgttt

SEQ ID NO: 86077 - DNA, 42 bp, Homo sapiens
  chr2:23640423-23640465
  hypo
agacactgaagcagacggaaatgaagtcgtttgtccaggtga

SEQ ID NO: 86078 - DNA, 181 bp, Homo sapiens
  chr2:236417611-236417792
  hypo
cactttagtcgggggcgtggtggtggctgcgctatctgcttcccactcactggcatcctagccgtgtggggtgtgtgctcacctgcagccaccctcacctgcttgaaccagatttacctagagggtggtgtgaactcatgtgatgtgaacgattacttatagttaccgtgaaaattaatgg

SEQ ID NO: 86079 - DNA, 193 bp, Homo sapiens
  chr2:236452425-236452618
  hypo
gtggtagtgtcagggcggtagccatctgagctcacactggccctaggggctgtactttggggtatccaggggcaacacgtgccctctaaaagcatagacctgtcagggaatcacgggatggttccagggtaatatctggtcaagggcttgcggcagataggaagagttctctctctgccgcctgtgcccaggc

SEQ ID NO: 86080 - DNA, 125 bp, Homo sapiens
  chr2:236577930-236578055
  hyper
catgagttgcatcttcgaggctgcatggttaggaaagatgcctcatttaaacgcgcagcaggtgagacatgcccctcgttttgttcttgcaggccaagccccagagtgggcgtggttttagggtg

SEQ ID NO: 86081 - DNA, 221 bp, Homo sapiens
  chr2:236579027-236579248
  hyper
ccgcacccgcagcaccgggcagctggaactggggcggctccggccgtgcgcacgcggcctggaacccgcggacctggccggcagcgccccggccgaggaggagggacgcggctcgcccgcgtccggcagccccgacgtggagggggcccgggccgcgcccctgcggcggagcctgagcttcaggcactggagcgggcctgaggcgccgcaaggccggacac

SEQ ID NO: 86082 - DNA, 42 bp, Homo sapiens
  chr2:236877226-236877268
  hypo
tagcaacttcaaagccgacggcctgtccggcactgctgaagg

SEQ ID NO: 86083 - DNA, 163 bp, Homo sapiens; identical to SEQ ID NO: 27972
  chr2:237068390-237068553
  hyper

SEQ ID NO: 86084 - DNA, 61 bp, Homo sapiens
  chr2:237068626-237068687
  hyper
cgcagccgggcctcctgcctctctccctcgaggcccacggggtgcacggcttcctgcagga

SEQ ID NO: 86085 - DNA, 16 bp, Homo sapiens
  chr2:237068925-237068941
  hyper
gcggtggaggctaggg

SEQ ID NO: 86086 - DNA, 357 bp, Homo sapiens; identical to SEQ ID NO: 281
  chr2:237072641-237072998
  hyper

SEQ ID NO: 86087 - DNA, 16 bp, Homo sapiens
  chr2:237072999-237073015
  hyper
ctcacactcgctggcc

SEQ ID NO: 86088 - DNA, 440 bp, Homo sapiens; identical to SEQ ID NO: 283
  chr2:237073056-237073496
  hyper

SEQ ID NO: 86089 - DNA, 138 bp, Homo sapiens
  chr2:237073564-237073702
  hyper
cgcttgcctcctccgggcacccacctcctcctctgccgaagtttgccggcctactaggtatcgattaggctgtgcaaaagggggagatagatttctaaggtgagaattaggttttcttaaattcgtaatcctatcggc

SEQ ID NO: 86090 - DNA, 55 bp, Homo sapiens; identical to SEQ ID NO: 27979
  chr2:237075130-237075185
  hyper

SEQ ID NO: 86091 - DNA, 370 bp, Homo sapiens
  chr2:237075817-237076187
  hyper
ctcggccaaacgcatcgtcagatagatatgtggcccagggcagcagctggtcgccgggcgctaaacgccccccctcccgagaccccgcttgttgggtggctctgaatgtcccccggaggcccagcggcacagccgggcctcatcctccagctcctcccgcgggggtcgagcgggggcgcggcctcgcccccttggtctcccgcgggaacccggcgctggcccgcccccgcctcctcccgccccctcgtcccggctgcgcgcgccgccgactcaccgagcgaagcctgcaccgtctcggccgcggagaaggcgagcagcgagccctctttggccaggaagcctttgccgtcctccgcgtcagcctgcagcg

SEQ ID NO: 86092 - DNA, 78 bp, Homo sapiens
  chr2:237076558-237076636
  hyper
ctactccccagcgggcgctgcatcatcatcagcgacggcgggaacgctgcgctcatagacgcgctcggtagaggccag

SEQ ID NO: 86093 - DNA, 91 bp, Homo sapiens; identical to SEQ ID NO: 27982
  chr2:237076656-237076747
  hyper

SEQ ID NO: 86094 - DNA, 15 bp, Homo sapiens
  chr2:237076991-237077006
  hyper
cggcgtacttatctc

SEQ ID NO: 86095 - DNA, 207 bp, Homo sapiens
  chr2:237077033-237077240
  hyper
cgcgctcctctttctcattcacattttgcctgccgcctggcccggctcgcctcacgtggggctgggcgcctctggccattggctgagcggggcgggggtggggcgaaagcggggccccgccctttccacccaagctggcctcgagcgggctgcgggcgccaccgtcggagcgcgcgggccggggagccggagcctgcatgcctagcc

SEQ ID NO: 86096 - DNA, 315 bp, Homo sapiens
  chr2:237077284-237077599
  hyper
cggaccttggggccctgcagccttgtcgaggccacctcgaagggtagcctccggggcccgcacccccacggctgggccgggggcgctttatttcttttactgtatttgccatggaaccaacctgcctgcggctcactccagcgctgggtgctccggctgcgcctggggtccgggcgagggtcctggagttgggggcagggtcctgcccctccggagccacccccggggcgaaggctgggagctggcagcgcctgcccgccgccagaaacccgccgggttgctcgctgtaggtccgcgcaccgggtggggcgggga

SEQ ID NO: 86097 - DNA, 60 bp, Homo sapiens
  chr2:237077904-237077964
  hyper
gagtgctcaccctggcgccgccgcccggtttccagcgcgaggactcgagggcgcgcggtt

SEQ ID NO: 86098 - DNA, 323 bp, Homo sapiens
  chr2:237078192-237078515
  hyper
cgagcggggcttcctcgagtctccaaggcccgggcttcaacttcccgggtctagacgtcagccctgaaccgccaacagcaccgggttggggagaaggaaagaagggcattgttagttcggtcattaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccggggga

SEQ ID NO: 86099 - DNA, 42 bp, Homo sapiens
  chr2:237079083-237079125
  hyper
tccttccttgatttacgtggctacagccggggcccttccggc

SEQ ID NO: 86100 - DNA, 258 bp, Homo sapiens
  chr2:237080173-237080431
  hyper
cagcccagcccaatccggaggaggaagcaccgcgaatggcgcgcttcgctgccgccgccagagtcgaggtaacgggtggtcgtggagagggtacggtgtggccacccgtggtctcggaggacgcggggaatcctgcgggcctcgagggtctggcgctcccgccagtcgcccagtcctaggcgacaggctggtttctcgggcaaccgagttgtttttatttacagggattttgagaagcccgatcgtttggtcattgcc

SEQ ID NO: 86101 - DNA, 245 bp, Homo sapiens; identical to SEQ ID NO: 27987
  chr2:237081182-237081427
  hyper

SEQ ID NO: 86102 - DNA, 18 bp, Homo sapiens
  chr2:237081536-237081554
  hyper
ggccgggatccagatgtc

SEQ ID NO: 86103 - DNA, 377 bp, Homo sapiens; identical to SEQ ID NO: 285
  chr2:237082343-237082720
  hyper

SEQ ID NO: 86104 - DNA, 108 bp, Homo sapiens
  chr2:237086290-237086398
  hyper
ggcctctggaacatctaaaaacagaccagaggccacccaatggaacaggatgcagtgtgacatttcacaacatacgacgcctctcctgggaagggagagctcgcgagc

SEQ ID NO: 86105 - DNA, 671 bp, Homo sapiens
  chr2:237086399-237087070
  hyper
cctctactgggtgggcgcagcgccatccccattgcacgaaccgagacggaggtgcggaggccgtgtctggccctggagagtcctccctctgtcgtctgctctcagcaccaagtctggcatcgccagggcgccaggcacggccttcccagggagaagccttttctgtcatttttgattattttactttaaatatgtgtgcaaaaccttagctacattctcgtgggccagggataggcaacgcgtgcacctagacctcttgcttgcccccacactccgtctccccagggccaccccctcaacccccccatgccatcagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgcttttactgctctcctcctc

SEQ ID NO: 86106 - DNA, 196 bp, Homo sapiens
  chr2:237087422-237087618
  hyper
cagggaaacttgggccggggagggaccaggaccttctgagccccccaactcccccgcctccccggcctccgccgtcccttattccgaggaggggcgcccgtggggtaacacgttggcgcgagggtcgggggcgcatttatccttaagtgcgtttattaaatcgcgtctggagatggatggacgtggatacaggaga

SEQ ID NO: 86107 - DNA, 228 bp, Homo sapiens
  chr2:237088011-237088239
  hyper
gattataaatgttcacgcaatcaagttcattaggacttcaaatcgcatttctgattgggatcgctctgccgccgtcctcccagcgcctttcaaaccccagcgcttggctttcaaaacatctttttgaatttaaagcctcacatccttttgtcttccgacgccccctcccgccccacccctcccggcggctgcaagctcttcgggcctccttcccggggcaacagccct

SEQ ID NO: 86108 - DNA, 301 bp, Homo sapiens; identical to SEQ ID NO: 27995
  chr2:237145136-237145437
  hyper

SEQ ID NO: 86109 - DNA, 311 bp, Homo sapiens
  chr2:237145438-237145749
  hyper
cgggttcccagcactaaacgtgggcgactttccttaatcttcccccagagacagaaggccatgcaatgacaactccaagggcaggggctggagcattttgactaacagaaaagtcaggatgacacaatgcaagccgagaaaccccacacgagtcctgtgcaaagacaggtggccccgctgcctttccgagacccggagcacacgctgggagggcgctctctggggacgggggctgcgggacccccagaccccgcgcccgggcgcgaactagctgagcggccgctgggcctccctagaggccggcacagctc

SEQ ID NO: 86110 - DNA, 34 bp, Homo sapiens
  chr2:237145963-237145997
  hyper
cgctaattaaacccgcgggggccggggccggggc

SEQ ID NO: 86111 - DNA, 560 bp, Homo sapiens
  chr2:237146057-237146617
  hyper
ggccggggccggggcgcggggcgagggccgggaggtgccaggtctggggtcccgggtcagggatcttggatctgggtcccgaggcaggggccggggtagggacggggcggatgcgggtctggggatccagtgggcagagtcaagggtgcagggtctgggtccggaggcgggggctgggacggaggcggaggcggggtcggcggtctcgtggggggaggcgggcgtctggtctcggggcggggcggacgccgcgggcctgtcccgaggtccttacccgagcgaggcggccgtgcggcagaggtgcagaggcgccaggccctcggcgctgagcaggtcggggtcggcgcggtgctgcagcagcaggcggacgcaggcggtgtggcccccgaggcaggcctcgtgcagggcgccgcggccgccggggctggcgtctgggtctgcgccgcggccgagcaggtgtcgcacgcaggcggtgtggccgtgggccgcggcgatgcacaggggcgtggtgagctcacgcttgtactccagggtccagaggcctgcggggagggaggtgg

SEQ ID NO: 86112 - DNA, 359 bp, Homo sapiens
  chr2:237416070-237416429
  hyper
cgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgcttggcgagcctgctccgggccccagcacttagcctgtggtcctccaggccgtcttcccgctttc

SEQ ID NO: 86113 - DNA, 30 bp, Homo sapiens
  chr2:237486176-237486206
  hypo
aaggaaggacacactcgagatgtgggaacc

SEQ ID NO: 86114 - DNA, 92 bp, Homo sapiens
  chr2:237544340-237544432
  hypo
ggcgcagagccaacccgccgcacctgctgggccccaccggctgttatcctgccttatccacccgccctccccactcccgaagaagggctctg

SEQ ID NO: 86115 - DNA, 81 bp, Homo sapiens
  chr2:237904291-237904372
  hypo
attgcagatgattatcgttaaactatttttacattacagatcatttctttttagtattattattattattttttgagacgg

SEQ ID NO: 86116 - DNA, 314 bp, Homo sapiens
  chr2:238280498-238280812
  hypo
atattcggggctcagcgagatcttcaccagctcctcctggtctgcgttcctggcgatcgtgaaaggggccacgccaaactgcttgagctccaccgccgggtcgtccacctcatcgtcagactttccagacgagatgaggaccaggaactgcgggacgccctcttcaatgcggctccccaggggcctcttgaagatgttcctggacacgtactccagggcattgcccacgttgatctgccgccctcccttgggcctcagccgctgcaccgcgttctgcacttcatccttgctggaatgggcgttcagcaggaact

SEQ ID NO: 86117 - DNA, 377 bp, Homo sapiens
  chr2:238395078-238395455
  hyper
cgggcggactggagacggcggctcgccttgggaccctctgagcttgcgggccccgctgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgagggtacgctctctgcagcagaaagccctgggcttaaagtcctatttattatttggcgttgccacttactg

SEQ ID NO: 86118 - DNA, 157 bp, Homo sapiens
  chr2:238395729-238395886
  hyper
tccggggctctcccccgcactggcgcttcccgcgcgggcgccccaggtgtccgttccgttccgccctctgcctggcagggcatccagaggtgtccgcgctcccggagctgggcggagcggggcgcagcccacgtggttcgggcgggaggcgccggga

SEQ ID NO: 86119 - DNA, 129 bp, Homo sapiens
  chr2:238475087-238475216
  hypo
ccaaggtcccagctccgtgcacacgcaccctgatgcctgtgtgacgctgctcctgccccttctcccccaggccgtgtcctcctcatttggatctcccctccagcggggcctcctcggaggagccaaggg

SEQ ID NO: 86120 - DNA, 30 bp, Homo sapiens
  chr2:238490173-238490203
  hyper
aggcatgagccactgcgcccagcctctcta

SEQ ID NO: 86121 - DNA, 110 bp, Homo sapiens
  chr2:238535875-238535985
  hyper
cgccctggcgcgcgtcgctccgcgattaccggcccgccaaacagtccccgcaaagtccaccctccggggctcccggtccctcaggtcccgcgtgcccggccctgggcatc

SEQ ID NO: 86122 - DNA, 849 bp, Homo sapiens
  chr2:238536004-238536853
  hyper
cggacccccatcgtccctgacacctggcgtctccgccccccgcccccgtcccccgccccgccgtccctggcccctgcagtccctggcccgcgctgcggacctccggctctggcttcccccgggtccccgcggcccccgtccccccgcgtccccgcgtccccggcccagcgcccgctgacgccatgacgccgcggcggagggaggggccggggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgggctggccgggtgggggcgagcgccccgctttgttgtgcggcatgggaggaggcgggggcttaggcccgacctggaggcagtggacggtcgccggaggccacatggccctgctgaaatggccgagtcgctcaggtgaccat

SEQ ID NO: 86123 - DNA, 30 bp, Homo sapiens
  chr2:238768112-238768142
  hyper
cctgcaaagttttaccggccctgggcgccc

SEQ ID NO: 86124 - DNA, 30 bp, Homo sapiens
  chr2:238768375-238768405
  hyper
taggtccaggggtcccggccgagctccctt

SEQ ID NO: 86125 - DNA, 18 bp, Homo sapiens
  chr2:238833221-238833239
  hypo
actcggtctcaaaaaaca

SEQ ID NO: 86126 - DNA, 73 bp, Homo sapiens
  chr2:238864558-238864631
  hyper
cccctggaccccaggcgaggccaccagcgcccaccatccaaagggcgacagggaggcgtccccccaaccccgg

SEQ ID NO: 86127 - DNA, 573 bp, Homo sapiens; identical to SEQ ID NO: 28006
  chr2:238864726-238865299
  hyper

SEQ ID NO: 86128 - DNA, 66 bp, Homo sapiens
  chr2:23893248-23893314
  hypo
cacgactggactcgccgaccggtgtgatgggcaggggggtgtgctgggcaccgtgcctgctacaca

SEQ ID NO: 86129 - DNA, 46 bp, Homo sapiens
  chr2:239039796-239039842
  hypo
catggctcacgtgcccgcccggcagctgcggcggctgagccggcag

SEQ ID NO: 86130 - DNA, 368 bp, Homo sapiens
  chr2:239050963-239051331
  hypo
cttcagagccttgcccgtggacggtcaccttgtattctaattcctggcagtgggagatctgggggttccatatggggggccagggtggatggctgtgggagagcctggggtcctgggagacctaggcagtgactgcttaccggccgttcctaagacagccagcatttcccactgagccgggacaccctcgtgccgcctgctggaggccacccagggagcaggggcagggagaagcttatgcgtggcgctgcggacctgctatgggatcggttctgaagatggttcaggaactccaggaatgcccctgaaaggcacatggtgcaaggagggagcagcttgtgcactcgggcacacgccatctccagcaa

SEQ ID NO: 86131 - DNA, 84 bp, Homo sapiens
  chr2:239051823-239051907
  hypo
tttaggccctggagccggtgtacaggcctccacggccaagactgcaccctgtggggtgggcggcctggccgctgcctcctcccc

SEQ ID NO: 86132 - DNA, 30 bp, Homo sapiens
  chr2:239071498-239071528
  hypo
gggacacacacaccccgctgtgagcagggc

SEQ ID NO: 86133 - DNA, 240 bp, Homo sapiens
  chr2:239072151-239072391
  hyper
tggggcacttctgcccgagcttcccaaatcttgagggaaacgggagccgctgcagggtcaggacgcaaagactccgaggcccttcaggccgaggggacgtcgccctcgccccacccctgcgcccggcaggcccctggtctcgctagcacctgtcgttcagggctggacccacgcggcgggcgggtgaggggtccctggcgcgcggccaccgctcgctctgtgccaggtgcggtgcggcag

SEQ ID NO: 86134 - DNA, 45 bp, Homo sapiens
  chr2:239072429-239072474
  hyper
cgccgggccggtcgctgcgagcctcgccccggtctcggccaccgc

SEQ ID NO: 86135 - DNA, 30 bp, Homo sapiens; identical to SEQ ID NO: 39787
  chr2:239083135-239083165
  hypo

SEQ ID NO: 86136 - DNA, 43 bp, Homo sapiens
  chr2:239132262-239132305
  hypo
tacaggcatgagccactgtgcccagccacggtggcatctttaa

SEQ ID NO: 86137 - DNA, 30 bp, Homo sapiens
  chr2:239133018-239133048
  hypo
accttctgatggccacgctcaggaccttga

SEQ ID NO: 86138 - DNA, 30 bp, Homo sapiens
  chr2:239133524-239133554
  hypo
agtggccaagccttacgggggatggatcaa

SEQ ID NO: 86139 - DNA, 113 bp, Homo sapiens
  chr2:239133985-239134098
  hypo
tgcccaggagcatggcgatgccctctgctgagagccgggtgcagctgtggcccatgtggatacgtgcaagagcaccagggcagagctctcccctgactcgtccctgggctttt

SEQ ID NO: 86140 - DNA, 267 bp, Homo sapiens; identical to SEQ ID NO: 28008
  chr2:239140138-239140405
  hyper

SEQ ID NO: 86141 - DNA, 165 bp, Homo sapiens
  chr2:239147044-239147209
  hypo
tgcctctcatctccccgctgaagtggcaagttcaagcttttgtttagcccagggctgcctggaacactagtgcccagcaccatttctgccacctctgcccccagagcccgcacagggctggtgaagcctgggtgggtgaacctgggagagcgctggcagctctac

SEQ ID NO: 86142 - DNA, 215 bp, Homo sapiens
  chr2:239147417-239147632
  hypo
agatccagggagggccgggcccacccccgcaggactctggctggcattggtcaccaaggcctccagacactccgggcaatttgggctgtggtcaggctgcccagggctgcgggcaccaagtcgggcccctcagcaggagcctgactcagttcagcctcaggggcctcctccaggtcggagcacaggtcgtccccaggacccggggggctgggtat

SEQ ID NO: 86143 - DNA, 78 bp, Homo sapiens
  chr2:239152958-239153036
  hypo
tgatgcttggcatcacgtaaacaaattcacaagatgatcctattaagtcaactgcttggcacgcgctgaagctacagt

SEQ ID NO: 86144 - DNA, 30 bp, Homo sapiens; identical to SEQ ID NO: 39790
  chr2:239183260-239183290
  hypo

SEQ ID NO: 86145 - DNA, 41 bp, Homo sapiens
  chr2:239186621-239186662
  hypo
gcattaacaagcacacgcacaaggggcgctgcagccatcag

SEQ ID NO: 86146 - DNA, 86 bp, Homo sapiens
  chr2:239265701-239265787
  hypo
agccaccgcgcctggccgggaatgtttttaagtcttttttttaaatacatgttctattgtacctggttccccgcagtctccctcac

SEQ ID NO: 86147 - DNA, 30 bp, Homo sapiens
  chr2:239317559-239317589
  hypo
gaggaagaactttggcgcctactttctcaa

SEQ ID NO: 86148 - DNA, 184 bp, Homo sapiens; identical to SEQ ID NO: 39792
  chr2:239322426-239322610
  hypo

SEQ ID NO: 86149 - DNA, 67 bp, Homo sapiens
  chr2:239482485-239482552
  hypo
aacacaaagcttatccgagcgctttttttttcttaaaactcccaattggctgcgtgatgtgctttgt

SEQ ID NO: 86150 - DNA, 30 bp, Homo sapiens
  chr2:239482782-239482812
  hypo
gcttccatcctgccccggcacggtgtcaga

SEQ ID NO: 86151 - DNA, 181 bp, Homo sapiens
  chr2:239684667-239684848
  hypo
cagtcacaggcacatcgagagcgagaggcaatgcaagtggaaatgccaaagcaacagagggatgcagcaggtgacaagctgggcaacccggagttacctggggcctgtcgagtaagccctgaggaaggcggctgctcatgagaaggggagtggccagagagcagggcggggagcctgggtg

SEQ ID NO: 86152 - DNA, 30 bp, Homo sapiens
  chr2:239705259-239705289
  hypo
tgcgcactgctgctccggaaaagggcttca

SEQ ID NO: 86153 - DNA, 86 bp, Homo sapiens
  chr2:239755112-239755198
  hyper
gcggaggaaggagggcggtcaggccgggtggggctgggtgcggtggctctgcagaacctttaggcaccgaactgaagccgcgggtc

SEQ ID NO: 86154 - DNA, 38 bp, Homo sapiens
  chr2:239756425-239756463
  hyper
gccgggcctagggctcggggcggcctgagagtgccctg

SEQ ID NO: 86155 - DNA, 19 bp, Homo sapiens
  chr2:239756487-239756506
  hyper
cgggcgaggacccggcccc

SEQ ID NO: 86156 - DNA, 435 bp, Homo sapiens
  chr2:239757296-239757731
  hyper
gtggcgcatggagggcgcgtggtccatgtccgcctcccactagcgccgcgccacccacctccggaccggcgcgccagggtaggtgctgcgcgcgcgacgggcgccctccgctgcggggggcgggcggcaggggcgcaggggcattggggcctgctcgtgtctcctcggcgaggccccgcgggccgcgggggcttggatgccgtgcgcttttcctcttagcaaggaaggcgggcgggcgggacgctcacagtcccagggacacccctgagtgcagacttccacgcgagggtgtcagttgggaaccggcggaccggtgactcccccggcgggttctgaagatacttagacagatggtcgcagttttcattctcggtggtgtgtgggtgtccgtggttggcggtggaaggagcgagcatcagaaaaacctcctggggc

SEQ ID NO: 86157 - DNA, 163 bp, Homo sapiens; identical to SEQ ID NO: 28012
  chr2:239757898-239758061
  hyper

SEQ ID NO: 86158 - DNA, 330 bp, Homo sapiens; identical to SEQ ID NO: 28013
  chr2:239758125-239758455
  hyper

SEQ ID NO: 86159 - DNA, 30 bp, Homo sapiens
  chr2:239780321-239780351
  hypo
acacacacacacacacgatggaatgtcatt

SEQ ID NO: 86160 - DNA, 271 bp, Homo sapiens
  chr2:239888518-239888789
  hypo
ctcccccagggtcttcggggcaccccacgggagagagcacctgcaaggaccataacacgtgaggctgtgctgagtcctacgacaggcaggaacttgtacttggcccccggcgacccgggcgatttgcgggtcttcctcttggtttaacgaaggctctagcccggttccggagcccaccaagacgctgaagccatcagttcttggcttgcatttctagagccacccgtgtagttgcgagacagtgagaaagttcgcccgagttgcaatcctg

SEQ ID NO: 86161 - DNA, 274 bp, Homo sapiens
  chr2:239957240-239957514
  hypo
ggggtccccgccaggcgcgcccaccccctagcctagcagccccgctctcctgcgggctcccccgtgggccaagtctcctaaactgggccagcctggagtcaggtgcgtgcagccctgccactctacctccttgcagcgaggcctggagggcgttccacgcgtgggcaccgcggccttcggaggcctccagagtcggcctcagtgggcgcgtcctccctcctgctggaggggactggacaccgttaatgacagcgaaaatcgcctggagttgatg

SEQ ID NO: 86162 - DNA, 127 bp, Homo sapiens; identical to SEQ ID NO: 39794
  chr2:239997460-239997587
  hypo

SEQ ID NO: 86163 - DNA, 30 bp, Homo sapiens
  chr2:240003796-240003826
  hypo
cctcatcaggagccccgctgcctgggaaga

SEQ ID NO: 86164 - DNA, 30 bp, Homo sapiens
  chr2:240067129-240067159
  hypo
cacctttcagcccaccgtggtccccaactc

SEQ ID NO: 86165 - DNA, 55 bp, Homo sapiens
  chr2:240080007-240080062
  hypo
ccttcatgggaaacacggagtgacttgtacatgcatcccacgagttaaaaagatc

SEQ ID NO: 86166 - DNA, 197 bp, Homo sapiens
  chr2:240080368-240080565
  hypo
catagcccagctcaccgccaggagcacaccatgcagagcccgccccaccgcgcacccgccctccagacaccaggagagggcggccctcaccgtcagggcaggtcacacccgcccagccctggtcacatggtcccaggccagaccgcacacgcgtgccctccgcgaagaagcgtccagcagggcgagcagaagtgaag

SEQ ID NO: 86167 - DNA, 487 bp, Homo sapiens
  chr2:240103578-240104065
  hypo
acttttgaaagatgtcgcctagagacgccgacttcctgcagacactaaatatcctaaggtaaaatcaggccccctcaaggctagggagatactacctggagcacaccttcctaacgcggtgttccttgccgccacatgcaagcaaagtccctctaccaggacaaacatctgggcatgtacagattcaggactctgccctggggacccggagctgtgtacacagggaaaggtgccccgagagcatccctgggccacactgtctgcagattgggaatgccaccagcaggttaacctataaacatacaacccacagggcttcggggtgcttctcagctcagaaaacaaacacagtcctttgttgaactgatctcctcgtcatggcgagcccctcccctctggctgtcacctgcacagggccccttggctccctccctcccgctgctcagagctcactcagggcggaaacgcagagcggacagatgcagcc

SEQ ID NO: 86168 - DNA, 23 bp, Homo sapiens
  chr2:240165134-240165157
  hypo
accgctcccggctggataaatta

SEQ ID NO: 86169 - DNA, 349 bp, Homo sapiens
  chr2:240168786-240169135
  hypo
aggtgatgcagctatcggcaatggctggagactagctctgcggtctgctcgtggataaccgcgctccctcgctgccgggccacccgcacagccgggcaaaccaaaaggcccactttttcatgctgtacccaccacttctgtttccccgcaggcatcctactttctaaactaacaccttttcactcccgagaattctaacaaatattatacaattcctacccgcatctaccctccacctggacgtagaacccgtgtgggaggcagtcctgcagggtttggggtggaatatcccccctgtcgagtggagacgaggctgacatgaggagtgaataaacgaacacagataaag

SEQ ID NO: 86170 - DNA, 30 bp, Homo sapiens
  chr2:240169782-240169812
  hypo
acccaagtgacaggccggtggcttcaccca

SEQ ID NO: 86171 - DNA, 116 bp, Homo sapiens
  chr2:240213695-240213811
  hypo
ccacgccaggggctgcgcgcacggcccagctcggcccagctcagcccagctcagggcggccacaccaggggctgcgcgcacagcccagctcaggacggccacgccaggggctgtgc

SEQ ID NO: 86172 - DNA, 66 bp, Homo sapiens
  chr2:240216405-240216471
  hypo
ctgcctcggaggcctcggaggcagcacagcccacccaggccaggagctcagcgtctcagcttcctc

SEQ ID NO: 86173 - DNA, 30 bp, Homo sapiens
  chr2:240226977-240227007
  hypo
gcctcagggctgacacggggagtctgcttg

SEQ ID NO: 86174 - DNA, 109 bp, Homo sapiens
  chr2:2402544-2402653
  hypo
ggctcttccttttgacgtaaggccacccacccaccccctttcttgcgtcacatttccagtaattgactccgtaactggacattttttctcccgccgtatctccctgcct

SEQ ID NO: 86175 - DNA, 146 bp, Homo sapiens
  chr2:240270365-240270511
  hypo
cctgccctgccacagcgcatcccctcagggagggtgtggagggctggccgggcaaggggcgtaaggctccagggcctcctttcaaaggagagcccttccaggctaagtcaatccaggttcttccctcaggccgctcacatcattag

SEQ ID NO: 86176 - DNA, 30 bp, Homo sapiens
  chr2:240319982-240320012
  hypo
atgtttcttctgctccggcaattaagacag

SEQ ID NO: 86177 - DNA, 40 bp, Homo sapiens
  chr2:240399164-240399204
  hypo
gaaataggtcactctcgaaagcaagcggacttaattgtta

SEQ ID NO: 86178 - DNA, 30 bp, Homo sapiens
  chr2:240485257-240485287
  hypo
gatggtgttggatcccgtgcaggagacgca

SEQ ID NO: 86179 - DNA, 155 bp, Homo sapiens
  chr2:240505959-240506114
  hypo
cttgacagaggccagcgtcaggctcccgttcttccacacgctggaagctgctgcacagcgggctcagagcctgggctcaggaggcatcccggttactgttgctgtatcctggagggtggcatctcctgggagctgtggtccgagccccttgcaac

SEQ ID NO: 86180 - DNA, 58 bp, Homo sapiens; identical to SEQ ID NO: 39800
  chr2:240566166-240566224
  hypo

SEQ ID NO: 86181 - DNA, 55 bp, Homo sapiens; identical to SEQ ID NO: 39801
  chr2:240582300-240582355
  hypo

SEQ ID NO: 86182 - DNA, 167 bp, Homo sapiens
  chr2:240612421-240612588
  hypo
ggagtcagggccccccggcgtcccgggtgggcggagtcagggcaccccggcgtcccgggtgggcggagtcagggcaccctggcgtcccgggtgggcggagtcagcaccctggcatcccgggcggaggagtcagggcaccctggtgtcccgggcgggctctgccgctc

SEQ ID NO: 86183 - DNA, 348 bp, Homo sapiens
  chr2:240619528-240619876
  hypo
ctcactgggaacacccgggaggcagctttttaccaggctgaggtccaaggccacagggtgtcgtgcttgggcccaccatgcacaaagccttcggtgtcactgcagggctaacgtgggggagggcaccgtcccggcccaggcctaccccttcttctaatgtctccgcatctggagggcccacgccccttcctcttcgcggcggcaggccccgccccttttccctcctgctcagtgctgagcagcgccatgtttacacgtggccagaatcaccagcttaaatattttaaataaaaagaatgatcagtatgtttttttctctatcagaaataaagccgtggctgtttaaca

SEQ ID NO: 86184 - DNA, 30 bp, Homo sapiens
  chr2:240650547-240650577
  hypo
tcatcacccatgaaacgatgggactctcat

SEQ ID NO: 86185 - DNA, 754 bp, Homo sapiens
  chr2:240658183-240658937
  hypo
ggcagtgatgtctgtcggtaccccaaggcctgtgtggaggcagcaaagtgtctgggggacggactggtttcccggctttgctcaagctccgatgcccacgggaggagggtaggaggcagtcgctggtctcggtaggacacgggatgccacgcatggctggttggccaatctgtgtttgggtcaacgcgcccctgtgtgctcggacctggaactgcacctttgtcgggcaccctgagataggaagggctcacaccctgacaggtgcgatcagtcagggcagggaggcgggcagcaggactggccactggccccgataggtgctggtgagctgggcagacactcggggtcttcctcccaccctccaccctgaggacaaggcaggacccccaggagcccccaacccaacgccccccaacccagcgcctcgcttcttccctctcccctccggcctccggaatgtggcgcccagcgacacagacaagcccatcctcaaaagcaccgggtctttcaaggcaggagctctgacgtcatcggagtcacgtgaacctggttccttcacaggttctgaaaaatggacgcaacaaaactagcggtggaaaaagcctttgactcccgccctcaaattcttgccagtgaaatacccggaaaaggagacatggcttttcccttgcaggcaagtcaggctcctgagtgcttctctccaggtcgcagcagggcacggggggcagggagtggagcccggcacttccacaga

SEQ ID NO: 86186 - DNA, 157 bp, Homo sapiens
  chr2:240690401-240690558
  hypo
gtcccgcacgtgccccggctctgaggtttagcctgttggctgatggggggaaaggtgtatggggcctttgtcgacagcacatatgccgggctgtggagtggggcccagggtgcctgcgagtgtctgcactccccaagcatcgcgcaccaccaaagga

SEQ ID NO: 86187 - DNA, 27 bp, Homo sapiens
  chr2:240756273-240756300
  hypo
gggggtggtggctcacgcccagcactt

SEQ ID NO: 86188 - DNA, 398 bp, Homo sapiens
  chr2:240809303-240809701
  hypo
gaggcaaacaggccacggagtgtccgcctttctggaggaaagacgacatgcctctgagcagcccaggctcactgaaaacacacttgcaggatatgcatcaccttcagggcagcacgcagcctcacccgggacacctgtcacttcgacggagaatcctggacatgcagcctcacccgggacacctgtcactccgatggagaatcctggacacgcagcctcacctgggacacctgtcactccgacggagaatcctggacaggcagcctcacccgggacacctgtcattccgaaggagaatcctggacatgcagcctcacctgggacacctgtcactccgatggagaatcctggacacgcagcctcacctgggacacctgtcactccgatggagaatcctg

SEQ ID NO: 86189 - DNA, 167 bp, Homo sapiens
  chr2:240874074-240874241
  hyper
agagtcatcctagagcggtagagggcgctggacctcattcgtcctgtcagctgcgattgtctgtcctttgacaggtctcagcgcagcgttctcactgtgacctccgtgcagcatcaatcacttcgttcctttctctggctctctctgtccaccgcatggaccagcca

SEQ ID NO: 86190 - DNA, 30 bp, Homo sapiens
  chr2:240965962-240965992
  hypo
aaaaatacggattcccggtccccaacgcag

SEQ ID NO: 86191 - DNA, 112 bp, Homo sapiens
  chr2:241074559-241074671
  hypo
ctctctggcactgcacgctcaaccatgttaaacgacacaacattcccttcccttggtgagccagtcggcatcccccaacccagggctctgctcctgccgggccttcatcccc

SEQ ID NO: 86192 - DNA, 181 bp, Homo sapiens
  chr2:241095604-241095785
  hypo
gtcaggtaataagtacgtctcctccgctctaccccttacacaaaaagccgtcgccgtctgcctcttgttctgattctttgttcccaccttacaaaacctgctgttctgccattgcctggtgggagttctcattgtgttttgtagaaacagaatcggagctctgccccgattcatgaagagt

SEQ ID NO: 86193 - DNA, 170 bp, Homo sapiens
  chr2:241107135-241107305
  hypo
agccttgacaaatgccgccagggtgaaattgctctcatggctctggtccggcacagggatgaagcccataaatccagagttcaggggcaggaggctctgaggagggatgaggaccgagggctgctccctgctaatagctgggtggctgcgtggcacgtgccactccaggt

SEQ ID NO: 86194 - DNA, 30 bp, Homo sapiens
  chr2:241157270-241157300
  hypo
acaggtagcatgcaccgcctttccgcacct

SEQ ID NO: 86195 - DNA, 38 bp, Homo sapiens
  chr2:241236738-241236776
  hypo
ccaggacacagcaagcgaggacacgggcttggcatctg

SEQ ID NO: 86196 - DNA, 70 bp, Homo sapiens
  chr2:241262151-241262221
  hypo
agaccttcacagactcgagatctcagtcagctgtggaaggaggaggctgggcccgcgatggctcagggga

SEQ ID NO: 86197 - DNA, 34 bp, Homo sapiens
  chr2:241263378-241263412
  hypo
ttgcagccccagcctcggccgaccctgggagctg

SEQ ID NO: 86198 - DNA, 30 bp, Homo sapiens
  chr2:241264182-241264212
  hypo
cagcattgctcgaggcgctggttcagagtg

SEQ ID NO: 86199 - DNA, 148 bp, Homo sapiens
  chr2:241350165-241350313
  hypo
ggaaagaggagacaccgtccccctgggcaagcggcaaagcaggtaagcagaaaacagccggcaattgaacattcataagggccagtgtagaaggaagagcacccaagcgagggaggcggcccccaccatggcaggtgcaagggaggcg

SEQ ID NO: 86200 - DNA, 58 bp, Homo sapiens
  chr2:241375833-241375891
  hyper
tgggcgtcttctgcccgccgctcggcccagcgcgcctgcaggccgggagtcccagccc

SEQ ID NO: 86201 - DNA, 36 bp, Homo sapiens
  chr2:241392394-241392430
  hyper
agcccgcgcgccgcccggagccgctggagccgccgc

SEQ ID NO: 86202 - DNA, 32 bp, Homo sapiens
  chr2:241393135-241393167
  hyper
gtgtccagacccctgcgcacccgctccggctg

SEQ ID NO: 86203 - DNA, 271 bp, Homo sapiens
  chr2:241393198-241393469
  hyper
cggctggcgactggcatcggggcgcccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgcagtgcgcggcggaggttctgcggcggcggaggggctccttggcgacgctgtcatttgggt

SEQ ID NO: 86204 - DNA, 83 bp, Homo sapiens
  chr2:241398532-241398615
  hypo
ctggagaccgcgctccgggacagcagccgcgtcctgcaggccatgcttgccacccagctgcgcagcttcgatggtgagtgcct

SEQ ID NO: 86205 - DNA, 30 bp, Homo sapiens
  chr2:241515213-241515243
  hypo
gggcctccctggggccggtggcacaggcta

SEQ ID NO: 86206 - DNA, 118 bp, Homo sapiens
  chr2:241542135-241542253
  hypo
aggctcctggggcaccgccgcccactccctccaggctcctggggcaccgccgccactcccgccaggctcctggggcaccgccgccactcctgccagcctcctgcggcacagctgccac

SEQ ID NO: 86207 - DNA, 149 bp, Homo sapiens
  chr2:241543418-241543567
  hypo
ttcccttggggctaccgccccggctcacacctgctggccagcgtatttactccttgctggctgcaccctctcagcagtggctgtgtagaccataaccctgggaacacctgcggggagaagcgcccttggcctggcggcttgggggagac

SEQ ID NO: 86208 - DNA, 51 bp, Homo sapiens
  chr2:241544980-241545031
  hypo
ttctggggtgagtgtcgagatcctgtgtcctgagagcggtagtcagggaga

SEQ ID NO: 86209 - DNA, 33 bp, Homo sapiens
  chr2:241581574-241581607
  hypo
tgctgtgagggagggcggcggagtgcagcgtct

SEQ ID NO: 86210 - DNA, 30 bp, Homo sapiens
  chr2:241581963-241581993
  hypo
accggtgccagcctgcggcatcacccacgc

SEQ ID NO: 86211 - DNA, 30 bp, Homo sapiens
  chr2:241642432-241642462
  hypo
aaatctcactgtgcccgttttcctcaagac

SEQ ID NO: 86212 - DNA, 179 bp, Homo sapiens
  chr2:241647044-241647223
  hypo
cagggcgccggtctccgctgagactctgtgctgtctcttcagagtttggggttgcagtatgccctgcaagctcaaagctttgatcggtgaaagaaaacactgattttcaggtttgtcagcttttcttgctgtaaggatgagcttcgtgactgccaagctctttacgcaccaaaggcact

SEQ ID NO: 86213 - DNA, 39 bp, Homo sapiens
  chr2:241656179-241656218
  hypo
agcctggggcccaggcgatacacccgtgtgctagcccca

SEQ ID NO: 86214 - DNA, 30 bp, Homo sapiens
  chr2:241657313-241657343
  hypo
ctactgaatggtccccgccaggaggggatt

SEQ ID NO: 86215 - DNA, 73 bp, Homo sapiens
  chr2:241662384-241662457
  hypo
gcctcaggagagggccgaggggtgggcagagccctggcctcacgcatctcacacgtcacgcgtcacgtgtcac

SEQ ID NO: 86216 - DNA, 30 bp, Homo sapiens
  chr2:241681007-241681037
  hypo
acgttctctgtgccccggctaggaaaggca

SEQ ID NO: 86217 - DNA, 30 bp, Homo sapiens
  chr2:241717092-241717122
  hypo
agacactgtgagccccgctgaacacccgcc

SEQ ID NO: 86218 - DNA, 53 bp, Homo sapiens
  chr2:241721534-241721587
  hypo
ccaggcagcttcacacgtggcgcgctccgcggcacctccgactccacacgcgc

SEQ ID NO: 86219 - DNA, 67 bp, Homo sapiens
  chr2:241722175-241722242
  hypo
gggtccctccagggccgcccttcccgggcccaggcctgggctgcctgctgcacggggccaactgtgg

SEQ ID NO: 86220 - DNA, 111 bp, Homo sapiens
  chr2:241729006-241729117
  hypo
tcaaaggcagccacccggggaggatccttcccacctgcaagctgcggcccctccatctctggtgtccaccttgggctcacagcccctgccctgccccgccccctgctcagg

SEQ ID NO: 86221 - DNA, 742 bp, Homo sapiens
  chr2:241758266-241759008
  hyper
ccgcaagatccaatccgcttgccctggcaggcctttaattccagcaatgcaggcaccccttggaaagggctgacgcttggggaaggggtcctccagtctctgggggaaagtccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttccttcgtgtcatccgagcccgggcgccgggggcgcgccgccagcctagaccctgcggccccgcagcccctccctcgccgccgggccacacctgttacaggggcgctggctgctgagacgcaggcagtgctcgccggcggcccctcccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcc

SEQ ID NO: 86222 - DNA, 938 bp, Homo sapiens
  chr2:241759042-241759980
  hyper
cgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctcccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagggtgggggaccgacacccggctcggacgcagcgtcccctcccccggcgtgcccctgagacctcgcgggggagggacccggcggcgccccgtcccgaagccccgcgtgcacctgaactt

SEQ ID NO: 86223 - DNA, 572 bp, Homo sapiens; identical to SEQ ID NO: 28019
  chr2:241760224-241760796
  hyper

SEQ ID NO: 86224 - DNA, 280 bp, Homo sapiens
  chr2:241771102-241771382
  hyper
cgtccaggcagcaaccgggccgggatgcgcggatggcgggggtgccgaggtgggcaaagggatcacctggggtcagtgcggggagctctgtggacaccaggatggcaagtcaggaagacgctgcccgccacggtccccctcgggcctgggaagcctggaaggtcagggcctggaggggagctgggtccaggcagggaactcacagcagagacgccccgagggtggggtcgggccaagagccgcagccaggggatgccctgacctgcgctggagaacgatt

SEQ ID NO: 86225 - DNA, 188 bp, Homo sapiens
  chr2:241771583-241771771
  hyper
agtcccaggccaaggcgttgggtggaaccccagggtgtggaactgcaacagccccgcagtctggaaagaagccgccagcagcccgcgcggccccgcggttccacggggcctcgtccccgcccctgccccgctgtaggccccgcctgctataggccccgccccgctgtaggccccgcctgctataggcc

SEQ ID NO: 86226 - DNA, 160 bp, Homo sapiens
  chr2:241771976-241772136
  hyper
gcctctcagcagcgccgttgccatagcaacggcgggtgggtcccgcggggcgagctgagctagggtgagcatcctgtggggtagactatggcggctgggcgcgtgcggcctgtgcggggcctccccggctgcggtgagagcggctcgaggggtcccgtgc

SEQ ID NO: 86227 - DNA, 41 bp, Homo sapiens
  chr2:241859518-241859559
  hypo
ctggccagcaggtgccgtgtggtcagcgagcaggtgcgtgt

SEQ ID NO: 86228 - DNA, 270 bp, Homo sapiens
  chr2:241861858-241862128
  hypo
cttccccactaaggtcggctttgtgcccaagatgccccagcccctgcctggcgggttcaggagcagccagaccaggtgggctattgctcctccccagctgcaggcccggctggagaccaccgaggctcagctgcggaggtcagagctggagcacagcgtggatctggaggaggcccttggccgtctggaggctgccgaggagaggtgaggccaggtgcggggcagtcagggctgcaggaagcacagccatccccccgagaggcagtggga

SEQ ID NO: 86229 - DNA, 145 bp, Homo sapiens
  chr2:241862358-241862503
  hypo
gcctcctgggctcagcgtgggcctctcacgcaaccaggcaccaccgtcccagcctctgagagcggctcagcagcatccctattatagtagctgcatcacgattgtacccatcgctatcagacccctcccccgctccacaggccag

SEQ ID NO: 86230 - DNA, 671 bp, Homo sapiens; identical to SEQ ID NO: 39818
  chr2:241864757-241865428
  hypo

SEQ ID NO: 86231 - DNA, 30 bp, Homo sapiens
  chr2:241868098-241868128
  hypo
agcaagcgtctaccccgtacagcaggcacg

SEQ ID NO: 86232 - DNA, 30 bp, Homo sapiens
  chr2:241873900-241873930
  hypo
tgctccccacaaccccgccccctctcctgt

SEQ ID NO: 86233 - DNA, 89 bp, Homo sapiens
  chr2:241874844-241874933
  hypo
agcagctggcacaggcggagcagcagctggcgctggagcgggcagagcgcaggggcctgcagcaggcctgcggacgcctggagcagcgg

SEQ ID NO: 86234 - DNA, 146 bp, Homo sapiens
  chr2:241896932-241897078
  hypo
ggggcgtccaggcagcggggccttgggggacgctcggtgactcggagccgggatggagggcttgtgccccatccccagggcactgcgcagcgggagagggcgctgcaatgaggaggcggctgctggagtgtcgcttcacctcctcc

SEQ ID NO: 86235 - DNA, 224 bp, Homo sapiens
  chr2:241937658-241937882
  hyper
gggaagggggcagcacggaacgggttcattcaggcactgcctggccagggtcccctcccgccccccgcgtgatgacacgccttcagggcgggcccagcgtctcaggccttagggacacaggtctgtcccaggacggcactgagggcccaggcgcctccaccagggtagggacccagggcggagcatggccccaccacagggcgcgcgcccgcagagccctcacc

SEQ ID NO: 86236 - DNA, 86 bp, Homo sapiens
  chr2:241938205-241938291
  hyper
cccagcgccctgctccgccagcgccccgtcccgcccgcacacctccgcgatgcggcacggcgtcgcctgggcgctgctggtggccg

SEQ ID NO: 86237 - DNA, 30 bp, Homo sapiens
  chr2:241971172-241971202
  hypo
gagtgttagcacttacgttcgccttcctga

SEQ ID NO: 86238 - DNA, 30 bp, Homo sapiens
  chr2:241989234-241989264
  hypo
cctgccatcaccctgcgactcggacccctg

SEQ ID NO: 86239 - DNA, 307 bp, Homo sapiens
  chr2:242004869-242005176
  hypo
tttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgtgagtgtccccgagcctggccgtccctgcccagcccctgcccctcgagggcagcgctggccccggcacctgcagggcggctgtcatgccgtccaccctcctagttcttgcagcagcaagacagacagctgagctgggggttggaggcaccgccctgctggagac

SEQ ID NO: 86240 - DNA, 105 bp, Homo sapiens
  chr2:242006589-242006694
  hypo
ccgctgtccacagaccggggtgctgagttgccgggagctgagcgctgccctctggctctgcctggtgcatcagcagtggcactggagcttcggaggagactggct

SEQ ID NO: 86241 - DNA, 314 bp, Homo sapiens
  chr2:242009344-242009658
  hypo
tccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttg

SEQ ID NO: 86242 - DNA, 30 bp, Homo sapiens; identical to SEQ ID NO: 39822
  chr2:242011200-242011230
  hypo

SEQ ID NO: 86243 - DNA, 122 bp, Homo sapiens
  chr2:242011442-242011564
  hypo
gcggggctcgtgggccgccggcagcatgcacctccatggcaggaggggcagctcgtgagggcctcacgtcagtgtgtgggctggaggcgcaggctgctggtagggcacgcaagagaagataa

SEQ ID NO: 86244 - DNA, 70 bp, Homo sapiens; identical to SEQ ID NO: 39823
  chr2:242021761-242021831
  hypo

SEQ ID NO: 86245 - DNA, 30 bp, Homo sapiens
  chr2:242022435-242022465
  hypo
cctgccttcaggacccgttcattgcagatg

SEQ ID NO: 86246 - DNA, 59 bp, Homo sapiens
  chr2:242128768-242128827
  hypo
acaccctccggtcatcgtcgcagctccaaatgccagccccagctcgaaccctctccttc

SEQ ID NO: 86247 - DNA, 30 bp, Homo sapiens
  chr2:242129507-242129537
  hypo
cagcaccgtcctgatcgatgtgagcccccc

SEQ ID NO: 86248 - DNA, 30 bp, Homo sapiens; identical to SEQ ID NO: 39825
  chr2:242131916-242131946
  hypo

SEQ ID NO: 86249 - DNA, 164 bp, Homo sapiens
  chr2:242138184-242138348
  hypo
tgtctcaacccaccccgggctccaggagcacctgtcacatgttggcacacatgtgcacatgtgaacatagacagtagtgctcacctatatgtacacacacatacacacggaaacatgtccgtgcacagcatgcatgtacacctggtgaccgatcaaaggtgagg

SEQ ID NO: 86250 - DNA, 30 bp, Homo sapiens
  chr2:242143600-242143630
  hypo
aaccctgggacagcacggccaggctggggg

SEQ ID NO: 86251 - DNA, 190 bp, Homo sapiens
  chr2:242148690-242148880
  hypo
ctgccacaggccggccggctgttcgaccacggcggcaccgtgttcttcagcttgttcatggcactgtgggccgtgctgctgctggagtactggaagcggaagagcgccacgctggcctaccgctgggactgctctgactacgaggacactgaggtgagccacccccgctggaccacggtcacacccggcg

SEQ ID NO: 86252 - DNA, 143 bp, Homo sapiens
  chr2:242153667-242153810
  hypo
aaacgctcagggctacgcgggcttaggtatgaatgatccaggtgttaaaaatgctgcactgctattcccagcattgcctgtgttctcagaaagattatccccatctggagggaaggtgccctgcagtgcggccgacactctcg

SEQ ID NO: 86253 - DNA, 122 bp, Homo sapiens
  chr2:242156554-242156676
  hypo
tcttaacctagcaagcgggcatgtgagccggcaggccccggagctccccagcgtagccgcggcatctgtggaaagggagcaggccagttcccagggcgaggagtggacgccctgaccctcct

SEQ ID NO: 86254 - DNA, 159 bp, Homo sapiens
  chr2:242294167-242294326
  hypo
tgcactatccccacccggccctgcccgtctgcaggcagggatcctctgttctggggtgtgtgcaccactctgggcctggtggtgtcattgggggttggttaaaggaaaagccccagaggtgggtggcacatgaggggagcatcccgcacagctgagccc

SEQ ID NO: 86255 - DNA, 33 bp, Homo sapiens
  chr2:24232756-24232789
  hyper
ccaccccaaggagaacggtcctgagggcctgcc

SEQ ID NO: 86256 - DNA, 114 bp, Homo sapiens; identical to SEQ ID NO: 27090
  chr2:24233349-24233463
  hyper

SEQ ID NO: 86257 - DNA, 147 bp, Homo sapiens
  chr2:242436356-242436503
  hypo
tgagcctcctgtcaccgggtgtcacccaccctcggggggctgtggctggatcagcaggctgcccaggacctggacccgagtggctgcttcccgctggggcctccacatgggctggggccaacgtccctcgaccgtgctcctcccttt

SEQ ID NO: 86258 - DNA, 30 bp, Homo sapiens
  chr2:242439539-242439569
  hypo
cagtggggctcaggacgttacaagagccac

SEQ ID NO: 86259 - DNA, 47 bp, Homo sapiens
  chr2:242448500-242448547
  hyper
cgcgaagcccctgttcgtactgagaccccgcccgggatcacgcgcac

SEQ ID NO: 86260 - DNA, 89 bp, Homo sapiens
  chr2:242467414-242467503
  hypo
aatgtggcctatccatgcactggaatattattagccttaaaaggacagaattcctgaccacaacatggataaaccgaaaggactttatg

SEQ ID NO: 86261 - DNA, 46 bp, Homo sapiens
  chr2:242472490-242472536
  hypo
ggccatcatcagctccgccggtccgtccgttcggcagctgcttctg

SEQ ID NO: 86262 - DNA, 36 bp, Homo sapiens
  chr2:242498764-242498800
  hyper
ggcgccggctacggcccttcccgagggccacgccca

SEQ ID NO: 86263 - DNA, 91 bp, Homo sapiens
  chr2:242499035-242499126
  hyper
cggcctctcctggagcgcgcccgagcgtgccgcgccggtcccgggacgcctggctgaggtgtgcgcggtgctgctgcgcctgggtgagtgc

SEQ ID NO: 86264 - DNA, 30 bp, Homo sapiens
  chr2:242501690-242501720
  hypo
gtgccccaagccagtcgtgtcccaggaagc

SEQ ID NO: 86265 - DNA, 134 bp, Homo sapiens
  chr2:242523955-242524089
  hypo
gttgaggagccgaaccgttgaggcacagtagccaggccctcccgagggctccagaagctctaggtttacggggtcaccttcttgtaggtgacgtgaagatgctgagtcattggctgtgtcgtggttgccatgga

SEQ ID NO: 86266 - DNA, 37 bp, Homo sapiens
  chr2:242524369-242524406
  hypo
agtcaccttttttgtcgacggccataccaccctgaac

SEQ ID NO: 86267 - DNA, 51 bp, Homo sapiens
  chr2:242549626-242549677
  hyper
gtgaggggcacgcgccgcaagtcctgcctctgctcccgggcggccccctcc

SEQ ID NO: 86268 - DNA, 120 bp, Homo sapiens
  chr2:242550007-242550127
  hyper
ctgcttccccagccacggggtcttctcccggcccctcatctacttggcagacgcctctcaccggcagcctctgcctccccctggtctttccctcccaccacccaccgtggagtcctctcc

SEQ ID NO: 86269 - DNA, 75 bp, Homo sapiens
  chr2:242554549-242554624
  hypo
caattagatgaaattcgagaccaggcagaaaggatggagggtggggaatctgaacggtgacggggaggggcttgg

SEQ ID NO: 86270 - DNA, 124 bp, Homo sapiens
  chr2:242598673-242598797
  hypo
tccccacgggagcctcggcgagtgttgtcagtcgccccatgccgtgcaggtgctccgtggggcctgtgcgccaagccagatgcacggtggcctcgctctcctatcccggcggtcataccaagag

SEQ ID NO: 86271 - DNA, 99 bp, Homo sapiens
  chr2:242602250-242602349
  hypo
accaataaagtgggccgggcgcggtggctcacgcctataatcccaacttcaaaatcaataaagcgggccgggcatggtggctcacgcctataatcccaa

SEQ ID NO: 86272 - DNA, 30 bp, Homo sapiens
  chr2:242617894-242617924
  hypo
agctggtggaaacaccggagcgcccgctcc

SEQ ID NO: 86273 - DNA, 39 bp, Homo sapiens
  chr2:242625092-242625131
  hypo
actgtcattcagaatcgagtgctgcgttcactgaatctc

SEQ ID NO: 86274 - DNA, 120 bp, Homo sapiens
  chr2:242636865-242636985
  hypo
aaagtacatgggtaaactgtggaacatccggacgttggaatatttttcaaattaaacatgaactagctattaagccacggaaaggcacgctgggaccttaaatgcatattgctgagtgaa

SEQ ID NO: 86275 - DNA, 87 bp, Homo sapiens
  chr2:242637045-242637132
  hypo
gcaaactggaaacagtaaaatgatcagtggttgccaggggcctcgggagggggagagggatgaatcgggaagcgcaggggattttta

SEQ ID NO: 86276 - DNA, 71 bp, Homo sapiens; identical to SEQ ID NO: 39832
  chr2:242672951-242673022
  hypo

SEQ ID NO: 86277 - DNA, 30 bp, Homo sapiens
  chr2:242714055-242714085
  hypo
tccccggctgctccccgctgctcccggctg

SEQ ID NO: 86278 - DNA, 30 bp, Homo sapiens
  chr2:242716305-242716335
  hypo
gaggcggtgggacctcgggggagctcaagc

SEQ ID NO: 86279 - DNA, 284 bp, Homo sapiens
  chr2:24272963-24273247
  hyper
gcggcagctcggaggcgggggtctgcggcccggaggcgggggtctgcggcccgccaccgccccgggcttctcctgtcgcggctgcagtcgttcggttatccgctgctgctgataccccagcctgggtttcggcttcgctttccctgccctactcggcgagctctggaaagcaggacctgctctcggatacccgctgctcggggacctcctcctagcgcgtcccccgccgggcctcccctcggtcgcttccctgcgggccgggctgtgagcggctgtggggacag

SEQ ID NO: 86280 - DNA, 89 bp, Homo sapiens
  chr2:242735157-242735246
  hypo
cctctctcacgaagacgtgggtgtctccagcgggaccctgatcccgcgtggggcgcatggccctctctgctctgcggcccctctcgctc

SEQ ID NO: 86281 - DNA, 782 bp, Homo sapiens
  chr2:242755844-242756626
  hypo
tgctgaggaggggcacgctggccgggggctccgtgcgggtgagtgagtggccgggggctctgtgtgggtgtagtggccggatctgctggggctgcacaccccgggatggggcgggggtggcggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctccc

SEQ ID NO: 86282 - DNA, 180 bp, Homo sapiens
  chr2:242757477-242757657
  hypo
tttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggc

SEQ ID NO: 86283 - DNA, 53 bp, Homo sapiens
  chr2:242762778-242762831
  hypo
acccttggcttcagacggcctccagagccgcgagaggacgcatttgcattgct

SEQ ID NO: 86284 - DNA, 60 bp, Homo sapiens
  chr2:242763132-242763192
  hypo
gcccctcctagcagccgtggcctcctcaggtggggcccagggctccgaggccctgactcc

SEQ ID NO: 86285 - DNA, 99 bp, Homo sapiens
  chr2:242766114-242766213
  hypo
catgcgcagaaggctcgctccacgccacgtgcttcaagcgcgtcgttccgtttagtatgaaataaaggcccgcggggtggagaacgtgtctgttttcca

SEQ ID NO: 86286 - DNA, 132 bp, Homo sapiens
  chr2:242784279-242784411
  hypo
ccagtctatgaaggccggagagaaaggagagaaaggaggatggaatcctgcctgcaggcatctttggatttgagtggctacttcggctcctcctgcgtccccagcctgcctgcctgccgtagtcatgtgagc

SEQ ID NO: 86287 - DNA, 39 bp, Homo sapiens; identical to SEQ ID NO: 39837
  chr2:242791597-242791636
  hypo

SEQ ID NO: 86288 - DNA, 244 bp, Homo sapiens
  chr2:242794852-242795096
  hypo
ccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagcacgaagctctccgatgtgttggagaagctgcaggtgaaggtggcgttgtccccttcggtcaccacgagcagggctgggg

SEQ ID NO: 86289 - DNA, 30 bp, Homo sapiens; identical to SEQ ID NO: 39839
  chr2:242814897-242814927
  hypo

SEQ ID NO: 86290 - DNA, 111 bp, Homo sapiens
  chr2:242815269-242815380
  hypo
ccgccgggaggaagacgagcgccctggccgtgcctgccgtaggccgcacgccgagccctacgaggacttctggatctgggtgtccatgaccgtgtgcgtcttctggctgat

SEQ ID NO: 86291 - DNA, 30 bp, Homo sapiens
  chr2:242827465-242827495
  hypo
catttgctggaggaacgcaggtccagcact

SEQ ID NO: 86292 - DNA, 30 bp, Homo sapiens
  chr2:242829172-242829202
  hypo
ctgcccttcccggtgcggcagatctgtgcc

SEQ ID NO: 86293 - DNA, 30 bp, Homo sapiens
  chr2:242829930-242829960
  hypo
gatggctcaaaacagcggatactgtctcac

SEQ ID NO: 86294 - DNA, 388 bp, Homo sapiens
  chr2:242832880-242833268
  hypo
tggatacgtcccagccgaaatgttcaccgtgaatccggcaacctgtggagctgatttccatttctaaggaatgaggggggatggggaagaaccccccaggacagcaccaacagtccctgcggggacctttcccggacacccggccttctcggcggtgaggcaggtggcggcaccgacaggcccgggggggacctttcccggacacccagcctcctcggtggcgaggcaggtggcggcaccgacaggcccggcggggacctttcccggacacctggcctccttggcaaggcaggtggcggcaccaacaggcccgggggggacctttcccggacacctggcctcctcggcgaggcaggtggcagaactggttccacgtctgatcttcctt

SEQ ID NO: 86295 - DNA, 363 bp, Homo sapiens
  chr2:242833478-242833841
  hypo
ttggttctgtggcctcggtttctgtcttcctgatggcacctctgtgacaggagctcagaccccggcatcagaccggcctccgcagggaggagctgcggtgcccaggccaggccaggaagcaccatggcccactgcctgggcctcacctcacgaacgccaagcactgtggcgggcacaggcggagcctggcggcttcacgcccacaccggcagctcctccctcagcccctcgcccgccgctcccaagtccggcagttctggagcacgggaagctctctgggggttgctgggcagcaggacctggtctgagatgactgagtctgcccaggtcttcacgcgcctaactgagcgtgagcgtgtctga

SEQ ID NO: 86296 - DNA, 247 bp, Homo sapiens
  chr2:242836393-242836640
  hypo
ggactcagtggcctccgggaccctgtctgggcatctccctgggccctgcagcatcttgttcctcccctccagctgctcagcccatcccacgcggagcctggggcagggcgataatttcggcattgtgagtcaagctctcggaacttagtgacggccaagcccgtgtctctcagcacctgggcacctgtgagagcaggagtatgacactccctgccaggggtgggggtgtcaccgcatccctgcccag

SEQ ID NO: 86297 - DNA, 30 bp, Homo sapiens
  chr2:242849495-242849525
  hypo
aaacgtggatgaggacgggaggctgtgatg

SEQ ID NO: 86298 - DNA, 60 bp, Homo sapiens
  chr2:242890284-242890344
  hypo
ggtctgctcagccagcgccctcacctgcggtcggtgagctgtgcacggggaagcagagcc

SEQ ID NO: 86299 - DNA, 84 bp, Homo sapiens
  chr2:242891217-242891301
  hypo
gatcttctcactcttcgatgctaagggggcggctcccggagggtgggctggttgccagtagaaccggtgcgggtcagcccggcg

SEQ ID NO: 86300 - DNA, 172 bp, Homo sapiens
  chr2:242891535-242891707
  hypo
gctgaatctggaagccgggggccaggggtgctccatgtaccgtgggcgttggaagtgggggcgtcttgtgggctcaatgcctgtggagagtgggtgagccctccctgggccgggtgggagttgaggacttactggtgtgagaagaaacctgtacagccgcggtcagggggcc

SEQ ID NO: 86301 - DNA, 30 bp, Homo sapiens; identical to SEQ ID NO: 39845
  chr2:242892372-242892402
  hypo

SEQ ID NO: 86302 - DNA, 38 bp, Homo sapiens
  chr2:242913228-242913266
  hypo
gatgtccaggaagatcgtaaccccatttactcagtcaa

SEQ ID NO: 86303 - DNA, 180 bp, Homo sapiens
  chr2:242925496-242925676
  hypo
tctcaaaagatacttcgagcaaaaacaccggacagaagcgtccgtgccagccccgcaggctgcctgtgtgccaggctatcccgtgccatctgatccgggagaagcaggactttcttgcacaggtactcagcgctgtggctgtgggaggagccgggagggccctggcgtgggtgggcttgg

SEQ ID NO: 86304 - DNA, 159 bp, Homo sapiens
  chr2:242929019-242929178
  hypo
agggtcaggataactcgggacggactcctcccaggagctccctgggcgaaggcggtcccatcggggaagcgggattccctcctccagtagggaagaagcaccctcagcaaggagactgccgaggcgtggggacgctctgctctgcgtttgtggaaacca

SEQ ID NO: 86305 - DNA, 39 bp, Homo sapiens
  chr2:242930454-242930493
  hypo
catggaagctggtgtcgagtcagtcggggacgtggcctc

SEQ ID NO: 86306 - DNA, 30 bp, Homo sapiens
  chr2:242933429-242933459
  hypo
tcgtatccctgcccacgtcccacgtggacg

SEQ ID NO: 86307 - DNA, 30 bp, Homo sapiens
  chr2:242948345-242948375
  hypo
ttctcccaagtaccccggacaggcactgtt

SEQ ID NO: 86308 - DNA, 131 bp, Homo sapiens
  chr2:242985060-242985191
  hypo
aggacggagcaggtgcggctgttacctgaggacggagcaggtgcggctgttacctgaggactgagcaggtgcggctgttacctgaggacggagcaggtgcggctgttacctgaggacggagcaggtgcggc

SEQ ID NO: 86309 - DNA, 76 bp, Homo sapiens
  chr2:24324877-24324953
  hypo
tctgagaaatctagtttgcataaattagatgggaaaaaaatttcatcataggaatgccagccgattctttgaatac

SEQ ID NO: 86310 - DNA, 21 bp, Homo sapiens
  chr2:24584330-24584351
  hypo
tggcacagtggctcacgcttg

SEQ ID NO: 86311 - DNA, 141 bp, Homo sapiens
  chr2:24645761-24645902
  hypo
gatattccctctaagcgagctgctcctccaactgcagaaacacgtccccctgctgcacagaacactcttcactcagagagctgcgtggctccctccctgggccaatttccagtaggtattcctgcccgagtctcagctcag

SEQ ID NO: 86312 - DNA, 63 bp, Homo sapiens; identical to SEQ ID NO: 39480
  chr2:24775908-24775971
  hypo

SEQ ID NO: 86313 - DNA, 18 bp, Homo sapiens
  chr2:25047467-25047485
  hypo
acaggaatggccaggcgt

SEQ ID NO: 86314 - DNA, 30 bp, Homo sapiens
  chr2:25056369-25056399
  hypo
ccccagcagcatacccgcctcccttccttg

SEQ ID NO: 86315 - DNA, 25 bp, Homo sapiens
  chr2:25193340-25193365
  hypo
tttttttttttgagacggcgtctca

SEQ ID NO: 86316 - DNA, 189 bp, Homo sapiens; identical to SEQ ID NO: 14371
  chr2:2522670-2522859
  hypo

SEQ ID NO: 86317 - DNA, 44 bp, Homo sapiens; identical to SEQ ID NO: 39481
  chr2:25241776-25241820
  hypo

SEQ ID NO: 86318 - DNA, 209 bp, Homo sapiens; identical to SEQ ID NO: 27092
  chr2:25354748-25354957
  hyper

SEQ ID NO: 86319 - DNA, 18 bp, Homo sapiens
  chr2:25371415-25371433
  hypo
atccggcctgtcacttct

SEQ ID NO: 86320 - DNA, 675 bp, Homo sapiens
  chr2:25391059-25391734
  hyper
cctagcaagctctcggagcctccggaccgccgcgagcccctgggggagaggaggccgccggctccctggagacagcgcctgcagcttcgcggccgtccgcccaggggccggacgtgggccctccagctcagctactggcggcttctcatgccgcagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaacttaattatggatggcgttgggtctccgcttagaacgggcgggaggctta

SEQ ID NO: 86321 - DNA, 72 bp, Homo sapiens
  chr2:25438800-25438872
  hyper
gacccgaaatacgcccgaggcatttatcctaaaaaacgacaaggtccgggcgcccagcagaacggcccggct

SEQ ID NO: 86322 - DNA, 218 bp, Homo sapiens
  chr2:25439138-25439356
  hyper
ggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcat

SEQ ID NO: 86323 - DNA, 32 bp, Homo sapiens
  chr2:25439961-25439993
  hypo
gggcgacagagaaagaccgtttctaaataagt

SEQ ID NO: 86324 - DNA, 119 bp, Homo sapiens
  chr2:25442329-25442448
  hypo
cattctctacttcatcgaatcctcagcacaacctgtgaggcagacagggcccaattctttctctcccgtctaagcagagcgtaggactggtgaagagagtcactcgaggtcacacagcc

SEQ ID NO: 86325 - DNA, 30 bp, Homo sapiens
  chr2:25476260-25476290
  hypo
gtagaaaaaaatgggcggcatggatgacaa

SEQ ID NO: 86326 - DNA, 63 bp, Homo sapiens
  chr2:25563485-25563548
  hyper
gcggggacgtggggccgaagaccccgctccgcagccgcggcgaggcctcgtccttcactgtgc

SEQ ID NO: 86327 - DNA, 50 bp, Homo sapiens
  chr2:2569541-2569591
  hypo
gtctgacagaaaggccgttcctcactggaggacagcgtttgctaaggtgg

SEQ ID NO: 86328 - DNA, 87 bp, Homo sapiens
  chr2:2575682-2575769
  hypo
gagctttcttcctggcggggttgctttgtcctgcgcgacagcaggagttgtgggcggccgctgcaaggcccgcgctggccccgtctc

SEQ ID NO: 86329 - DNA, 20 bp, Homo sapiens
  chr2:2576136-2576156
  hypo
cacacacgccacacacgcca

SEQ ID NO: 86330 - DNA, 84 bp, Homo sapiens
  chr2:25837886-25837970
  hypo
tatacttctgaccaacgaactataaaattgcggttcccatgacccttccttggactgattagtttgctagactggctcacagaa

SEQ ID NO: 86331 - DNA, 84 bp, Homo sapiens
  chr2:25838030-25838114
  hypo
gaacagtcagatggaggagatgcatagggtgtgttttacgggaaggggcacacagcttccatgccttcccgaggtgtgctacac

SEQ ID NO: 86332 - DNA, 38 bp, Homo sapiens
  chr2:2584798-2584836
  hypo
catgtctgtagagggcggatgtccggggggtgcattgt

SEQ ID NO: 86333 - DNA, 33 bp, Homo sapiens
  chr2:26204584-26204617
  hypo
agctggcatcatacacggcgtcaaaggtgaagg

SEQ ID NO: 86334 - DNA, 145 bp, Homo sapiens
  chr2:26372899-26373044
  hypo
atgggcgtgagccaccgtgctgggctgacaatggcttttcaatggagcatacggacaccgcccgtttccagagaaatcatggccgcatcagtgaaatccttagtgacagtgtggtgccagacattccgtccgctgtcacaacagc

SEQ ID NO: 86335 - DNA, 57 bp, Homo sapiens; identical to SEQ ID NO: 27096
  chr2:26395401-26395458
  hyper

SEQ ID NO: 86336 - DNA, 163 bp, Homo sapiens
  chr2:26395459-26395622
  hyper
gcctccgggaggccagcacgagggggagcggcggggcccggacacacccagccagaaggaggaggccgaccccgcgccgactccgcagatgccgctcgggacttcgttgtccctccaggcgcccgccctggggtcctccatcacccgccgtcacctgggcgcg

SEQ ID NO: 86337 - DNA, 282 bp, Homo sapiens; identical to SEQ ID NO: 27098
  chr2:26396681-26396963
  hyper

SEQ ID NO: 86338 - DNA, 74 bp, Homo sapiens
  chr2:26397014-26397088
  hyper
cgcttccatgaatgctaatggggcccgcggccgcaggctcctcgtctccccgtggggcccggcagcccctcctc

SEQ ID NO: 86339 - DNA, 544 bp, Homo sapiens
  chr2:26401682-26402226
  hyper
tggtcttggggggcgcggccccagccccatcttttcgcggggctgcttctgtccgcccgcacgggggaggggaggaggaggcggaggcggaggcagaggcccctaggagggcgaaggccggcgggttaacgaggaggcgctgagtgcacggctgggctccacgctgatttctcctaatgaattaataatggcgctcgggcgggcgggggtggccggctgcggaccgcggagagagccgaggggaaggccgtggagggaggaggacggcgactcgcgccgggtggggctgaaggcactgcggggtgactcggtctccaggctgcggcgctctgctccgggagtcagggagacctggcctggccccgtactgtcccccgtcccagcccccgcccctggccctgcgggaggggccaggcgtcttccctgagcatggtgccacttccccagtgttggccttgtttcctgctcagcatttggcagatgcgcctctggcccaactaggatgtttccattttacagacgggaaatccgaagcccagagaga

SEQ ID NO: 86340 - DNA, 179 bp, Homo sapiens; identical to SEQ ID NO: 145
  chr2:26407743-26407922
  hyper

SEQ ID NO: 86341 - DNA, 30 bp, Homo sapiens
  chr2:2648264-2648294
  hypo
acagcagcagcagagcgtcccggagttccc

SEQ ID NO: 86342 - DNA, 120 bp, Homo sapiens
  chr2:26521959-26522079
  hyper
gacgaggggaggcacagatcccttagtgcgggttgtgttccgaggccagtgtgggggaaaccagacctagaacgttgtatacggctgataggaccaggtccaccgctgcagcaggctgtg

SEQ ID NO: 86343 - DNA, 148 bp, Homo sapiens
  chr2:26607235-26607383
  hypo
gggcaacatattgcccgaggtcgtgtgatcaatggcggaagcaggactggaatttggagctctgttcagctgagcaggcgtgtattgtataacctcctgtgtgcttagagacactgagatgtggtatgccagtcgcacctcagagtct

SEQ ID NO: 86344 - DNA, 15 bp, Homo sapiens
  chr2:26624992-26625007
  hyper
cgcttagaagcccgg

SEQ ID NO: 86345 - DNA, 86 bp, Homo sapiens
  chr2:2665523-2665609
  hypo
gaccaggcagccaggcgctgcggctgggtccagtgagggcacgcactctgctgattttggtttttttttttcttgaggcggagtct

SEQ ID NO: 86346 - DNA, 125 bp, Homo sapiens
  chr2:2669364-2669489
  hypo
tgccgacagctggagcgaccggggcaggcctcaccttcgtgggaaggggagtcaggtgcccttccacagcagggggtctagacacagccctgcctcacggaacccagccccggctcacctccttc

SEQ ID NO: 86347 - DNA, 30 bp, Homo sapiens
  chr2:26712122-26712152
  hypo
accagggtgccactgcgcagcaggttcttg

SEQ ID NO: 86348 - DNA, 30 bp, Homo sapiens
  chr2:2673084-2673114
  hypo
aggggatttcctccacggtgttggaattga

SEQ ID NO: 86349 - DNA, 18 bp, Homo sapiens
  chr2:26854048-26854066
  hypo
taactaagtgaagaccgg

SEQ ID NO: 86350 - DNA, 390 bp, Homo sapiens; identical to SEQ ID NO: 27103
  chr2:26915677-26916067
  hyper

SEQ ID NO: 86351 - DNA, 466 bp, Homo sapiens
  chr2:26916088-26916554
  hyper
cggggccggctggggctgggggcgggggctcccccgagaggggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccgggccaggccctgaacagggcgctgagagtgagcggcgggagagcgccagtgctccgtatccctgaggatcggcttccacagcctagcaggtctacacctgctgggctctggggaggcatgaggatgtcggaatgcggcacttcggggcacttggggccaccctataacggcggctgtgagtgtacgtgtgtctgcgtgt

SEQ ID NO: 86352 - DNA, 69 bp, Homo sapiens
  chr2:27007856-27007925
  hypo
cccattttgtttatccgttcatctgttggtgtgtattcaggctgtttctgccttcgggctgttgtgaag

SEQ ID NO: 86353 - DNA, 32 bp, Homo sapiens
  chr2:27008352-27008384
  hyper
cgatcccgccgtccccgcgaccccaagcgtca

SEQ ID NO: 86354 - DNA, 42 bp, Homo sapiens
  chr2:27069889-27069931
  hyper
ctctccccaccggatcgccggggagcccggggagggagggat

SEQ ID NO: 86355 - DNA, 1632 bp, Homo sapiens
  chr2:27070287-27071919
  hyper
ggacagggaagcacccgcgtggcgctgggcaaaatcttctcagtggagagaacgcactccgggttcgagacctccccgggtgcagatgcgaactgcggtggccccaagtggccgtccactttgttcatgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtgatggcaggggggtcggtgggcttacccctcccgggctaggacatcctcctctcccccttctgtttctgcgtgaggcgcacaaaagggcggggagccgggtgagcctggggcccggccgcaggggacgcggcgggaggtgtggtttggggttgggaggtggccatcggggctaagccggggcgctcttggggtcctctttgtacgcccgcgaagcgccgtgccgggccttgctcatagtaagcgtttaatgcgtgctcgcggggttgcaaagccctggggtgaggaggcggctcggccgaggggtttcgcgcctagcacgcagtgggccgctttcctagccgggcgcggtgcagtggaccgctggagggctgggcgggggcgcctctggccgggggccagtcctgccggtcccaggatctgcgctgtccccggtcccacacaccacccagatacacaccctccgtccttctcgcctccgagctgggatctgcccagcctggacccgacccggcggtctgttccaccgcccggctaacggagcggacgcctgcagaggactcgcccgccgcctccgagcctcccgcctgagccacaaaggcctcctgcggctgcccagcccggagcgggcgccgagccgggtccctcggctggagcccagcgcgggagcccgccttgcagcatcgatctcagcgggcaccgacgtcgacgccccgggcctggggacggggctgtagtctgagctggagagaagccgggagagggcgaggggaggcctcggttgagaaaagat

SEQ ID NO: 86356 - DNA, 879 bp, Homo sapiens
  chr2:27072152-27073031
  hyper
cgaggagaagacccgcgctgtgcgggggaggggggcctcctgggaaggggagcctcccgaggagggaggggcaagcagctgagaggcggtctcgggcccgaggatcctcagctccaggcgcggggccccgcggcccaggtggccggctgggcgtggccctcggaccggggttagggacccaggatggcagatccgggaccgggctgggctggcttggtgaggagctttgtctccaggcttgaaaccagccggtagcgactcgcttagggttttgtgatcttccgcggcgcccacggcacgcccttttctcgaggagctgaaaggctttgcccagcagcaggtgctgccagggaggcggatctcccttcggggagacccggagaacaatagccgaccctggtgtccatccgacgacaaaccagggccacccaggacgcgagggtgcagttttctggtgctgggaatactccctgcggaacctccgggcacgtgctggctttggggttttatgggggcctggccacgccgggaatcccgtgtgggaggcgctcccccggcctgggggcctgcagacagccacccccccactccggctcgggtgccttctggtgcagcgccgccgcccgccccgcgctgtccacccgctgccgagacgcggcgtggttagcggcgcggagctgccgggcggcgacgcaggtgccaaagactggaggtcgcctcggtgcagcgcgggttcccccgagcagcggctttgtctgccgaggcggccgtagtctaggggctgcagctgtgctttctcagggggagccgtaagggctggtgcggattgtggtcaaattgcggagaagcgggtggaaatgatcccgcaagggtgaggct

SEQ ID NO: 86357 - DNA, 29 bp, Homo sapiens
  chr2:27090275-27090304
  hypo
ctattgatggacattcggtttgttcccaa

SEQ ID NO: 86358 - DNA, 28 bp, Homo sapiens
  chr2:27090604-27090632
  hypo
gagccaccgcgcccggcccccaattgtt

SEQ ID NO: 86359 - DNA, 30 bp, Homo sapiens
  chr2:27165703-27165733
  hyper
gttcactccagttttcgacccaattccatt

SEQ ID NO: 86360 - DNA, 493 bp, Homo sapiens
  chr2:2725048-2725541
  hypo
tgcatctccacaccccggccatgccatcggcacctgcacctccacaccccggccacgccaccagcacctgcacctccacaccccagccacaccgcccgtacctatgtctccacaccccagccatgccatcagcacctgcacctccacaccccggccacaccaccagcatctgcacctccacaccccagccacagcactggcacctatgtctccacaccccggccatgccacccgcacctgggtctccacaccctggccatgctgccggcacctgcacctccacaccccggccacgccaccagcacctgcacctccactccccagccacacctccagcacctatgtctccacaccccagccatgccatcggcacctgcacctccacaccccggccacaccaccagcacctgcacctccacaccccagccacaccgccggcacctatgtctccacaccccggctatgccgcccgcacctgcgtctccacaccctg

SEQ ID NO: 86361 - DNA, 30 bp, Homo sapiens
  chr2:27304380-27304410
  hyper
ctggccaactctcaccgtccacagagcctc

SEQ ID NO: 86362 - DNA, 92 bp, Homo sapiens; identical to SEQ ID NO: 39409
  chr2:2730695-2730787
  hypo

SEQ ID NO: 86363 - DNA, 70 bp, Homo sapiens
  chr2:27319238-27319308
  hyper
tctgcctgtgggagccgtgtgctgctgcaagggattctgggaagtgtaggcttggcgctctcagtgcatt

SEQ ID NO: 86364 - DNA, 119 bp, Homo sapiens
  chr2:27322524-27322643
  hypo
tcctccagggaggagcgtgcaggaagcactgagattcgggtgccaggtggccggcaagaagtgtggcctgcagggctttgatggcatcgtgtgagagcaggtgccggctcctcacacac

SEQ ID NO: 86365 - DNA, 481 bp, Homo sapiens
  chr2:27341629-27342110
  hyper
ggaggccacctaccccgcgcggccctggctggctgacggcgatgggctcgggtctccggccggccggggcggggtgtcacccacctgctgcggcgccgcgcggctctgggggtccagctccgtgggcgctcctggctgctgcgccgcccgcgcctcgcctcccgccgccagcctcccccgggccgctccacgtggccgctccacgtcgccctcccggctggagccgccgccctggccgggcagagtccggagccagtgccagccgccgccccgcccgccggacctggcccttcgcagctccaccagcgcccccgctgcgcccgcggccggaggggctgcgcgcgcccgtgtgagtgtgcgcgtgtgtgcgtgcgtgagtgcgcatgtgcgcgtgtgcgagtccgcgtgtgctcgtgagtgcgctcgtgtgcttgtgcgggtgtgcacatgcgtgtgacattgtgagcgtgagtgtgagcat

SEQ ID NO: 86366 - DNA, 30 bp, Homo sapiens
  chr2:27354485-27354515
  hypo
tttctggtcattaaacgtggggtggtgcct

SEQ ID NO: 86367 - DNA, 24 bp, Homo sapiens
  chr2:27433305-27433329
  hypo
ctttttttttggagacggagtctc

SEQ ID NO: 86368 - DNA, 168 bp, Homo sapiens; identical to SEQ ID NO: 27111
  chr2:27473190-27473358
  hyper

SEQ ID NO: 86369 - DNA, 834 bp, Homo sapiens
  chr2:27484899-27485733
  hyper
agacaagatggcccacgggggtgggcagggaggtcggacggccgctcagaggggcaggtggacggtggcggcaggcgcgggggccggcggggcgcgttggcggttctcctgccacccccggcccgctgtcccggccgctccgcgcgcctcatttcacacctcgccgcccccggccccgtctgtgcggagccgggaatacccccgctgcccagaccgcacctgctccttcctcgccgccccctcgcttcccggcggccgcccgccccccaggggcccgcaagacccgcgcggagcccggcccatcctcgggccccggcgcccacagctggccgcggctggagggggcgcgcggaggggagcccccggggcctacagagggagctctgaagcctgggcagcgaggcgctcccgccctgggcccggggcaatgcggaccttggcgcaccgggcgagggctccggcccgaccgagcggcagctgctcccagggaaggcaggcgccgcgggggtggcggaggggtccggcggcctgggacgccggccggaggggagtgagaggccgcttcacccgaggaagtcaggcggccgggaggaggcgtagccggctgtgtagggctgggcgctccgtgtggccagaggggatgaagcggggtgcagcggagcgagggacccgcggtgcgctggggcggccgccggggcccgcgccgagagagacaacgaaatggacggagggtagtagggtggcgcccccgggccgagggccagcccaggtctgtcctacctcttcaaacgcaggctgcctccggcgccaccgcggtcccgggggctcaccagg

SEQ ID NO: 86370 - DNA, 841 bp, Homo sapiens
  chr2:27486232-27487073
  hyper
ctctgtgcatgcctgcgcgggggtgtcgcccaccacgccgtcaccctgtggccgcaaccctcacgcggaggcagaaacaggagcggacccattacctatctccagagaaccagaaagaacatgaggtgagcggtgacacagggagattccagggactccagaaacccctttacggagaatctggggtcggaattcacgagcccagtctgctgccaatcactgtaccgcgaatgatcatttatttttatacagaaacattgggtgacaagcttcctgctctccttcaacccactgttatccctgcttttcaaatgagtaaactgagacccagaggaagaagagtccaaggtcatgcaggctgtgaataaagggcccggcctggacccccatcctctttccctccccggctctggacgccgcactggcaactggagagcgctcacagttctcttacgggcgggggtccagtgaagtcgagccgcctatctggtgtcacggccactgtttatggagaggggctgaggggcagcggggcagcgtgtcagctagtgattcccatcctccacacctgcagcgccctcctggacattaccgcattctgcctcatttgggggaaactaaaacccaggggagggagcgacttacagcaaagtcggtggccgagcctcaagtcgaagcttcaaatgctcaatgttctctcccctcgcacctgccgccactgtagaatgggagggggtgggaagaggattgtgcactcgaagctgtgacagtctgtgaagaggagggtccgtaggaggaggggagcgagtgagcagggatggggaagcgtggagggtgggaa

SEQ ID NO: 86371 - DNA, 262 bp, Homo sapiens
  chr2:2752881-2753143
  hypo
gtaacatcaggacagcgcctcctgagagaagtgaggattgagtgggatactctgtgtacagcctcagtttccctggcacgtggtaaatactcagaaaaggtgagctagccttaccacagcttgctttttagacaacatgggggcattcacgggatctgaaacctccatagcggggtacgagctgtcttagcagtcaagcacatggcctccttcacaccacgggctgagcgcagtgaccacagtcaggcggctacaggccagg

SEQ ID NO: 86372 - DNA, 89 bp, Homo sapiens
  chr2:27578409-27578498
  hypo
tcatggaaggcagcagcaggatgtaatggtacaaattctggatacacagtaaaggaatagatgatcagtaaattcgtactgagtttcta

SEQ ID NO: 86373 - DNA, 30 bp, Homo sapiens
  chr2:27581396-27581426
  hypo
ttgccatgcctggcccggttatctttctaa

SEQ ID NO: 86374 - DNA, 33 bp, Homo sapiens
  chr2:27591961-27591994
  hypo
gcctcctgcttggctcgacgctcagcccgaagt

SEQ ID NO: 86375 - DNA, 56 bp, Homo sapiens
  chr2:27666342-27666398
  hypo
gctgcactcactctacgtggagttgggccctgcaggaaggacggacttcaggggca

SEQ ID NO: 86376 - DNA, 30 bp, Homo sapiens
  chr2:27669403-27669433
  hypo
taggttcaattctttcgcccaggctggagt

SEQ ID NO: 86377 - DNA, 308 bp, Homo sapiens
  chr2:27717830-27718138
  hyper
cctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcgggatgtgaccgtcccggagagccagccgccgccttctgcagcgctggccccgctcgctccgccgcagcccggccgggacgcgcgggcccgccccgcccagccggggttct

SEQ ID NO: 86378 - DNA, 178 bp, Homo sapiens
  chr2:27718172-27718350
  hyper
cgtcctctcggggctcctcccacgaccctcccaatggcgcctccggagcccccatcccttatcccttctctctcccagctgaagcggacgagtcggcgggggcgtggggggtgagacgcgggtgctagggtctccggcacctgggagatccccttcctccccgcgtggaagagccaag

SEQ ID NO: 86379 - DNA, 141 bp, Homo sapiens; identical to SEQ ID NO: 14400
  chr2:27887525-27887666
  hypo

SEQ ID NO: 86380 - DNA, 309 bp, Homo sapiens
  chr2:27938325-27938634
  hyper
gggggcaggcctggccgagtggctccgtgaagacgcaggcgcggccggagggcgcggggctcgggcaggatcgcgccgccgggccgggagggggctgcgggcgcgcggcggatgtcacggcttacctcagagcccaaattagaaggctgaaaaaatcacagcaggaaataatgtgctgcctaaaatagaagcatcaactgggagagaggccggggagtaggtggcatctgaggctcccgccgcgtcctccccagcggctgcctgacgctgcatcggaggcgcgtgggtggcgcccggccagaggggccc

SEQ ID NO: 86381 - DNA, 192 bp, Homo sapiens
  chr2:2799315-2799507
  hypo
cggctcctgacaccccgggatggtgcgggcggctcctgacaccccgggatggtgcgggcggctcctgacaccctgggatggtgtgggcagctcctgcactccctcttttcctctcgaggacttaatggctacagcgaaagcagaggcctgctgtggggagcggggggagccgggcagcgcagtggcctccca

SEQ ID NO: 86382 - DNA, 30 bp, Homo sapiens
  chr2:2829715-2829745
  hypo
gctgcatcgctagggcgaagagagcaagga

SEQ ID NO: 86383 - DNA, 30 bp, Homo sapiens
  chr2:2844571-2844601
  hypo
ggcatcctggattcccggctccctgagaga

SEQ ID NO: 86384 - DNA, 70 bp, Homo sapiens
  chr2:2844886-2844956
  hypo
taaaaccagtattgccgattctgaaatcccaattgcgtctgttcttagcatgacacgctgtgaaatgtaa

SEQ ID NO: 86385 - DNA, 193 bp, Homo sapiens
  chr2:28500549-28500742
  hypo
cactattaccaagagcgttcgggcatgcagaggttaaagtctggtcctattgttaaggagaaaagccttgtgtaccttcaagtcaactcagcaaacatttgagtatctactatggaccaacgtctaggttaagccatgtggtcacagaaatggatagctacactaaggagtttgtactcgggtaagggagaca

SEQ ID NO: 86386 - DNA, 122 bp, Homo sapiens
  chr2:2854341-2854463
  hypo
tggatcaagtcactgcgtgtcagggaacggctcctctgctgctcctgatgcctggccacccgtcccggtccacccctcgcgaggaaggccaggcctccgctcctctgcggagcctttcagga

SEQ ID NO: 86387 - DNA, 30 bp, Homo sapiens
  chr2:2854703-2854733
  hypo
acctctgcccctccccgctcagccagcctg

SEQ ID NO: 86388 - DNA, 30 bp, Homo sapiens
  chr2:2863300-2863330
  hypo
gtgtgacagcaaacacgtgatatgctcaac

SEQ ID NO: 86389 - DNA, 35 bp, Homo sapiens
  chr2:28659202-28659237
  hypo
aacctctgttcattgcggcccgccatcactccctg

SEQ ID NO: 86390 - DNA, 212 bp, Homo sapiens; identical to SEQ ID NO: 39489
  chr2:28676953-28677165
  hypo

SEQ ID NO: 86391 - DNA, 1395 bp, Homo sapiens
  chr2:287500-288895
  hyper
tgtctctttttgaaacgtgtttctcaaagacaattctatttcccagcagccccggccctcgggcgcgctcggccccactcacccactcgctgctccggcgaaggccccagccccgccgcctccgcgcggcccagggcgcagtcccgcccgaggagctgcaggcccttgtgctccgccgagtggtgcttccgcagctcctggacgagttccaccaccagccgcagcagcgcctgtccgtccgccggctcccggggctccgcgcccccccggccgcgccccgccgcccccagcaccagcagcagccccaggaggagggggtgcccgggtccgcgcatcgtgcgctcggggccgcggggctgggagactccgacacgcgccgagagctgggctcgctgcgagagaaggggcgcggggggccggagagaaagtcagcgggggagggggacggagcgcggggcgggggaggggaggggaggcgggaggagccgctggcgctggacccggcccctcacctccgcggaccccgaggaacaagccggcaggtgagggagccgcggtctcctcgacgatcacgcccgaggtcccgcccacggggagcgaccgccgctggtgcggaaaggagcccccggaacccgcccgcccgccagcccggcccctcctaactttcgcccgaaaggccgcgtccgccgagcgcgctgcgcctggcgcgggcgcaactttctttcccctttggaagccgcgggtgccaggcagctccccggccgcgggcggacctcggaggggccgcgctcccgcgcctaccgctctccaagaaggcggcgccgcgcgccgggcccggcggccgcgctcaagtttccagcgtcgcctttgcgcggtggtcgccggcgagcgccgagtccccgaagcccacggaggaggccgggtgcggaccctcgcgctggccccggccgcgccacgtgctggaagcccctccacctcccggccatggcgccctcccgcacctgcccggcgccacccgggagccacctgcgcgtcgtggccgggccggttacctggagccgccggagtcgtcgccgtctgtgcgcacgtctgtccccgcgccccgagctgcgccactactccatgcccggcgggcggagcgcacgggacgcggggactcggccgctccgagcgctggacccacggccgacctggggtgcgccggctccgagtcccgcctcagacctcggggagcttcttatccccgcgcccgccgacgtcaggcgggtccccaagggctccgagcggggctttaattagaagccgctgaagtgttagtacccccatgcggatcttcgtcagtccccccgcctcacctcgctctcgcctccccccgtctcccgctccccctcaact

SEQ ID NO: 86392 - DNA, 131 bp, Homo sapiens
  chr2:2875928-2876059
  hypo
tttcacagtgggttgcggttggcgctgttggggcacgatgcaggggcacttgctgtggccttggtgttaggtctcaagagaaatcttaggggccaggaggttctctcagctcctgacggtagggcggcggg

SEQ ID NO: 86393 - DNA, 1189 bp, Homo sapiens
  chr2:289223-290412
  hyper
caattagagtccatccgttttggagggatccgctctccggacctcgaggggtctgccccgcccgagcccagtccccaggttcgggtccccaagccctggtccccgaggcggggcggccaggaggcaggagatgggcgggtgaggactctccacggcccccgaggtgcgcacagctgaccacccgaggaggggcaggacctgcaccccctccccagaccccctgcgagaggacgagcgaaggtccctccccggcaaggaccgcgccatctgcgcgctcctctgcgctggaccctcggcccgcgggtccctcgcgccccggcagggaacgcccgcaggagggcacttgcctcccggactcgtctttaagaaagtttggctctttggccgaagcccggcacatctgtgaaagttcagcaatttgcctcttttattttattcttgtaaaatgtattatcaatcagttgcgcactttcccattcgattggtgctttctgggcaagagctggacgtcttccaagtccgcgatctgtttgggaaaggtgttctgagtgcaatcagagaggcggagtgggcgagaattaaaggcctgcaccatgatcggggcagtcgcaggaccgcggcgggaaggtgctggcccaggcgcacgtgagcgcgggcggtgcgggcggaaggctccgcgccccgatcccccagctcccggagaggccccgtctgcgcccgtccccgcgtcctttctctcttcctgcacggggtctgtctcctcaggaggagaaagtgtccggcagagctgggcggggaggcagcgtggagagagaagatatgaaatgtgccggttccggaccccgccccacacccttgggatctgcgttctctccgctcccttgaaaaacagatggtttgatttcacagcgaggcttttctttttctttttgcaagctacatgactgaaatgtgaacatttctgctaaaatacactcaggaaaaagtaaaattttatgtcaaacagaccttaggcacataaaaggaggcatttttcgtttctctctttccccttcccatgtccaagaagacacttgagttccacgggcaagagcgacgcctggcgatggaaccggccctccccggccctgctcccggtcctgcttgccgggcccacctcgcagctggtggacaccgcagttcccagaaa

SEQ ID NO: 86394 - DNA, 362 bp, Homo sapiens
  chr2:29033336-29033698
  hyper
taaccagggtaaccacgctgtgcccgcgtgtgccgggcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagag

SEQ ID NO: 86395 - DNA, 30 bp, Homo sapiens
  chr2:29093791-29093821
  hyper
tttaccctcccaaaacgaaatagaagtgtc

SEQ ID NO: 86396 - DNA, 30 bp, Homo sapiens
  chr2:2913672-2913702
  hypo
ggagtgataaatgaccgagcctgtgataag

SEQ ID NO: 86397 - DNA, 122 bp, Homo sapiens
  chr2:29337930-29338052
  hyper
gccttttacagcaagcgctgccagcagggaactggtggatgtactcttgaccacgctcggctggactctggggagcccaagacgggtaagactaggtccccggccccagcagctggtggggg

SEQ ID NO: 86398 - DNA, 590 bp, Homo sapiens; identical to SEQ ID NO: 1940
  chr2:29338158-29338748
  hyper

SEQ ID NO: 86399 - DNA, 296 bp, Homo sapiens; identical to SEQ ID NO: 27120
  chr2:29338809-29339105
  hyper

SEQ ID NO: 86400 - DNA, 30 bp, Homo sapiens; identical to SEQ ID NO: 39414
  chr2:2939589-2939619
  hypo

SEQ ID NO: 86401 - DNA, 97 bp, Homo sapiens
  chr2:2941871-2941968
  hypo
tacaggtgtgagccaccgtgcccagccccttttgtgtctgatgcccatgactgaattcatttctctttctctcgcatgttcacgtcacaaaccgtct

SEQ ID NO: 86402 - DNA, 40 bp, Homo sapiens; identical to SEQ ID NO: 39490
  chr2:29462699-29462739
  hypo

SEQ ID NO: 86403 - DNA, 219 bp, Homo sapiens
  chr2:29504677-29504896
  hypo
ctgcctgagaaatgccgatgctgctcacgtacgactcagaaaatgtaccatctcattcaggcaacagactgttaatggacagcgaatataatgccttatttgccaccctgccagccttagggattgacaaacctaattaagttcacttaatgattttaagtagctgacagaaaggtttgtgtctgatgtggatggagggaatggcgaagctttggaggg

SEQ ID NO: 86404 - DNA, 95 bp, Homo sapiens
  chr2:30142882-30142977
  hyper
ggcggggctgggaggcgcgaattgccgcggacagccttccctctctgcccacttccgacgccttcttctcgggcatcaggcggatcctcagtcgc

SEQ ID NO: 86405 - DNA, 47 bp, Homo sapiens; identical to SEQ ID NO: 6091
  chr2:30143276-30143323
  hyper

SEQ ID NO: 86406 - DNA, 330 bp, Homo sapiens; identical to SEQ ID NO: 27123
  chr2:30143382-30143712
  hyper

SEQ ID NO: 86407 - DNA, 233 bp, Homo sapiens
  chr2:30143918-30144151
  hyper
gggtctgtcccctctcggggcagcctccaatctctgcaacttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctggg

SEQ ID NO: 86408 - DNA, 405 bp, Homo sapiens; identical to SEQ ID NO: 27125
  chr2:30144174-30144579
  hyper

SEQ ID NO: 86409 - DNA, 113 bp, Homo sapiens; identical to SEQ ID NO: 27126
  chr2:30144580-30144693
  hyper

SEQ ID NO: 86410 - DNA, 32 bp, Homo sapiens
  chr2:30144922-30144954
  hyper
gggagagggtggcagcgcgacactggcaaatc

SEQ ID NO: 86411 - DNA, 87 bp, Homo sapiens; identical to SEQ ID NO: 39492
  chr2:30368623-30368710
  hypo

SEQ ID NO: 86412 - DNA, 27 bp, Homo sapiens
  chr2:30404502-30404529
  hypo
ctttctttttttaaacggagtcttgtt

SEQ ID NO: 86413 - DNA, 30 bp, Homo sapiens
  chr2:30407504-30407534
  hypo
gttttttccctcctccgaagggagagatta

SEQ ID NO: 86414 - DNA, 145 bp, Homo sapiens
  chr2:30443158-30443303
  hypo
agaatagtctccagtcgagcagaggctgaggagaaagagggactaagtgctggtcctgggttcaccagtcactgacagtgggaacctcagaaagccaactcctctctgtgggccttagttctgtcgcctgcgaagtggagcagac

SEQ ID NO: 86415 - DNA, 64 bp, Homo sapiens
  chr2:30453590-30453654
  hyper
gtcaaggatggggggcggcgtgcacaccgcccgcccacaccttctgcccccgctgcagaccggg

SEQ ID NO: 86416 - DNA, 1122 bp, Homo sapiens
  chr2:30453784-30454906
  hyper
cggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccgggagcagagccgagcgcgcccccgagccgccgcccgccggagctgcgagcgctgaagccattcatgattttggtgacgttattccaggagtgggcgagggagggcggggcctctcggggccaagccccgcccccgcccctataaatacggcttcccgggctctttgtggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactggtgagtaccctgcgcctgcggcgggcgtctgtctcgcggcggtggctgcgggcccgggcgcctgcttcgtgccggctccgggtgcgagggcagccggcggcgcgggcgctcagcgctaacccgccgcccgagcccgtgcaggagtcaacgtcaaggttgcaaaggtgggggtggggggagggggtgctgagaacatccagacaaaggacgtgaactcggagccctcacctaagtgacggccggagggtttgtattggttggcgggggagccagggg

SEQ ID NO: 86417 - DNA, 404 bp, Homo sapiens
  chr2:30455403-30455807
  hyper
gggttagaggagaagcggccgggggcgagcgccggcagccccggagcgcgctctcaggtgcggacgtggggagctcggccccgagtctccggcaggcgctgagcgaagggaaaaccggcgcaagccgcggcggggtccggcctggcccaagaagcggaaagttcatgcttctcgcttcaacttttcgggccggcgccacagccccgagcgaggaagagccgcccctacgtcagactcttcaccctgcgtgcgctcttctggctcctttctttggaggtcgccagcagcctttccaagacccgggaggaaactgcctttgcagggcccagctcccgaacctaaacttgccgcaaagccccgcatcttctgttagtctccctgcccccatccgtcccagcctggca

SEQ ID NO: 86418 - DNA, 30 bp, Homo sapiens
  chr2:30471090-30471120
  hypo
tactatcaaggaagacgtcttgcgtggggc

SEQ ID NO: 86419 - DNA, 30 bp, Homo sapiens
  chr2:30486255-30486285
  hypo
tcctcatttgtacaacgagtacctaactca

SEQ ID NO: 86420 - DNA, 100 bp, Homo sapiens
  chr2:30497260-30497360
  hypo
aggcgtcagccaccgcacccggcctgacagacttgttactgaagaaaccctggagtgaatttgtttataaagggccctttggtcccgggggtccccccac

SEQ ID NO: 86421 - DNA, 105 bp, Homo sapiens; identical to SEQ ID NO: 39416
  chr2:3050299-3050404
  hypo

SEQ ID NO: 86422 - DNA, 30 bp, Homo sapiens
  chr2:30512636-30512666
  hypo
ggggaagttcttgggcggggtggggtgcat

SEQ ID NO: 86423 - DNA, 16 bp, Homo sapiens
  chr2:30541168-30541184
  hypo
ttggagacggagtttc

SEQ ID NO: 86424 - DNA, 395 bp, Homo sapiens; identical to SEQ ID NO: 27131
  chr2:31360195-31360590
  hyper

SEQ ID NO: 86425 - DNA, 63 bp, Homo sapiens; identical to SEQ ID NO: 6096
  chr2:31360630-31360693
  hyper

SEQ ID NO: 86426 - DNA, 62 bp, Homo sapiens; identical to SEQ ID NO: 6097
  chr2:31360694-31360756
  hyper

SEQ ID NO: 86427 - DNA, 218 bp, Homo sapiens
  chr2:31360803-31361021
  hyper
cgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcggcgctacgtcccgggggcaccccccggcggtcagggttggcg

SEQ ID NO: 86428 - DNA, 394 bp, Homo sapiens; identical to SEQ ID NO: 27135
  chr2:31361296-31361690
  hyper

SEQ ID NO: 86429 - DNA, 252 bp, Homo sapiens
  chr2:314488-314740
  hypo
actcaaaatttggagcggatgaggggcaggagcagctcactgattgggccccgactttcccaggtgtctacactgctagagctacgctcacagctgcggacgtgcacgcgctgccagcaactgcaccgagcactcagcgcacacctgctcccacgcgccacgcactcgtgcaggtgccgggagctccgtcgtcagcagccagaggaaagccctgttctcgtggaacctccatcctagcgaggacagaatgag

SEQ ID NO: 86430 - DNA, 579 bp, Homo sapiens
  chr2:31456682-31457261
  hyper
caactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctc

SEQ ID NO: 86431 - DNA, 102 bp, Homo sapiens
  chr2:31457325-31457427
  hyper
cggccctcctagccgcgtgcccgggccatggtgcggctgagccccgcgcttgggtgaggcggcggcgcggctcggagcccggcggaccggtcctacgggaca

SEQ ID NO: 86432 - DNA, 30 bp, Homo sapiens
  chr2:314985-315015
  hypo
gggtgtgtttgggcacgcagccatgccgac

SEQ ID NO: 86433 - DNA, 68 bp, Homo sapiens
  chr2:3175737-3175805
  hypo
ctgagatgagagtgacgaaggctgagacaggaggaggcttgggcctcactgggcggatgtgagaggta

SEQ ID NO: 86434 - DNA, 30 bp, Homo sapiens; identical to SEQ ID NO: 39417
  chr2:3176032-3176062
  hypo

SEQ ID NO: 86435 - DNA, 89 bp, Homo sapiens
  chr2:32263995-32264084
  hypo
cgtgggccatcgcgcccggcgaagggtttcttaattttaatatgcggtttttacgtagcaacatcccaaaagatcgattaaaagccacc

SEQ ID NO: 86436 - DNA, 31 bp, Homo sapiens
  chr2:32275102-32275133
  hypo
aaaaaatatctgggccgggcgcggtggctca

SEQ ID NO: 86437 - DNA, 17 bp, Homo sapiens
  chr2:32360509-32360526
  hypo
ttcgattattctaaatc

SEQ ID NO: 86438 - DNA, 16 bp, Homo sapiens
  chr2:32472347-32472363
  hypo
gacaagcttaacctgc

SEQ ID NO: 86439 - DNA, 30 bp, Homo sapiens; identical to SEQ ID NO: 39497
  chr2:32494200-32494230
  hypo

SEQ ID NO: 86440 - DNA, 120 bp, Homo sapiens
  chr2:32504329-32504449
  hypo
gcgccccggccattttcaaatttttattacacttcgtgcaccagttattttccagtgaccagacttactggctgctatgaaatcataaattatgtttacagaaatttcagtctgagaaag

SEQ ID NO: 86441 - DNA, 42 bp, Homo sapiens
  chr2:32504749-32504791
  hypo
ttacaggcgtgagccaccgcgcccggccgaaagaacctagat

SEQ ID NO: 86442 - DNA, 27 bp, Homo sapiens
  chr2:32551637-32551664
  hypo
tgtgagccaccgcgcccagcctaccct

SEQ ID NO: 86443 - DNA, 29 bp, Homo sapiens
  chr2:32620220-32620249
  hypo
aaaaacagcaacaacgacaacaacagaaa

SEQ ID NO: 86444 - DNA, 150 bp, Homo sapiens
  chr2:32852511-32852661
  hyper
caaataaggtaccagcggaggctggtttgtctccttgcaatttctttgtgatcacccctgggatcactcttctacagcgttccgacagtgttccaaaaacttccctgcaccagcggcaggggcagatttcccacccggccatgattcatg

SEQ ID NO: 86445 - DNA, 30 bp, Homo sapiens; identical to SEQ ID NO: 39418
  chr2:3285842-3285872
  hypo

SEQ ID NO: 86446 - DNA, 30 bp, Homo sapiens
  chr2:3286245-3286275
  hypo
ttgcggtctctgtctcgttagtcatcccgt

SEQ ID NO: 86447 - DNA, 30 bp, Homo sapiens
  chr2:3290098-3290128
  hypo
gtgtaaacgtgtggccgtgacatggcctcc

SEQ ID NO: 86448 - DNA, 165 bp, Homo sapiens
  chr2:3290515-3290680
  hypo
agcagctccaagaggcggagctatcaatttcacatacagacaaggaaaccaaggcttggagagttgaagccaccgtccaagaacacaccagagtgccagccggcagagggggctgtggggagcacacagagtgccagccagcagagggggcggtggggagcacac

SEQ ID NO: 86449 - DNA, 30 bp, Homo sapiens
  chr2:3307369-3307399
  hyper
tcatattgggaaatgcgactaataacctag

SEQ ID NO: 86450 - DNA, 34 bp, Homo sapiens
  chr2:33313226-33313260
  hypo
atatggacagtgagccgggcgcggtggctcacgc

SEQ ID NO: 86451 - DNA, 30 bp, Homo sapiens; identical to SEQ ID NO: 39501
  chr2:33315571-33315601
  hypo

SEQ ID NO: 86452 - DNA, 30 bp, Homo sapiens; identical to SEQ ID NO: 14373
  chr2:3331786-3331816
  hypo

SEQ ID NO: 86453 - DNA, 16 bp, Homo sapiens
  chr2:33373991-33374007
  hypo
ctcccatgggctgggc

SEQ ID NO: 86454 - DNA, 21 bp, Homo sapiens
  chr2:33379839-33379860
  hypo
ttgaactaggccgggcgcggt

SEQ ID NO: 86455 - DNA, 45 bp, Homo sapiens
  chr2:3347109-3347154
  hypo
ggtacaggccggctccgaaaacaagcaatgcgagaaagaaacacc

SEQ ID NO: 86456 - DNA, 33 bp, Homo sapiens; identical to SEQ ID NO: 39420
  chr2:3352677-3352710
  hypo

SEQ ID NO: 86457 - DNA, 159 bp, Homo sapiens
  chr2:33529420-33529579
  hypo
ccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactc

SEQ ID NO: 86458 - DNA, 44 bp, Homo sapiens
  chr2:33530065-33530109
  hypo
tagtgtgggagataacgaaaaaatacaataaatggctgggtgca

SEQ ID NO: 86459 - DNA, 70 bp, Homo sapiens; identical to SEQ ID NO: 39503
  chr2:33532830-33532900
  hypo

SEQ ID NO: 86460 - DNA, 42 bp, Homo sapiens
  chr2:33544683-33544725
  hypo
ggccaggaacaactgcgctctcccagtcgtgtgcccaggctg

SEQ ID NO: 86461 - DNA, 87 bp, Homo sapiens
  chr2:33653893-33653980
  hypo
ccgacctgatctcatttcttaaaccaaaccccctgattttgatgtttatactcagttcttcttcctttttcgcgtacctgacacatt

SEQ ID NO: 86462 - DNA, 60 bp, Homo sapiens
  chr2:33775696-33775756
  hypo
gaggagtatgacaatcgcccctttttctagatgccagagctcagtcgtgttagctttatt

SEQ ID NO: 86463 - DNA, 59 bp, Homo sapiens
  chr2:33953179-33953238
  hypo
ctccctcccaggacccgccaccccgtggaacaggaacatagcaccgagcagggaagaga

SEQ ID NO: 86464 - DNA, 38 bp, Homo sapiens
  chr2:33997908-33997946
  hypo
ctttccagggaatgtcgtcttctcggtcactcagttcg

SEQ ID NO: 86465 - DNA, 42 bp, Homo sapiens
  chr2:3438687-3438729
  hypo
gttttccatctggaccgagggactggccggtgcagcaggagg

SEQ ID NO: 86466 - DNA, 21 bp, Homo sapiens
  chr2:34556567-34556588
  hypo
ccactgcgcccagccttggga

SEQ ID NO: 86467 - DNA, 30 bp, Homo sapiens
  chr2:36245456-36245486
  hypo
agaggagaaaatacccgtggtgaaacccag

SEQ ID NO: 86468 - DNA, 236 bp, Homo sapiens
  chr2:36600958-36601194
  hypo
tcacagggtcatgtgcgtgtcctggtagtctgttatgtccattcttctgtaataggagtatgtttttcaaactgaagctgttaggttctgttaattccaacagaacaaaaaaaaatctgcctctggccatcattcgttaatttacatagattagatacatgtagtctgtctcctaagtggcttacataaagccgtgggcgtcttttcctgtgtctcctcttcggcagttcctaagg

SEQ ID NO: 86469 - DNA, 66 bp, Homo sapiens; identical to SEQ ID NO: 39505
  chr2:36824207-36824273
  hypo

SEQ ID NO: 86470 - DNA, 30 bp, Homo sapiens
  chr2:36998369-36998399
  hypo
tgttataaaaatgttcggctttgccggtcc

SEQ ID NO: 86471 - DNA, 16 bp, Homo sapiens
  chr2:37445969-37445985
  hypo
gcgccactgcattcca

SEQ ID NO: 86472 - DNA, 177 bp, Homo sapiens
  chr2:37571733-37571910
  hyper
cggcgggaggctacccgggggcgatgggaaggcgggcgcagtcgacccaagggtggagaagagggaaggcgaaggacgcgcgttcccgggctcgtgaccgccagcggcccggggaacccgctcccagacagactcggagagatggcaggcggaagacaccggcgcgtcgtgggcacc

SEQ ID NO: 86473 - DNA, 48 bp, Homo sapiens
  chr2:37899949-37899997
  hyper
acgcggagaacctcccggataccttggctttgccgagagatatcagct

SEQ ID NO: 86474 - DNA, 33 bp, Homo sapiens
  chr2:37979626-37979659
  hypo
aacctggattcaggccgggcatggtggctgagg

SEQ ID NO: 86475 - DNA, 226 bp, Homo sapiens
  chr2:38007974-38008200
  hypo
tggtccaggtaacaccggtgatcacagtagctctttgtgtgcattgttaatgacaagagtctaaacatgcaagtctctctttttatccatgattttttttttcctgagatagaatcactttatcatgcaatgaagctatatgaaggtaagatgcctgagagagtgtttaccttgctagaaaatatttagacgtgtgttgaatgactgatttcgaggtccaactctg

SEQ ID NO: 86476 - DNA, 64 bp, Homo sapiens
  chr2:38301221-38301285
  hyper
aaatgtgttctcactcgcaagcaggggaggggacgatagagacaagataggagaccggaggggt

SEQ ID NO: 86477 - DNA, 15 bp, Homo sapiens
  chr2:38301350-38301365
  hyper
cgatcttggttttga

SEQ ID NO: 86478 - DNA, 426 bp, Homo sapiens
  chr2:38301762-38302188
  hyper
cggtgcgcaccgggttggggaagtactgcagccagggcatcacgtccaccaggctgcccgcgcccaccgtgcgcccgaactcttcgttgtggctgagcagctcacggaactcggggtcgtcgtggctgtagcggcagccgaaacacacggcactcatgacgttggccacggccacgacggtcagcggcctcgggtcgaggaaggcgccgtccgcgctgccgcgcaccagcagcgccaccagctcgcgcgcctcgctcagcacgtggccctcgaggacttggcggctgcgcggctggcgcgtgaagaagttgcgcatcatgctgtgggctgcgcgccgctgcaccttccagtgctccgagtagtggccgaaagccatgctgcggccgccggacaccacacggaaggaggcgaaggccggccggtcgg

SEQ ID NO: 86479 - DNA, 532 bp, Homo sapiens; identical to SEQ ID NO: 27141
  chr2:38302369-38302901
  hyper

SEQ ID NO: 86480 - DNA, 761 bp, Homo sapiens
  chr2:38302948-38303709
  hyper
cgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacagcgcccctggttggtt

SEQ ID NO: 86481 - DNA, 205 bp, Homo sapiens
  chr2:3833780-3833985
  hypo
catgcagatgtgtcccgcttgtgcacagggcctctcgtgtgggtgtgtcccgcctgtgcacggaacctctgatgtggatgtttcccgcccccgccctccacgtgcagtgaacctctcgtgcagatgtgtcccgcctgtgcacggagcctccggtgtgcgtgtgtcccgcctgtgcacggagcctccggtgcgggtgtgtcccgcc

SEQ ID NO: 86482 - DNA, 21 bp, Homo sapiens
  chr2:38365727-38365748
  hypo
ctcccccgtcctgtcttaaag

SEQ ID NO: 86483 - DNA, 30 bp, Homo sapiens
  chr2:38466890-38466920
  hypo
gcgggtgccacattacgttagtaagctcct

SEQ ID NO: 86484 - DNA, 16 bp, Homo sapiens
  chr2:38669261-38669277
  hypo
tcgcgccacagcgctc

SEQ ID NO: 86485 - DNA, 19 bp, Homo sapiens
  chr2:38744252-38744271
  hypo
actccgtctcaaataataa

SEQ ID NO: 86486 - DNA, 79 bp, Homo sapiens; identical to SEQ ID NO: 27143
  chr2:38755384-38755463
  hyper

SEQ ID NO: 86487 - DNA, 30 bp, Homo sapiens
  chr2:38756521-38756551
  hypo
ggccgccctgagggccgaccaggcttggtg

SEQ ID NO: 86488 - DNA, 20 bp, Homo sapiens
  chr2:38953653-38953673
  hypo
caccccgcctggccaagtct

SEQ ID NO: 86489 - DNA, 68 bp, Homo sapiens
  chr2:39187170-39187238
  hyper
cccggagatggacttcgagtcctctccggcggagccgctgggcaacgtggagcgctccctgcgcgccc

SEQ ID NO: 86490 - DNA, 175 bp, Homo sapiens
  chr2:39187544-39187719
  hyper
gcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcgg

SEQ ID NO: 86491 - DNA, 94 bp, Homo sapiens
  chr2:39188263-39188357
  hypo
tactccacttcttcccggcagcattcttgcttgtagctagggaggaggcaagttgccctagctcaaggtagactcgctgcgcaatttgctgcaa

SEQ ID NO: 86492 - DNA, 15 bp, Homo sapiens
  chr2:39892733-39892748
  hyper
aaggggaaggggggt

SEQ ID NO: 86493 - DNA, 4 bp, Homo sapiens
  chr2:39892804-39892808
  hyper
cgcg

SEQ ID NO: 86494 - DNA, 1041 bp, Homo sapiens
  chr2:39893018-39894059
  hyper
ggaagagggagggagcgggcggagagctggggccaagtgcattgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcctttgtacacctgcctgacatgtgtgtcttttcttgacgctgctccccgtgagggggactaaccgtcaaagactcgacttttctcacccgggctccttccttcaagttgtgctccttttggaaataccgtttggaagaaaagtggtgccgacctccgaagagagggaaggggctttgcctgtattgtgcggatgctggtgtcagacggaactgatgtggt

SEQ ID NO: 86495 - DNA, 129 bp, Homo sapiens; identical to SEQ ID NO: 39422
  chr2:3990793-3990922
  hypo

SEQ ID NO: 86496 - DNA, 697 bp, Homo sapiens
  chr2:40678187-40678884
  hyper
agagcatcgcctgggcggatttggtttctttggccggctgtccagctataagaccgccctcttcttcattaaggaggagccaaaaaggatatcttcacatctcagaacacagaccatttcccccaagagccagcaaagctccagaggcagagaatgcagctgcaaagttcccttccaatctcttggggaaagatgcctgtgtgtgcagaatccccaaagcacaccacggcacagtgcccagagacgtggaccccgcagcccactccctgctaccccctacatttcttcctcgtctgtctctgccccgccacacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcggacacccagaaaaatgtgcaggcgcgcacacaccacatcacacac

SEQ ID NO: 86497 - DNA, 142 bp, Homo sapiens
  chr2:40678944-40679086
  hyper
tgccaaagcagagggaagtgtagccttatgagcagcaaatggaaaatagttcttggtctctgactaaatgccttctgcctgtccatcataagatcctacctggtttggggagtgtgaatggattcttcctccgttcctccac

SEQ ID NO: 86498 - DNA, 432 bp, Homo sapiens; identical to SEQ ID NO: 152
  chr2:40679087-40679519
  hyper

SEQ ID NO: 86499 - DNA, 85 bp, Homo sapiens; identical to SEQ ID NO: 153
  chr2:40679520-40679605
  hyper

SEQ ID NO: 86500 - DNA, 49 bp, Homo sapiens
  chr2:4130725-4130774
  hypo
agtgtcagatggtctcgaaagagggacacagagccgacacattgcggtt

SEQ ID NO: 86501 - DNA, 26 bp, Homo sapiens
  chr2:41770131-41770157
  hypo
gctaaaaaatatttgcgaccaggcgc

SEQ ID NO: 86502 - DNA, 147 bp, Homo sapiens
  chr2:42274544-42274691
  hyper
ggctgagcgaggagccgccacccccggccccacccgcgagagacggggtccacgcgccttccctgcgcccaaaccgccccgaggcccccagtcccaggagggagcgctgagatcactcggatctccgcaccccggacttagctgctc

SEQ ID NO: 86503 - DNA, 152 bp, Homo sapiens
  chr2:42275776-42275928
  hyper
aggctacaccaaggccgtgtaccgggtccgcctgcccggcggtgccgcggtggcgctcaaggcggtggactttagcggccacgatctgggcagctgcgtgcgcgagttcggggtacggaggggctgctatcggctggcggcccacaagctgc

SEQ ID NO: 86504 - DNA, 203 bp, Homo sapiens
  chr2:42281964-42282167
  hypo
taggcctgagggatccggctccctggccaggttagcgttctgccccaggttggaatagaggaaggatgtgtctccaaaggctggattcctgagccactggtttccctctgccacaggtttttcttcacatacctcctgcctcacagtgccccgccttcactgcgtcctctgctggacagcatcgtcaacgccacaggtgagct

SEQ ID NO: 86505 - DNA, 30 bp, Homo sapiens; identical to SEQ ID NO: 39508
  chr2:42282578-42282608
  hypo

SEQ ID NO: 86506 - DNA, 127 bp, Homo sapiens
  chr2:42329318-42329445
  hyper
gtgatcagggaaagtcgaaagtgcagatgggttcgcaaacgtggactctctagttttgggtctgcagatggggccggccaccacgtgctctctgagttctctttccaagtacagatccctccggaga

SEQ ID NO: 86507 - DNA, 344 bp, Homo sapiens
  chr2:42329493-42329837
  hyper
cgtgagaaccggagcccggggtgacttgcgggggaggggatcgcttccccgtcgcccacacctgcctaacccacgcccacggcggccgcaaaggcgacaccgcgtgaatctggaaagccccgagtttcaacaggcccaaccatcggcggctttgcaggcgcagcaccaagtgctgctctgcctgtgttcccccagacagcccctggttgtgatttgtcgtttccagtccagctagagtcccaaggccaagaactagacccttgcagcgagatccgcgcccccccccaccccaccccgcctcattctccacaggcgccacagccacaggccgcataaataaatcc

SEQ ID NO: 86508 - DNA, 30 bp, Homo sapiens
  chr2:42338267-42338297
  hypo
tgccttttgccaaaacggactcaaaccaaa

SEQ ID NO: 86509 - DNA, 2 bp, Homo sapiens
  chr2:42719904-42719906
  hyper
ga

SEQ ID NO: 86510 - DNA, 185 bp, Homo sapiens; identical to SEQ ID NO: 27157
  chr2:42720262-42720447
  hyper

SEQ ID NO: 86511 - DNA, 474 bp, Homo sapiens
  chr2:42720772-42721246
  hyper
cgctcctgccctccgctggcccgggggtccctgggctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggcgaagagccggctcgcggcggcgggggcggggcctctgtgcagtcctcctcctcgcccgccggctccgcgcgcgccgctcacctccctccgcgccgccctccgctt

SEQ ID NO: 86512 - DNA, 727 bp, Homo sapiens; identical to SEQ ID NO: 27159
  chr2:43019598-43020325
  hyper

SEQ ID NO: 86513 - DNA, 241 bp, Homo sapiens
  chr2:43037936-43038177
  hyper
cttgttgccaccgcgcgacatccagccgctcgaactcggacatccacccactgcgtccttctagtgctcttcttaggcgggtcctgtaactgcacctagtcccggaccacaggagggcggatggaggtggcgaggcgctccactgtggcggggtccctagctggccgtggggatcgaatattctacagggcacttcattctacagtgtgagcccgagctcccggtgcggagatgaggcctg

SEQ ID NO: 86514 - DNA, 30 bp, Homo sapiens
  chr2:43038607-43038637
  hyper
ggaaagcctcctggacgtgttctttcaaag

SEQ ID NO: 86515 - DNA, 251 bp, Homo sapiens
  chr2:43227374-43227625
  hypo
ggcagccagttctgccgtttttggccaggctcttggggaaggcggcctgtttgggcacatgggctcccacgtgcgcagaagcatcacctgccctccatgtgatgcgcacactcacagacccacatgcttacgtacttgcagactcgcccaggcacacgtgtatcgccacatgcagacacgcaagcatacacttgctgcactcagacctcctggtgtgaacacacggtgtgcaccgtcggagatagccagtg

SEQ ID NO: 86516 - DNA, 19 bp, Homo sapiens
  chr2:43365437-43365456
  hypo
tgggcgacaaagtgaggct

SEQ ID NO: 86517 - DNA, 189 bp, Homo sapiens; identical to SEQ ID NO: 4967
  chr2:43408168-43408357
  hypo

SEQ ID NO: 86518 - DNA, 39 bp, Homo sapiens; identical to SEQ ID NO: 14407
  chr2:43412683-43412722
  hypo

SEQ ID NO: 86519 - DNA, 30 bp, Homo sapiens
  chr2:43413669-43413699
  hypo
cgcccatctgacactcggagtctcatggga

SEQ ID NO: 86520 - DNA, 401 bp, Homo sapiens
  chr2:43448395-43448796
  hyper
caacaagcaccaaaacgctccagttaacaccagtgcaatcatcgttaacgtgaaacagctgcccgaggcctggcgtatccaccagaccgccccctcccctccatgctcagctgtgagtcaccagagaccccggctaaggcagggcccgggagggagcggggatgcgaggattgttgatggagcccagctgttgtatatgagaaagcaaactattgctaaatctcttacctaccttggaaaaagtgtctgaactgtgtgcatgagggacggcggtggaggagaagaaacatgaattgatttatgaacccgatttaagttcctaaagtgattgttttaaagttagaaacagccagagtcactatagtaagattttgttcaaccgtttgcgaaatcagcaggca

SEQ ID NO: 86521 - DNA, 897 bp, Homo sapiens
  chr2:43450949-43451846
  hyper
ctggtttgtttacaccggtctgagacacaattaggaacttcttccaagagaagggttcccacatctggacttaactaatgctgttcaagtgaagagatggaatggtggttggtagctgctggtgctgggttgatttttcctgaagtcccaaactcatcggagtcctaacaaagtttaagtgttttttttttttttttgttctattcgtatcacaactgccctgttgtgaatattttgttcaacagaaaaagttcgacttttttgctcaaaaagaatgaaacttcgtaataaaaataaaaaaaaaaagacaagaggaaaccgaaaaaggaggggtgggggcccctcccggcacagagttcgagtccaagtgctcggtcgggcttgcagtctgcctagggcccatgtcaccccccccactcccgtgcccccagcaagggcgagatggcgaggggtgtcctccaacatctctgaaccgccttcccttcctcctcactggcgccctcttgcctcagtcgtcggagatggagaggcggctgaagattggcaggcggcggccagggtcgaggctgggagactcagagccgctgaggctgccggagctcagggagccgcttaggtagctgtcgcggtccgacagcgagtccggggggctggggggcgcgtcgaacacgggcgagtcggacaggcggcgcggcagctggaagctgaagggcggcgagggaggtgcggcggccccggcggggagggtcgcgctgggcggcgccggcggctgcgcggggggcgccaggccctgctgctgctgctgctgctgactgcggtagtaggcggcggcggccacggcggcaaagttgtgggtctggatggcgagcggcgtgatgaggctgctgagctccggac

SEQ ID NO: 86522 - DNA, 552 bp, Homo sapiens; identical to SEQ ID NO: 27164
  chr2:43451891-43452443
  hyper

SEQ ID NO: 86523 - DNA, 30 bp, Homo sapiens
  chr2:43654231-43654261
  hypo
ttcaggtactacaaacgtaaaagagaagac

SEQ ID NO: 86524 - DNA, 107 bp, Homo sapiens; identical to SEQ ID NO: 39512
  chr2:43812086-43812193
  hypo

SEQ ID NO: 86525 - DNA, 21 bp, Homo sapiens
  chr2:43824111-43824132
  hypo
ggctgtagtgctcttcgccca

SEQ ID NO: 86526 - DNA, 21 bp, Homo sapiens
  chr2:43824372-43824393
  hypo
ccatggcgcccggaccgtaat

SEQ ID NO: 86527 - DNA, 534 bp, Homo sapiens
  chr2:43864196-43864730
  hyper
atgaaggtgaccggccgctgcagcaagctctggagtctcgcagttgggacgttaggggtaccactccaggacagagctccctcctggggcagggactgggaggagccaaagttatagccacacccccggtgacgcccggtggtcggctgtggtctcccattggctacaccggctgccagtccctggaggaggcggtgcccttccccgccctctccgagctcggcttgaggcgggcgcgggctgagagtccggggatcccgggggccagtcgcggccgggacatcgggcgctgcggccggggacccgctgctgagatagacaggtgagaaagcccggggacgaggggccactccagagttcctgccaccctgggatccccgcccccttgagggcgccccgtccaggggggctcgcggggccgaggtttggggcgccgggaggagcgggaaggcggggacgagagggacggagcgggctgactcgggatccgccgctgcacctcccgccacagcccagagtcggcccccaagtctg

SEQ ID NO: 86528 - DNA, 53 bp, Homo sapiens
  chr2:43865097-43865150
  hyper
gtcgatattgttgtgcgtaacgctgtggaaatagaagtcgaaccacttacatt

SEQ ID NO: 86529 - DNA, 32 bp, Homo sapiens
  chr2:44104688-44104720
  hypo
tctgtctccagtgcccgcgtggatttccaaag

SEQ ID NO: 86530 - DNA, 30 bp, Homo sapiens
  chr2:44126101-44126131
  hypo
ccccgcaccacccgccgctccccgctacct

SEQ ID NO: 86531 - DNA, 91 bp, Homo sapiens
  chr2:44224202-44224293
  hypo
tctgtctaaaacaaaacaaaaaaaccacgtcgctgccttcacagggcttacagactggatcggttccctgtgcacacgtgggaagctgaga

SEQ ID NO: 86532 - DNA, 45 bp, Homo sapiens; identical to SEQ ID NO: 39515
  chr2:44497699-44497744
  hypo

SEQ ID NO: 86533 - DNA, 119 bp, Homo sapiens; identical to SEQ ID NO: 154
  chr2:45028940-45029059
  hyper

SEQ ID NO: 86534 - DNA, 188 bp, Homo sapiens; identical to SEQ ID NO: 27167
  chr2:45029183-45029371
  hyper

SEQ ID NO: 86535 - DNA, 66 bp, Homo sapiens
  chr2:45029713-45029779
  hyper
gtacacttagctactcgctcagccgcggtggcggggcccgcgcggtccctccgcagactcgcgggc

SEQ ID NO: 86536 - DNA, 172 bp, Homo sapiens
  chr2:45029987-45030159
  hyper
cggctgccccgtccgggacccgctaattacagggattcggtttccccgctctgaaggaatgcattacctgcagcaaaggaggcgcggcctctcaggaaggccccgagaggaagctgaatgccccagtgcattccagccccatccctaggtttatacccgcaacctcagccca

SEQ ID NO: 86537 - DNA, 30 bp, Homo sapiens
  chr2:45034776-45034806
  hyper
aaaggagggaagtctcgttttggaaattat

SEQ ID NO: 86538 - DNA, 143 bp, Homo sapiens
  chr2:45154224-45154367
  hyper
cactacatagccctccgcaggctgcagagtcccagcgccgaacggttctagcttccgaatgaatagcattaagctgcaccactaaagcgaggtgttctgggccctctggcccattcccacaatagaatcgagtttccccaatc

SEQ ID NO: 86539 - DNA, 86 bp, Homo sapiens; identical to SEQ ID NO: 156
  chr2:45155125-45155211
  hyper

SEQ ID NO: 86540 - DNA, 636 bp, Homo sapiens; identical to SEQ ID NO: 157
  chr2:45155355-45155991
  hyper

SEQ ID NO: 86541 - DNA, 820 bp, Homo sapiens; identical to SEQ ID NO: 158
  chr2:45155992-45156812
  hyper

SEQ ID NO: 86542 - DNA, 848 bp, Homo sapiens
  chr2:45156832-45157680
  hyper
cgcggccggccccgaaggcgcgagggacagcgcggccggcggtggagcctcactcaggcacggagcccacagagcgaggctgaggaggactccatgctgttgtccgtcgggaaaccggactactctggggcgcgctggagccaccattctgccagcagccggggaggggccgcgagggctcccaagtggacggaagtaggcgaccaacttcgccgcgactcctgcttcctagagaagggccttggctgaggaggcggcgggaggggactgttgcaaacagctgttcctcatacatatttcattacacaatcagataatgcgtcccaccaccttctcaattattcacagataaacattttcaagacgttttgacatctgtcttagtgcctgctattaatttagtaatcactgtagttaaaaatgtatgggatttttgccgtcggagcacctcgtatccggcgcgcgggcccagtgtgggactgcggctgggagcccgggccctccgggagtgaagatacctttggaggtgagacggcctctctagcgcgttgacactgttgatggaagggattaaaggggtatcaggttattttaatttattgttgaagatgatgactgccccctccccgatccgcataccgtcctcactttcccaccccaaccctagacccgacaacaccgttcagccctttgccccgggcagcggaaatggttagcttcctctaggagtttctgctgaggaaggcgcaggcaaccctagtcggcttagagagagacaaccgcacgcgatcaccgagcacgatttctcccaacaaaaaaactaacaataatagcgatccacacactca

SEQ ID NO: 86543 - DNA, 1526 bp, Homo sapiens
  chr2:45159488-45161014
  hyper
gttggggtcactcctcgcaggcactgtggcttttgtctgcatctggacaacagggtgtgcacccgtgtattcaaataattatgcctgtgggcacttctttattcctcaaattcctgttagtgttcctttaattctcccgtagtgttcctttaattctcccatgtgtattcggtacgattgcctgtacgttccaggcatagtcaggtgactcagcttgagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctttgggaaggataggaccatcatctagggcgtctctcggtggactgtggctgggccgggctgaatgggcgggcggaggtctcgaggtcgtctcctggctctcgattgctcccatcacccaagccacctcgaggtcgagtgcgccctggggctatgtctggggaggtcatggcgtctcggggcgaatgatatgcacgttttggggcaaaactctcctaggcctcgcaggagcagctgtatttgtaacttggaattggcctgggcccgcctcccttggcccctcctccagctcctacctcaacacgcagcgctcagcgggctgccagagtgagcttcccggaccacccccaagcaccctggggcctcaccatccttcagggtccctggggcatcctagaggcctggatctggaagaatgggggccaacaagagtggccagggctctcctggggcggttttgcgatgtattcctccgctagaattagcctttcgggcctgcgcgcctacaggtttcagaggccagcgggaacggtggcctcgggtgtgtgggggtgaggggtgtggtgtgtgtgcacgtgttcacgcgcgactagaagcggttccttgtgcatttctagaatcttgtagatgtgttttctcgtgagaatgatgcagacttactgctgacttaaggtcagtttgtttgaaaagggagaacgtcagtccgatggtcggtggttgtgtctctcctgagcattcgtacaaagtgaagccacctcccctccgccatgcagtctcccagaccgggtcaaaggacccaggctccaggtcgctgaggcctggagggctgaggcccttgctgtgcgccctggtgctctgatcccaaggcccaagctgccccggtacccacttagggtcagggtggaaagcctacgtgggaaagggggacctggaggactacccccacgcccatggcagggtggagtcccgaccttggcatattggacctactcacttggcatctccctgccccgaccccgtctgggatccgtattggcagcgacgaggaagggaggaatggtaagggagttgggtcggtacaggacggaagtgaagatgg

SEQ ID NO: 86544 - DNA, 112 bp, Homo sapiens; identical to SEQ ID NO: 27177
  chr2:45161221-45161333
  hyper

SEQ ID NO: 86545 - DNA, 207 bp, Homo sapiens; identical to SEQ ID NO: 27178
  chr2:45161334-45161541
  hyper

SEQ ID NO: 86546 - DNA, 439 bp, Homo sapiens; identical to SEQ ID NO: 27179
  chr2:45161597-45162036
  hyper

SEQ ID NO: 86547 - DNA, 1118 bp, Homo sapiens
  chr2:45162037-45163155
  hyper
taaacccccacacaaaggctgcccggccaccgggtcccctgtcccccttcccggggacttcggcttttgaggtgctgctgcgcgttctttctccctccccctctcagggcgccagggcccagaccaaggagctaagagtgatcgggacttgggggtaccgggtggaactccttgggggccgcccgccaggcttcctgggctgcaactcggagcccagagacccccaggggaagggcgcctcttcccccaccaccaccccagccgtcgcctgcgggaggagcacggggaacccggcccagccaaagggggaagagggaggggaaaaggaagaaggtcggggaggggctgaccatataaccagaattctttaaacggacttacccggccacctgttgagaatccatgtggggtcggctggctccggagttgcgcaaggtggacacacaaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagcagtgctgcctctcctcgccgcctttcatgccgcggccgctccttattcttgtgtctcggcctctcccggccccctcggacaaaacccccagagcccggccactctcttcccgctaaatccccttcggggtcagtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagccccctcccctcgcctcctcccctgagcagccggtgggcctggcctcgaggccacagggctgagttctaccctcgcctcaggtcccct

SEQ ID NO: 86548 - DNA, 500 bp, Homo sapiens
  chr2:45164656-45165156
  hyper
cgctaacaaggcgtacaaatgccgagcccagcagctttcttgcaatgcccggccttagcagggcgccggactaatgagggtcactcaaaggggctgatcaaatattcaaatttccccgcacgccaggaacttttatgcatggagaaagttgaggcaactgagctgtgtttactgtccggggcgacaattgcttggagcgccagtccccggaggctaaggcggggggcgggggtgcggggagggagcagttgttgttgttgtttttcaaaggaaagtaatcggggtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcggctgtttagagct

SEQ ID NO: 86549 - DNA, 1043 bp, Homo sapiens
  chr2:45165470-45166513
  hyper
tctgcacaggtgacccggcctgtacgggcgccaagtcccagatcccgcaatcagagcggccagagagcagagaagagacctagaggatctgcaagctgacctatccacccgagactctccgctctgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatttgggaggggaagctctggcgctccacagccctgcttcccacccaaacacgcactcagaacccctcgactgagatcctatggagcctgcgcccccagcccggcggggagccagtccggccctccgctctgggaccagccgccccgcctccctgccctgctctccggactctcaacttacccgctccaggaggcgggagtactgcttcaggccagagccgaaaggcgctggcggcggctggaccgcgaggtgggctcggtgggcggcgccgagctcggctctgctgggaggcgcggacagcccggggctgccacctgccccaccgggtcctggcgcacaaagctacacgcctctctgcagccctctgccctgcttcgcgttccggaaccgcggtcgccacccaagcaggcggggtgcggcagggcggcagggcggcaggcgctggggcagaggctggggggcgggggtgtcgccagagtctcagccccacttgcctcagttctccctgagtggcgatggttttttatttcagcgctttcggcagagcccgcagcacctgcccagcctccctccggggctggccgggcagtggcagggagaggccaggtcgccaccacccggaggcgggggtttcggggacggggaggggactgaccgggttcacccgcccgcccggcgcctgggtccccggctccgggggatgcagtttcggggtcacgagctgctttcaaa

SEQ ID NO: 86550 - DNA, 43 bp, Homo sapiens
  chr2:45168189-45168232
  hyper
gctcaggctccctggcgccagataccctcggaatccgggatcc

SEQ ID NO: 86551 - DNA, 93 bp, Homo sapiens; identical to SEQ ID NO: 27186
  chr2:45168959-45169052
  hyper

SEQ ID NO: 86552 - DNA, 261 bp, Homo sapiens
  chr2:45169287-45169548
  hyper
gttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagac

SEQ ID NO: 86553 - DNA, 574 bp, Homo sapiens; identical to SEQ ID NO: 27188
  chr2:45169549-45170123
  hyper

SEQ ID NO: 86554 - DNA, 45 bp, Homo sapiens; identical to SEQ ID NO: 27189
  chr2:45170168-45170213
  hyper

SEQ ID NO: 86555 - DNA, 318 bp, Homo sapiens; identical to SEQ ID NO: 27190
  chr2:45171246-45171564
  hyper

SEQ ID NO: 86556 - DNA, 88 bp, Homo sapiens; identical to SEQ ID NO: 27191
  chr2:45171836-45171924
  hyper

SEQ ID NO: 86557 - DNA, 271 bp, Homo sapiens
  chr2:45172153-45172424
  hyper
caccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaa

SEQ ID NO: 86558 - DNA, 641 bp, Homo sapiens
  chr2:45176593-45177234
  hyper
gcctgagactttgggcggggagacggttcagtgaggcagcgggaaggcccttgcctgggcttgccgagggggctgtgatggtggagtggcccccaggttcttctgcaaggagaataggacagcctggtacattctcgacccagcgcatcacccgggaccccggagctcgaagtccattcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacgcgcgctgaggcccccacggcttcccaccgctccggccctttccggccccagctgagctgaagctccctggccccagtgtgcgggccccggtggccgtctggcccgagggagggcgggggcaggcgagagggagccatggaggaggggagcagtactagcccggctccaatttctccggtcagctgagcacaactttccattcgagtgtattcatgcagcggctgattgagctc

SEQ ID NO: 86559 - DNA, 760 bp, Homo sapiens
  chr2:45179296-45180056
  hyper
aaggcagggtccagacgtgagggggagcgcggcggggcgtgggggacgcggcccccggggcaggggtccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccggcctgtggctgggcccgcactgcctttggtttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgtgtgtctgagctgaagcggctacgcttataccgggaggtgaaacggaagctcagagagggccataatttggccactgtcacacagccaacctccaccttcacccggctacaccaacac

SEQ ID NO: 86560 - DNA, 984 bp, Homo sapiens
  chr2:45181451-45182435
  hyper
cttaaggactgtagtcgggggcagtgaggctgtagacaggaaggcccctaggaaactattccaataggcaggactgagctaagacgccagaatgggttaaaggcatttccaaggaggaatggtgaggacttgatgaccagctgcagaccttataggctgccctccgaccttcagcttcctgtgcgctcacaattcacgtgctcacacgtgctccttagaggggtctgtcggtggacgccgcgaaccaatcaaacccttgcactttgttccaaaacccattccctaccagaatgggagtcctgtagggccaggtctcctcccatacccacccatttcggcctttgttctactgcacaataacagctggcactggggtgcgggaggacggtgaaagctcgagtcccaggctccaaatcctccaggagtaactggggtgacccgaggagagcagcgcactgggtgagtggaagcgtggcccgtgagaagggtaccgagggtcagaagtgtcgcaagggacccaggacgcgcgcgcctccgaacccctgagtcttcgcaggctctgcgaaacttcagtgcgcgcagcctcctgcacaccgttttcgcgcgacctccttgcctcggtctccaggggtcaagccaacccagcgcgggaatgttccatttgcccttttgggacattcagagaggcttttccgggctgccgcggcgcttccacgcagaggaggcgtcggcttccaggcagcttggcgatcttgttattggacacgcgagagtttagagacccagagaaatggagtgagtcaaagtcaaactcaagtttctcggcccctagtcctgcgattcttccattgcacattgcacccctgggcctttcacatctgctcctagcgagcttggagtgtaggtgcgaccagggcgcatctgtgccagtgcgtgtctgcgtgcgtggcctttgggtgactccacgcccgcaactgtctccga

SEQ ID NO: 86561 - DNA, 39 bp, Homo sapiens
  chr2:45231112-45231151
  hyper
cttagaaagtccaagcgaaagggtattctgattttatcc

SEQ ID NO: 86562 - DNA, 294 bp, Homo sapiens
  chr2:45231244-45231538
  hyper
cgcccggccgcggtgccctggtcgctgagggacgcggtcagtacctaccgccactgcgacccgagaagggaaagcctcaacttcttcctctcggagtcctgcccactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactc

SEQ ID NO: 86563 - DNA, 341 bp, Homo sapiens; identical to SEQ ID NO: 27198
  chr2:45231852-45232193
  hyper

SEQ ID NO: 86564 - DNA, 61 bp, Homo sapiens
  chr2:45232401-45232462
  hyper
cacatgagggcattacggggagacggcaagtcggcggctcggggggcgcgctcagccggga

SEQ ID NO: 86565 - DNA, 413 bp, Homo sapiens
  chr2:45233374-45233787
  hyper
gtgttgcagtgggtccgctccacctccgcctggcaccggcactggcactgcgctggggcccggagggtggcccaggctgtgcagggacggcagcccagggggcggcgggctgaggagcagtgcggggctggatgatgagtggtctggcgtccccgatggagtcttctcatcctccgagctgcctaacaccgacttgccgctgccattcagcgggttgtggctgttagaattggagttctcgttgttctccctgcaagtgcgggagcaaagcagcggggtcagcagggacatcgagaccacccagcgccatctcagtcacagtcagagccagccaccagcctcgggagacagatcccgggcttgtggcctgcgggtgttttcggtttctaccatttcctcgacctggtctgggt

SEQ ID NO: 86566 - DNA, 1411 bp, Homo sapiens; identical to SEQ ID NO: 27201
  chr2:45235475-45236886
  hyper

SEQ ID NO: 86567 - DNA, 511 bp, Homo sapiens
  chr2:45237178-45237689
  hyper
gggcacattctaccccggcgcaggccagtgggatgggagagtttggacgtgctcgggtgccgcccaaagacttggctttttctgctgacagcgccccacccccatcctagaaactctggactcagcggtcctcgagggaaaaggggagggagtagacgaaagaaatggggaagatttggcagtggccgcaggcggacgccggagaatcgacttcccggaggatcccgcctttcctccctctcctagccccgccggctgcctggcggcctgtaccgccccaactctgcgctctctgctcctcgccgggcggggactcagacttaaccccacgggtcccacagcccgaggagcgccaggcagttccgtgtggcctctatggaagctgactccggccggcagctgcgacgcagaaccccggacggcgcagacccgcagtctgcccaccggggcgggggagaggggcgacggcagggactctaggacggtggtggggcttccccggtgggtggtc

SEQ ID NO: 86568 - DNA, 253 bp, Homo sapiens; identical to SEQ ID NO: 27204
  chr2:45237690-45237943
  hyper

SEQ ID NO: 86569 - DNA, 104 bp, Homo sapiens
  chr2:45240323-45240427
  hyper
tccagcctataaaggcggcagaaatcccctgggtagactctggccctggcgccgcccgcctcgggcgctccatgctgctccgcacctcgggctctgggatgctc

SEQ ID NO: 86570 - DNA, 141 bp, Homo sapiens
  chr2:45240490-45240631
  hyper
cgcgttccccagacagtcccggagttctctgggcctgggcgacgtgtttcgttgaaagcgggcaggtggtgccgggcggggctgcgctgaggctccggtgcctccccacctgcccctcgtacctgccggtctgtcgggtcc

SEQ ID NO: 86571 - DNA, 406 bp, Homo sapiens; identical to SEQ ID NO: 1963
  chr2:45240763-45241169
  hyper

SEQ ID NO: 86572 - DNA, 591 bp, Homo sapiens
  chr2:45241232-45241823
  hyper
cgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcccaggagggagaggagggagaggacgcggagagggcccgctggttcttccctcctcaccccagcactgacccgcctgtgcgctggcacggagggctcgaaaatcggggcgcgtccgcgaagagcgagacctcggagacagacacacaacccagaggtgcactaggttgccagacggtctgatcacaggattcttggggggatagacgctggcttttctccatcacacgtttcccctgcaacgtctgggtgcccaggaaatgtttgaatggatgcctgaatgaccaatcgggtttgactgacagcaacagctgggaagtgacccggccaataggagaatggccctcttcctcctctttcctcccgctcttctctccca

SEQ ID NO: 86573 - DNA, 1141 bp, Homo sapiens
  chr2:45395854-45396995
  hyper
ttgtattttgagaaccgctccctttcccgcacacgcattgctgcctcctctcgggcttggttaatgagtctgtgcgccaagccaggtcgctccgggcagttcgcgcttccgcgcctcggcactcggatgaccgtgtcctattcgtctctctcgtgaatgtcgctgaaaaaaaataaaagtttgttctaagcccgtggcatttccgcgcgcagatggaaaggcaagtgggagaggagggtgcaggtgcggggcgggcgcggcggccccttcaggcgccgggggctgggctgcccccggccgggagcagctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgagctttccgggagcctctcccgcagccgatgggcatctaggggcgcagaacgaagagtgggcgccgaaacgggtgtaggcgctggaggccgacggggaggcccggggcggtcaggcttctcggtagagagggccgtgcacctcgcggcctgcgggctaaggcggggagccgctcctgcggcggccgggcgcgcggactggagggagggaagcgccacggactggggaaccggggtgacggggagacgggggggctggtggggtgaggtcggcgggcagcagccaagtgttctgcagctccgaaccccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctctctgctttcccaccagccctgtagatacggagccagcagtcgggctagagcggag

SEQ ID NO: 86574 - DNA, 54 bp, Homo sapiens
  chr2:45397223-45397277
  hyper
gcgattcccggctgtcggcggtggggctaggccttgcggcggatgagccagacc

SEQ ID NO: 86575 - DNA, 77 bp, Homo sapiens
  chr2:45879337-45879414
  hyper
gcagactttccttctcgacccctacattgccctcaatgtggacgactcgcgcatcggccaaacggccaccaagcaga

SEQ ID NO: 86576 - DNA, 45 bp, Homo sapiens
  chr2:46525712-46525757
  hyper
acctggattgccctgcgggggcagatggttcggtgtgtaggaagc

SEQ ID NO: 86577 - DNA, 237 bp, Homo sapiens
  chr2:46526002-46526239
  hyper
ttctgcaaatgtgtgcggctcgccgcctgtcccctttctcctcctgtctccacccgtgcggccccagtggcctggagcttccagccccgcgcttggccgcggcttggcgaggctatgctgcgggaagctggaatccaacgcgcggccggctgaaccgcctgagccgcgggaaaccagcggcggagcggcggtatagaggtgcgaggatgaggaggaccgactcgctaagggagggag

SEQ ID NO: 86578 - DNA, 132 bp, Homo sapiens
  chr2:46770699-46770831
  hyper
gaccacatcacaccccggccctttgccggttcacagtgagctggccgcacgggaaaagggggtgacatctcgcggggagcgcccccacgcctctagctgggttgggagaggagggtccgggtggggagcgaa

SEQ ID NO: 86579 - DNA, 119 bp, Homo sapiens; identical to SEQ ID NO: 27010
  chr2:468115-468234
  hyper

SEQ ID NO: 86580 - DNA, 280 bp, Homo sapiens; identical to SEQ ID NO: 27011
  chr2:468423-468703
  hyper

SEQ ID NO: 86581 - DNA, 16 bp, Homo sapiens
  chr2:47194061-47194077
  hypo
attgtgttggccgggc

SEQ ID NO: 86582 - DNA, 160 bp, Homo sapiens
  chr2:47200582-47200742
  hypo
ggagggcctcagtgccgagtgcggcggaggatggatccctcccactgccgcaggttgccggttgaggtgaactgtttccacctggagggagctaaggaaagaaagaagcctgtacacaaagtcatacattcacacaaacaaatggcgtgcttccaaacaa

SEQ ID NO: 86583 - DNA, 47 bp, Homo sapiens
  chr2:47235457-47235504
  hypo
agttagctttaaatccgagagaggctcctagacgctctccaggctca

SEQ ID NO: 86584 - DNA, 30 bp, Homo sapiens
  chr2:47249809-47249839
  hypo
tgggagcggcagtcacggtgacatcgggta

SEQ ID NO: 86585 - DNA, 89 bp, Homo sapiens
  chr2:47335736-47335825
  hypo
cctggagattcctttcacttaagatagcatgagcaccctctttttgcagtccaggtagtaggtaggtgttgtcccgcttcctggcattc

SEQ ID NO: 86586 - DNA, 185 bp, Homo sapiens
  chr2:47567513-47567698
  hypo
gaaggtcttgtgtgtcgattagagacaagcaaaggaaaacaaatctaccaggaatgctggtgttttcctggagagtgtttcactgatcacggggtagtgctctttgctcagtggagaggtacaaagctgtctagcccctgcttgctctgagggggaattctctgggctctcggaacctcttattt

SEQ ID NO: 86587 - DNA, 30 bp, Homo sapiens; identical to SEQ ID NO: 39518
  chr2:47574359-47574389
  hypo

SEQ ID NO: 86588 - DNA, 229 bp, Homo sapiens
  chr2:47596565-47596794
  hyper
ctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggccccc

SEQ ID NO: 86589 - DNA, 120 bp, Homo sapiens; identical to SEQ ID NO: 39519
  chr2:47597757-47597877
  hypo

SEQ ID NO: 86590 - DNA, 180 bp, Homo sapiens; identical to SEQ ID NO: 39520
  chr2:47598297-47598477
  hypo

SEQ ID NO: 86591 - DNA, 83 bp, Homo sapiens; identical to SEQ ID NO: 39521
  chr2:47598537-47598620
  hypo

SEQ ID NO: 86592 - DNA, 42 bp, Homo sapiens
  chr2:47599472-47599514
  hypo
tttttgtaaaagaggcggtgacagccgggcatggtggctcac

SEQ ID NO: 86593 - DNA, 473 bp, Homo sapiens
  chr2:47748050-47748523
  hyper
tggaggcgctggtctcggccagccggttgttcatgatgcccagcgcgcccacgccgcccgagaagccgttctggcgcgtgttgacgcacacgctgcgcgggtagccgttggccgtctccgacagctgcttctgcagcagcgccagcgacaccttgttggaggccgtgaggtcgcgcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctgg

SEQ ID NO: 86594 - DNA, 40 bp, Homo sapiens; identical to SEQ ID NO: 27215
  chr2:47748726-47748766
  hyper

SEQ ID NO: 86595 - DNA, 45 bp, Homo sapiens
  chr2:47753181-47753226
  hypo
ttaaacaactgagaacgagtctcaatcttaaaactggtacttaat

SEQ ID NO: 86596 - DNA, 738 bp, Homo sapiens; identical to SEQ ID NO: 27216
  chr2:47796750-47797488
  hyper

SEQ ID NO: 86597 - DNA, 474 bp, Homo sapiens; identical to SEQ ID NO: 1966
  chr2:47797489-47797963
  hyper

SEQ ID NO: 86598 - DNA, 1069 bp, Homo sapiens; identical to SEQ ID NO: 1967
  chr2:47797964-47799033
  hyper

SEQ ID NO: 86599 - DNA, 115 bp, Homo sapiens
  chr2:47799123-47799238
  hyper
cggctgcgggtgctcctctgctggacacaagccggctttgccggggccacaaaagttctggcgtggaacaccctcagtacaggcggaaaatcatcctcttcgggcagccagctcc

SEQ ID NO: 86600 - DNA, 91 bp, Homo sapiens
  chr2:48209807-48209898
  hypo
tagagaattaaagtgcggaaagactttattttacatagccaaaaagaggagcagtgatgaattaactttagttgctcgggattaaatagag

SEQ ID NO: 86601 - DNA, 193 bp, Homo sapiens
  chr2:48323080-48323273
  hypo
tggttaaaatgatctcgaaaattaaatcaaatctattttagacaaacaacgtctgagagaactcatttagcaaacctgaaatacaagacattaaaggaagttctttaggcaggggtatgatactggagggaaatttggatctacgcaaaataatgaagagttccagaatggtaagtgacggtgaacagattac

SEQ ID NO: 86602 - DNA, 70 bp, Homo sapiens; identical to SEQ ID NO: 39383
  chr2:484928-484998
  hypo

SEQ ID NO: 86603 - DNA, 182 bp, Homo sapiens
  chr2:48625247-48625429
  hypo
gaatggctttggctgcgctaggattgattaaattgatgagaagacaatccatatgctgtcaaaaaatatttttatgggcaaaaattcactactaatacctgcaatattggttccgaaagaaatggagaaaatgtttcatcaaatttattagctctatgttaaagaaacgaaacaaaggaacc

SEQ ID NO: 86604 - DNA, 149 bp, Homo sapiens
  chr2:48655875-48656024
  hypo
ctgctttctttctgacgatggacagccctgcactcaggcaggcataattgggggcttactcaggcatccctgagtatagagggctaaataagatgcagtcctagatgagcacggtggctcatgcctgtaatcccacctgggaggccgag

SEQ ID NO: 86605 - DNA, 85 bp, Homo sapiens
  chr2:48757541-48757626
  hyper
agagggatggcctcccggcagggactcctcggctcccctctgttctgagactgctgctgggaccggggtccgactctaaagagaa

SEQ ID NO: 86606 - DNA, 182 bp, Homo sapiens
  chr2:48982519-48982701
  hyper
tttgatagggcaaagcgtttttctccaagcttccagggaaagggggccaaaggagtagggagggaaggtggcatagagcgatggagggtcctgcatcaagggcgccgcgacgggagcgctgtgtactcacagtcgagtgagaccggccgtggggccggggcagcgcagggcgccgtcgggca

SEQ ID NO: 86607 - DNA, 186 bp, Homo sapiens
  chr2:48982753-48982939
  hyper
cggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcccttccacacacccttccctgccggcccgcccctgccctccc

SEQ ID NO: 86608 - DNA, 19 bp, Homo sapiens
  chr2:49004570-49004589
  hypo
tcaccggctgattgtttta

SEQ ID NO: 86609 - DNA, 149 bp, Homo sapiens
  chr2:49172411-49172560
  hypo
gagttaaagtaacagcgaagtgtggagcctgatggattgaaatgatgagcaaagagaaatgaagttgggagcaaagctgtgatctctgatttgggtacgttgagtttgaagttccggtgggagatagccacaagacaattaaaaaagtg

SEQ ID NO: 86610 - DNA, 16 bp, Homo sapiens
  chr2:49461025-49461041
  hypo
ccgtagtgagcaccat

SEQ ID NO: 86611 - DNA, 190 bp, Homo sapiens
  chr2:496190-496380
  hypo
gagcatcctgagcatcgatggtgagaagctacaggaggccgagcggctgttgacgcccaggaccgtgggcagcaccttgcagggggaaaccggcttcctccggtctcccagaagaagagttcaggccttctctcctctctccaggcctccagctcttccccatccccgctctcagcggaggactggcttc

SEQ ID NO: 86612 - DNA, 69 bp, Homo sapiens; identical to SEQ ID NO: 39385
  chr2:503076-503145
  hypo

SEQ ID NO: 86613 - DNA, 161 bp, Homo sapiens
  chr2:503840-504001
  hypo
gacccatcagatccccgcctttgctggggtactgcggtggccacaactcgcatggagcgccgcctgggaaagggaggagaggacgcatgagatcagaaacactggctgccgtaaacacttacaatgaaaataacgtaacaaataagcgaaaggtaaaatgt

SEQ ID NO: 86614 - DNA, 92 bp, Homo sapiens
  chr2:50497730-50497822
  hypo
atacacacagtttatcgacaccgtgaaagtataacgtacaagcaaattatatatttatatgtaaaatgcatatagatatagttttttttttt

SEQ ID NO: 86615 - DNA, 155 bp, Homo sapiens; identical to SEQ ID NO: 27222
  chr2:50573484-50573639
  hyper

SEQ ID NO: 86616 - DNA, 152 bp, Homo sapiens
  chr2:50573691-50573843
  hyper
cgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgca

SEQ ID NO: 86617 - DNA, 309 bp, Homo sapiens
  chr2:50574047-50574356
  hyper
agcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaag

SEQ ID NO: 86618 - DNA, 284 bp, Homo sapiens
  chr2:50574401-50574685
  hyper
cgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcag

SEQ ID NO: 86619 - DNA, 345 bp, Homo sapiens
  chr2:50574738-50575083
  hyper
cgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggaca

SEQ ID NO: 86620 - DNA, 305 bp, Homo sapiens
  chr2:51259261-51259566
  hyper
ggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcaggg

SEQ ID NO: 86621 - DNA, 74 bp, Homo sapiens
  chr2:522014-522088
  hypo
ggaacccacggaacccgatggcatggaaccagaaccgatggcaccgaaccggaacctgacggcacagaaccaga

SEQ ID NO: 86622 - DNA, 67 bp, Homo sapiens
  chr2:52798706-52798773
  hypo
ggcatcagcagtcatcgcccactctgtccccgctgtcatacatcactcaggccgtggccttgaatgc

SEQ ID NO: 86623 - DNA, 132 bp, Homo sapiens
  chr2:52856761-52856893
  hypo
agcctcccaaaaattcgcagagccccgcaggggaccggccaccaccgccattatcgcccgcgtctgcgccagggctcggcggcgtggcgccaccaatcgccggtccgcgggagccttcggtcttcttgtctg

SEQ ID NO: 86624 - DNA, 66 bp, Homo sapiens
  chr2:53241890-53241956
  hypo
ggaataaggaagtatcgttgatcctatttgtgaattccatatttttaaattcgcctactcactaaa

SEQ ID NO: 86625 - DNA, 30 bp, Homo sapiens
  chr2:53743692-53743722
  hypo
tcagaagatatttaccggcctctggtgctg

SEQ ID NO: 86626 - DNA, 82 bp, Homo sapiens
  chr2:54951713-54951795
  hyper
atggcagagctcacccgggttgcctgtcaaatcaaggctatcgcagaataaatcccgccgcctgccgcgaagccccggcgca

SEQ ID NO: 86627 - DNA, 199 bp, Homo sapiens
  chr2:54952233-54952432
  hyper
gctggagtgggtgtacgggtaccggggtcaccagtgccgcaacaacctgtactacacggcaggcaaggaggtggtctactttgtggctggggtcggggtggtttacaacacccgcgagcacagccaaaaattcttcctgggacacaacgacgacattatcaggtaagggggtggccaggggcggcggggaggggttgcg

SEQ ID NO: 86628 - DNA, 50 bp, Homo sapiens
  chr2:5506198-5506248
  hyper
cctggtggactgacacgggcagttttggacgtgagcgttgtgaaagaagg

SEQ ID NO: 86629 - DNA, 62 bp, Homo sapiens
  chr2:55289153-55289215
  hypo
agcacgtcaagagcacgtcaagagcacacggacaggcactggcacgccggcaggtcattgac

SEQ ID NO: 86630 - DNA, 82 bp, Homo sapiens
  chr2:55458383-55458465
  hypo
tcacgaaaaaaaaaaaaaaaagttccaggaagaataaacgactggattcttcagaaatgccaaaacacgggagggcataggt

SEQ ID NO: 86631 - DNA, 30 bp, Homo sapiens
  chr2:55554706-55554736
  hypo
gtgttctgagtacagcgattctaaatgtag

SEQ ID NO: 86632 - DNA, 30 bp, Homo sapiens
  chr2:55646190-55646220
  hyper
ggggagtaaaaatttcgttctccattttac

SEQ ID NO: 86633 - DNA, 30 bp, Homo sapiens
  chr2:55646428-55646458
  hyper
acgagcagcagcctgcgctggaaatgtctg

SEQ ID NO: 86634 - DNA, 96 bp, Homo sapiens
  chr2:55652969-55653065
  hypo
acaatatgctgctaccggaaagatactaagcaaatgaaaaccttatagagcagtggtccccaacctttttagcatcagcaacgggttttgtggaag

SEQ ID NO: 86635 - DNA, 21 bp, Homo sapiens
  chr2:55669245-55669266
  hypo
tggagccaagatggccgaata

SEQ ID NO: 86636 - DNA, 28 bp, Homo sapiens
  chr2:55874935-55874963
  hypo
gcgtgagccaccgcgcccagcagacatt

SEQ ID NO: 86637 - DNA, 638 bp, Homo sapiens
  chr2:56149809-56150447
  hyper
tactccatcctgctacgctgtttacatacaaaagacattcagcgtgcattttatactgcacctacaaagcaggctgcagaaagagggggtcgaaaggaaaaaacagtaatccatttcaaaggggacggtgcatttcctgccccccagtcccacaccccgggggatggaggtggggctgcaaaactctgttctctagaacgttaaggctttcccagtatactcaccttgagctagcagagttccttgcacagcacagcaaaaatacctgtgagccaatatgaattgccttggcctcaagctttttattttttaaacaaaataacaaaacaaaactcggagagcaatcttccagttctagtagaatactagaccttctcacatgtctcagagcttctcacatcccccagcacaaactctcaaagtggcatttccacgcctttctctgcgcacagctttgtttaaaagtcccaggttgtgtggaggggcagcccaaagcgactgattctcttttgtcttatcagtctgggtccccgacacgctaccttcggtttcaggctgcctaggaccggaaccagggatcgcaccgcagcccaaggtaccagtttcgggcgggcggcctggcccggcagggagatgag

SEQ ID NO: 86638 - DNA, 455 bp, Homo sapiens
  chr2:56150698-56151153
  hyper
acctccctctctgcccgagacaccctgcacagtccagggcagttctcgggtactcaacacccctcagctcaccccacctcactctcccgcgcgcggcccagtgagtactgggctcgctcggggcgaccccccgttgggggctcctacctgtgcggccgcgctgcgctccgggcccgggcagcgaggggagtgcgcaggggagggcagccccgtgggtctgatctggcgaagtccggcagcggccgcggcggcaggaggaggaggagaaagggagggaaagggggagggcgaaggggggcggaggagagagctgagggaggcgcgagcgctgagcccagcgttgcgagcccggcggtagagcgcgcagcgcagcgaggtccgcgccccctgctccaggggccctctttgccgcccccgcttgccctcccttgccagctcctcgtttcccagactcg

SEQ ID NO: 86639 - DNA, 30 bp, Homo sapiens
  chr2:5623242-5623272
  hyper
ccgcggcgttttccccgtgccagaaaaaga

SEQ ID NO: 86640 - DNA, 21 bp, Homo sapiens
  chr2:56263732-56263753
  hypo
ccacagcgcctggccagatat

SEQ ID NO: 86641 - DNA, 253 bp, Homo sapiens
  chr2:56411000-56411253
  hyper
cgcacctcgagggcccgggcagcggtcgagtggcagctgcgtccagcccatgcgggagctgctgcgggttacgggtggccccagctccaggctcctcctccagccggtcccccaccctccaccccttctcgactccgctctgcaaatcgaaggctttccggagcagcctaggagcggccgcgggcgcagcgaaggcggcaggaggagcgcagcagccttcgggcagccgcggcggcgtcgctagagcagccgg

SEQ ID NO: 86642 - DNA, 270 bp, Homo sapiens
  chr2:56411529-56411799
  hyper
caagcggctggctgccgggccctgggggagcgcgggcgcgcgcgcggggatggcgaggtaggatggccacccagcgcgacccccgccgccccaacccagcggcccctgggcggtgccgctgactcgccggagcgcacaggggtgtgggcggaggcggcctcgccgcgcccgcgccttcgggagtcgcctcgcctcttccacccacttgcacctgccaccccgcggataccatgtcgaaggcggccggaggcgcggcggcggctgcggcgg

SEQ ID NO: 86643 - DNA, 72 bp, Homo sapiens
  chr2:56412255-56412327
  hyper
ggctgttcggggaggcgctgaggacgctggaaagcagggagggaggtgaagggcacgcgaacctttcatttc

SEQ ID NO: 86644 - DNA, 57 bp, Homo sapiens; identical to SEQ ID NO: 14375
  chr2:5704308-5704365
  hypo

SEQ ID NO: 86645 - DNA, 253 bp, Homo sapiens
  chr2:5813654-5813907
  hyper
cacccgcagccacagcgcccgcccgggacacctgcccctccacggccgcgcgggcggaggatggcactgcaggtggcgaggctgctgcactgggcttccgaggaggtctgggggaggaggcagctggcagaaggaaagccagacggcggcggcagcagcttaataaggggggtctccagagaactgtggtccaggcaggtggctgggagcccggtgagccctttcagagaagggggagcgctgctgtctcaaa

SEQ ID NO: 86646 - DNA, 29 bp, Homo sapiens
  chr2:58269102-58269131
  hypo
acaagtatcgattgacgtcttctgtctcc

SEQ ID NO: 86647 - DNA, 249 bp, Homo sapiens
  chr2:5830956-5831205
  hyper
gaaaggaagcagattcggataattttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaacacaaaggagacgaacacggcacgatcgc

SEQ ID NO: 86648 - DNA, 164 bp, Homo sapiens; identical to SEQ ID NO: 27023
  chr2:5831237-5831401
  hyper

SEQ ID NO: 86649 - DNA, 581 bp, Homo sapiens
  chr2:5831467-5832048
  hyper
cggaggggcggggagaggacggggcggggagaggaggggcggggagcagagggagaagggaaggagggcgccgggcccctcgcagggacgccgggcggggcgcgggcttgctggagcctgcgggacccagagcccgctccggagccagccctgggagtggccagcttgaacccgagggccccgcagaccgttactccggcccccgcccggggcggggcgcgcgggggcgcggcgcagcccaacccgcacagccgcgtccccaaacaccaccgaggagggaaaacagacggagaaaaaggacaaaacagaaaaatgcaaaacgggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagc

SEQ ID NO: 86650 - DNA, 111 bp, Homo sapiens
  chr2:5832283-5832394
  hyper
cgcatctgtgcacacacgcggattttttaaaaataacatatttctagacatgcctcctctccccccacccccatctttgcaaagcagcccggagggcggggtggaggggcg

SEQ ID NO: 86651 - DNA, 132 bp, Homo sapiens
  chr2:5832715-5832847
  hyper
ggggagggggggagccgcgaaagcggggtgccgaggactttgcaacttgcccaggaaggtggaggggtgggagggggagggggacctccgcacgagacccagcggcccgggttggagcgtccagccctgcag

SEQ ID NO: 86652 - DNA, 151 bp, Homo sapiens; identical to SEQ ID NO: 1926
  chr2:5833282-5833433
  hyper

SEQ ID NO: 86653 - DNA, 141 bp, Homo sapiens; identical to SEQ ID NO: 1927
  chr2:5833499-5833640
  hyper

SEQ ID NO: 86654 - DNA, 399 bp, Homo sapiens
  chr2:5833734-5834133
  hyper
cgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcggg

SEQ ID NO: 86655 - DNA, 522 bp, Homo sapiens
  chr2:5836053-5836575
  hyper
ccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggc

SEQ ID NO: 86656 - DNA, 124 bp, Homo sapiens; identical to SEQ ID NO: 27032
  chr2:5836621-5836745
  hyper

SEQ ID NO: 86657 - DNA, 165 bp, Homo sapiens; identical to SEQ ID NO: 27033
  chr2:5836827-5836992
  hyper

SEQ ID NO: 86658 - DNA, 116 bp, Homo sapiens; identical to SEQ ID NO: 6040
  chr2:5837352-5837468
  hyper

SEQ ID NO: 86659 - DNA, 30 bp, Homo sapiens; identical to SEQ ID NO: 5265
  chr2:58614664-58614694
  hypo

SEQ ID NO: 86660 - DNA, 166 bp, Homo sapiens; identical to SEQ ID NO: 39527
  chr2:58641373-58641539
  hypo

SEQ ID NO: 86661 - DNA, 168 bp, Homo sapiens
  chr2:58654927-58655095
  hyper
actcccctgaggagccggctgcagggcggtgattcgcccccgggatggtggcggcgattccgtgcgccttcctgcagttggacatcagttatatttcaggctttcaaagtaaacgacgaactcagcactttggcagagtccaaaatccgccagcgaacttgggtgcta

SEQ ID NO: 86662 - DNA, 203 bp, Homo sapiens
  chr2:58655428-58655631
  hyper
agaagggagagggagcgcctgggactcgagacggcggcaggttcaattagctaaacaaagaaatcatggcggattgtttacatttggcagcgcccgggctgcgccgaccgccggccccgagccgccgcgggctccgaggagtcggccgagctgctcccgcgccctggccgggtaagtgacgccggccgcgggcccggggcggc

SEQ ID NO: 86663 - DNA, 254 bp, Homo sapiens
  chr2:58655979-58656233
  hyper
cctccgggacccaggcggagcgcgccactcagcccgggaggtggggccgggcagtgaccccgcgcgaagtgccagtgcggagggcgggggtggttaccgaaagatgtaatcccaggaggggccgccgccttcgctgtcccctacctgtaccctctctttatcctaccctccattccccgacccttttctccctctcttctccccgttcttttctactcccctcattgcttttctcagaccggccttagggttga

SEQ ID NO: 86664 - DNA, 169 bp, Homo sapiens
  chr2:5866042-5866211
  hyper
ggagtatcaagttagcgaaactgcaagggaaactgggggcagcagagcgacgtgccagcgtccgtgttgggcgggtgtcggggggacccggacaccccgccctccttcctgcagagctctgcgggccctgtggcatccatggagaccctggctccggtttcacaggaag

SEQ ID NO: 86665 - DNA, 201 bp, Homo sapiens
  chr2:5886248-5886449
  hypo
atgtgccgaagaagccggaggacagacataaagttgacaactccgccttttgccaaataagagaattaagaaacaagctgaccccttttcataaaagaaaaaactttcaataccgaaaagcagaaggttacagtcttgaaggactggagtttaaatggaccaaaatcactttgtgaaaaactcactcgattgtttcttgca

SEQ ID NO: 86666 - DNA, 166 bp, Homo sapiens
  chr2:58943963-58944129
  hypo
ggcttcaccatcgttcgtatgagaatattagacacaattattgtgttcatattagagaatctatagaacttatcatgcataatgaataaaagaaatgtataaggggaattgtcggggagcgttaagaagccaaggttctgggagtttgggtcggctgatgatactt

SEQ ID NO: 86667 - DNA, 30 bp, Homo sapiens
  chr2:59140038-59140068
  hypo
tatatgtacaattagcgcaaaataacattt

SEQ ID NO: 86668 - DNA, 30 bp, Homo sapiens
  chr2:59145084-59145114
  hypo
tatattgaacagattcgcagaacaagactt

SEQ ID NO: 86669 - DNA, 18 bp, Homo sapiens
  chr2:59269708-59269726
  hypo
tgtcgcatttactaacat

SEQ ID NO: 86670 - DNA, 209 bp, Homo sapiens
  chr2:59273588-59273797
  hypo
tccagctgccagtgccgcccaaagaagagagcatgccgcctggctttaagaaagcttgcagcccctgagagtggcaggttaaaaacctatagggtggttcaataaaaggcaatgccttgctccgtcctgtgctgctattgtacattggaacacatgctgctaggagacaaagaggacacgcgtttattttcaagcgtaggactttggaa

SEQ ID NO: 86671 - DNA, 30 bp, Homo sapiens
  chr2:59393002-59393032
  hypo
cctacggtgaggtttcgaccaagagtttag

SEQ ID NO: 86672 - DNA, 103 bp, Homo sapiens
  chr2:59479352-59479455
  hypo
gttgtccagaataagagtcaccgtttaaccatttactaactgtgtgcataggcaaattattttattttctatgtaataagataataaccggttactgtggctg

SEQ ID NO: 86673 - DNA, 44 bp, Homo sapiens
  chr2:602373-602417
  hypo
tgggctacttggctacgggagttctatttcgaaaatgctgaacc

SEQ ID NO: 86674 - DNA, 30 bp, Homo sapiens
  chr2:602842-602872
  hypo
acatggctggaggatcgtcatgggttttga

SEQ ID NO: 86675 - DNA, 82 bp, Homo sapiens
  chr2:60411668-60411750
  hypo
taacaaaattaatgacgaattgtagatcaaggaagctcagcaaacaccaagcagggcaagtcccccacaaaaaaaatctaca

SEQ ID NO: 86676 - DNA, 172 bp, Homo sapiens
  chr2:60442223-60442395
  hypo
gtgggttttcttccccgaaatcattttcccctttcggggcctggaaatgaaacccatgtttcatatgcttcattacatgtctattatatagcaggtcttaaagagcagtgcattgataatatattgtgctagttgtaaatgatctgtccatctggagcggcacgctaacaca

SEQ ID NO: 86677 - DNA, 30 bp, Homo sapiens
  chr2:60687883-60687913
  hypo
gctccctccacttcccgtgccgctgcgccc

SEQ ID NO: 86678 - DNA, 110 bp, Homo sapiens; identical to SEQ ID NO: 14414
  chr2:60705907-60706017
  hypo

SEQ ID NO: 86679 - DNA, 30 bp, Homo sapiens
  chr2:60706520-60706550
  hypo
ggtctagcatttccacgcagtcccaaccat

SEQ ID NO: 86680 - DNA, 217 bp, Homo sapiens
  chr2:60706757-60706974
  hypo
tggacggcaggctgacgcggtttcaaagaggccgaccaggcaagaaccgtcctgtactcctgccccagctctaatgcaataaaatgtcttttatcaatgtaattcaaggcaaagagtcaagggtctgtcaccattttaaagaggcttattacatggccacaaaaatttgcctcaggctcaaacctggcatgtaaggtatcagcgtgggacaggttct

SEQ ID NO: 86681 - DNA, 30 bp, Homo sapiens
  chr2:60732287-60732317
  hypo
aaatgtgattttatccgtatcctcattact

SEQ ID NO: 86682 - DNA, 30 bp, Homo sapiens; identical to SEQ ID NO: 39533
  chr2:60733708-60733738
  hypo

SEQ ID NO: 86683 - DNA, 98 bp, Homo sapiens
  chr2:60780399-60780497
  hyper
agacatggtgggctgcggggcgggcggcggcggcggcggcggcggcggcgggcggacgacggctcggttcacatcgggagagccgggttagaaagaag

SEQ ID NO: 86684 - DNA, 153 bp, Homo sapiens
  chr2:60784352-60784505
  hyper
ccaaacctttggtgacgacactgcgtgtaaactccaggccagcagacgacccctccccttccctcctccccctttttatcttgcccgcggaggagacgccccaggacttcctgcagtatatattctgcctctgatctccgtacttaatagcca

SEQ ID NO: 86685 - DNA, 453 bp, Homo sapiens
  chr2:60796196-60796649
  hyper
tcccaaagacccacacgaacgtctccttctccagatcacccactagagtacacagatgcctcctctgccccacactctctttctttcctcctcttctctctgtatcaggggctgggtggtaaagaggctgactgagggggagtcacgtgggcagcccgtgggcagcggcggcagcagctcaaaagaaattgactgactggccgcttgggcgcatttcaatatatggaaatgaccagaggcttctgcaataaatcagcactcaacactttgtcatttttctagttctgcttcattttcctattttcctcttctcctcacagaagcctcatttcttgcattttgccttgccgcgtctcttcccacttccaacctacaccctctccaaatcttgccccatcctctccatcgctcccaaccaccgcgcgcccccacccccgacacacacacacacac

SEQ ID NO: 86686 - DNA, 633 bp, Homo sapiens
  chr2:60796709-60797342
  hyper
taattggaaacatccggtctacgacgattttttccttttctttccctttcaaaaaattttccgacaaaatcaggcagtatttgctgccctgcctcggattatctgagacaagaggcgcccaggatgagctcatgtaatccccaggatgggaacctcaagccccttatgataaagaaaaaagaaaaagaccaggatactcattccttaccccagcccccactccaccctcgaggagttcccttagcaaacttaaaagactatcagaagcaacttgtgccatgcagtgccatggagagcgctggatggctagccagaagaaaagggaaggttgtagtggaaatctacgtgggtttgcaggttcctgcttttcttgtgtagagcctccggtgccctccacctaaccctgccccaatgcctcgggtcttttttgaactaatgctgtgcgtctccgcaatctgcaattactttggatatttctcaggagctaaacgcagcctgaatttcgtggcgcgtgcaaaaaaaaaaaaaaaggcgaaattaacaaaaccccaccaccgcgctgttgtttttttctggagtttttttttttttttttttttagttcggttcagaagcaaacgctacctagtttct

SEQ ID NO: 86687 - DNA, 30 bp, Homo sapiens; identical to SEQ ID NO: 14415
  chr2:60887794-60887824
  hypo

SEQ ID NO: 86688 - DNA, 299 bp, Homo sapiens
  chr2:60962750-60963049
  hyper
aaccccagctcttggcggtgcgccacaggaactctccggtggtcgggttgtagatgaagagcttccactcggcgaggctctggttgagggactccttcttcatcgtgtgcgcgcggacgacgaggggagcggcggccgcggggacggaggcggcgagggcagcggggacgggggcggcgagggcagcggggacggaggaggcgagggcagcggaggcgcgtcccggctccggcggcgcagcccggcgacggcaggggagggtgggacgaccgagaacacctcctcgttactgggagtac

SEQ ID NO: 86689 - DNA, 22 bp, Homo sapiens
  chr2:61135115-61135137
  hypo
cacgccccgccttatttgtact

SEQ ID NO: 86690 - DNA, 462 bp, Homo sapiens
  chr2:6121692-6122154
  hyper
agcctccccagctgccggcagcatcctgtgatccccggagagatttttcatgagggctgtatatttggagagagagaggaaaaggcagctagcccagggaggaagcaaccccacacgaatagcggctgcatcataaatatttctagatagcaaatagcccattaaaagcccacattgtaatgccttggaggggggctgcctttccctgcaataccccgggaccgtcggtaaagcaggctttgtcatcgtctgcgttttcgccgcggcgctgtcctgtctcagctcctcctgactcagctgaagggggctggtgaataatgcatcacctagggagaggcgctggggctgcggggcacagctgagcgtgtgcagagggagcccctcaggctttctctctgtctgcctccatcttaccgtatccagagaccacactaaaatggtggctgacgtggagacagagga

SEQ ID NO: 86691 - DNA, 76 bp, Homo sapiens
  chr2:61231438-61231514
  hypo
agaaataataaaagacggcaataaaataaagtaacatgtggccaagcatggtggctcacgcctgtaattccagcac

SEQ ID NO: 86692 - DNA, 15 bp, Homo sapiens
  chr2:61231814-61231829
  hypo
cgaagtgaaccataa

SEQ ID NO: 86693 - DNA, 204 bp, Homo sapiens
  chr2:61406160-61406364
  hypo
gctcctggtgggcatcgttgtggagaatgacgctggccgcggcgagatcaacgagttgaagcaggtggaaggggaggcttcgtgcagcagccgcaaaggaaagctgattttcttctatgagtggaacatcaaactgggctggaaaggtaacaggggcctcagggtactagtggggctggggacaaagtgcgttcatcattcagc

SEQ ID NO: 86694 - DNA, 80 bp, Homo sapiens
  chr2:61992300-61992380
  hypo
ggcgtgagccaccgcgcccggcccccctctggccactattattatagtttttaaagcctcttaatcgtaaatactagagt

SEQ ID NO: 86695 - DNA, 30 bp, Homo sapiens
  chr2:62116817-62116847
  hypo
cgaggttagttatctcgtattggttgatac

SEQ ID NO: 86696 - DNA, 56 bp, Homo sapiens; identical to SEQ ID NO: 39538
  chr2:62409597-62409653
  hypo

SEQ ID NO: 86697 - DNA, 82 bp, Homo sapiens
  chr2:62497735-62497817
  hypo
gtgaataggaatagcaaagtacataaacatttctaagtaggctcctgtgtgtgtgttgaaaaatatacgcatatatacgttt

SEQ ID NO: 86698 - DNA, 150 bp, Homo sapiens
  chr2:62589735-62589885
  hypo
acccatggaggccagcgctgcactcaaggagcactggctgagggccaggtgatgggaccagacccagagggctgcctgacgagggccagagggcagtgctgcagcacacctgagaggaatctttaccgggaactgcgggtggagctgggc

SEQ ID NO: 86699 - DNA, 147 bp, Homo sapiens
  chr2:62652367-62652514
  hypo
aattccagaggttgccgccttttccttgtatttcagaaattgataaacagtcatgtttattttattcatgctgctcattatttcatatatatgtttaaaaatcttagtgtatcctacacataaaatgatatgcgttatgtacgtgtt

SEQ ID NO: 86700 - DNA, 32 bp, Homo sapiens
  chr2:62732906-62732938
  hyper
ccccacgtcagctgccgcgcttgcaacaagct

SEQ ID NO: 86701 - DNA, 30 bp, Homo sapiens
  chr2:62764362-62764392
  hypo
ggattggtcagttagcgggggaaggttgtc

SEQ ID NO: 86702 - DNA, 120 bp, Homo sapiens
  chr2:62798327-62798447
  hyper
agacgccgcccgtgccgtgtcaggttgtccccgagtgcgcttgccgtgagtttctgccgcgtgactcacccgtgtccctcgctctcagccatcggaacagcagaagcgggtcggggagag

SEQ ID NO: 86703 - DNA, 15 bp, Homo sapiens
  chr2:62798511-62798526
  hyper
cggagcccagcggct

SEQ ID NO: 86704 - DNA, 183 bp, Homo sapiens
  chr2:63275326-63275509
  hyper
cgcctcaatcctctgcgctgctttcaagaaactttcatcccagtctctctccctctccactctcctccctctccccctctcctctttcttttcttaatcctggggttttatgggctgagcgttaagaaaattcgcctgcaatttgggattagataaatactctaattaggaaaaaaaaaatcc

SEQ ID NO: 86705 - DNA, 615 bp, Homo sapiens; identical to SEQ ID NO: 27241
  chr2:63275877-63276492
  hyper

SEQ ID NO: 86706 - DNA, 389 bp, Homo sapiens
  chr2:63278633-63279022
  hyper
ctcccccgcctcctccgaagtaaccaagctgaagtgctaagtttggagaaagtctttgaaaactcacgctgcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcag

SEQ ID NO: 86707 - DNA, 49 bp, Homo sapiens
  chr2:63280496-63280545
  hyper
gagctcatttacttgcggattcgctacccaggggcggctagtatttttc

SEQ ID NO: 86708 - DNA, 699 bp, Homo sapiens; identical to SEQ ID NO: 166
  chr2:63280952-63281651
  hyper

SEQ ID NO: 86709 - DNA, 217 bp, Homo sapiens
  chr2:63282650-63282867
  hyper
cgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacc

SEQ ID NO: 86710 - DNA, 30 bp, Homo sapiens
  chr2:63283512-63283542
  hyper
ttgctgctgctgcaccgcccgcctttgcct

SEQ ID NO: 86711 - DNA, 461 bp, Homo sapiens
  chr2:63283790-63284251
  hyper
ccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaacttt

SEQ ID NO: 86712 - DNA, 41 bp, Homo sapiens
  chr2:63284311-63284352
  hyper
aaagcaaaaaatattttccctctgtccgtcccccttctgct

SEQ ID NO: 86713 - DNA, 1241 bp, Homo sapiens
  chr2:63284558-63285799
  hyper
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctggaggccaaaggatgaggcgggaggacttggcaagagaagtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttcctttaaaacatacaaactcataacctggaaaagtcgacaaggacgcctttcactttggcaggggaagaagacgactggcttgcatctgggggtcaggaaggacagttccatctccctctgagggaagacggggttgaggggtaatcctcccccagaaaatgcagagcctggaactgtccagactctggc

SEQ ID NO: 86714 - DNA, 227 bp, Homo sapiens; identical to SEQ ID NO: 168
  chr2:63286358-63286585
  hyper

SEQ ID NO: 86715 - DNA, 55 bp, Homo sapiens; identical to SEQ ID NO: 169
  chr2:63286693-63286748
  hyper

SEQ ID NO: 86716 - DNA, 244 bp, Homo sapiens; identical to SEQ ID NO: 27249
  chr2:63287082-63287326
  hyper

SEQ ID NO: 86717 - DNA, 138 bp, Homo sapiens
  chr2:6402946-6403084
  hypo
gtgaaagaggagaggcgaggagaggcgggaaggggcggagcacgtgtttcggatgggcgcatagaatggagacttccgggccatgtcaggccttttgcttttactgtgagtgaagccataggacgaccctgcacagag

SEQ ID NO: 86718 - DNA, 164 bp, Homo sapiens
  chr2:64348216-64348380
  hypo
ccacttaggttacagcgaaataaatctgcgcaggtaggctgcttatatccaatgttgatacctgttcagtccaggaaacatacctgcaaaaatgatcggggcatattctagggtttgctgtttgatgatcctgccttgtcatgtgattccgggctgatgagatt

SEQ ID NO: 86719 - DNA, 30 bp, Homo sapiens
  chr2:64372072-64372102
  hypo
ttacctaagacttgtcgaaatgtagttgtt

SEQ ID NO: 86720 - DNA, 196 bp, Homo sapiens
  chr2:64455465-64455661
  hyper
gaaatcctgggctcccgagcccaagctgggcatgaatattcatcgggggcgtggccccgccagcgcgcagggctccaagcagctgcgactagcggaaagcgcgcgccagctgcacgcagggaaacagttctcattttgtgtgctcggctgactgcacgtccagcctcgggccagctcgagacggccacattgtgag

SEQ ID NO: 86721 - DNA, 72 bp, Homo sapiens
  chr2:647851-647923
  hypo
attgtcagctgctcccggcctgggtcggggtcagtcgctggcaccgaggtttctatacggatcttagacaag

SEQ ID NO: 86722 - DNA, 146 bp, Homo sapiens
  chr2:64835504-64835650
  hypo
ctgaggacagggaggcgaagtgagctgttaaaagtcaccatctaaggagctgtgctggggatagaacacgggtggctacgccgggcatggtggtgcgcacctgcagtcctggctgctggagaagctgaggcggaaggatcgcttaa

SEQ ID NO: 86723 - DNA, 226 bp, Homo sapiens
  chr2:64836207-64836433
  hyper
gtccgcctggacactcgggagtgaaggcgtgacaggcctcagccggccgtccctcctcgcgcctctgccccgggggacgcacgaggaccagaaagccgagggggcgcagggcctgctctggccgccgggcccgggatgccaggatgcggggggccggggctgccggtgctcttgggggcagggggaagctccgctccctctacagaggacaaccgccccgccgccc

SEQ ID NO: 86724 - DNA, 163 bp, Homo sapiens; identical to SEQ ID NO: 6195
  chr2:64836470-64836633
  hyper

SEQ ID NO: 86725 - DNA, 171 bp, Homo sapiens
  chr2:64836746-64836917
  hyper
cgcggcgccgcgcctgacggtcactctctctgacctcctgggcccagtcctggggccaagagccgcatccccggggaccttggtagaaaaatatgcggctcctgtagccacccaagatcttctggatgagaacccctgcaccagcagactgggtgtcgtggacctccaagc

SEQ ID NO: 86726 - DNA, 30 bp, Homo sapiens
  chr2:64854140-64854170
  hypo
tgtgaggcgctcagacgccatgaagctacc

SEQ ID NO: 86727 - DNA, 53 bp, Homo sapiens
  chr2:648647-648700
  hypo
gtggactcacagacacgggaccaagggacccacagatgcggagtcagcatgga

SEQ ID NO: 86728 - DNA, 103 bp, Homo sapiens
  chr2:65413481-65413584
  hypo
cccccacgcctggccaacaaacacttaagtgtcttctatgaacctagcaagtgcttggcactgcttctgttgagtgcacagccccaagcggaagacaaacatt

SEQ ID NO: 86729 - DNA, 45 bp, Homo sapiens
  chr2:65794624-65794669
  hypo
agagagagggagcctcggccgggcgcggtggctcacgcctgtaat

SEQ ID NO: 86730 - DNA, 30 bp, Homo sapiens; identical to SEQ ID NO: 39543
  chr2:65868490-65868520
  hypo

SEQ ID NO: 86731 - DNA, 30 bp, Homo sapiens
  chr2:6635445-6635475
  hypo
tacaatagacagaggcgagggaattcttgt

SEQ ID NO: 86732 - DNA, 30 bp, Homo sapiens; identical to SEQ ID NO: 39544
  chr2:66561514-66561544
  hypo

SEQ ID NO: 86733 - DNA, 86 bp, Homo sapiens
  chr2:66652616-66652702
  hyper
caggacagtcatttacgggatcacctaagggacattttgaaagaggatgtgtttgcctctggcctcaattgtcaccggaacgcgcg

SEQ ID NO: 86734 - DNA, 232 bp, Homo sapiens
  chr2:66653022-66653254
  hyper
tctcagtagtgtccccggctgtctcctttcctccgtctcccggtcctctcccagcgtcacccctcactacctatacccccgcgccctacccccacctggggcgctgggttccacgcctcctcaagaggtgtgagcgcccgcgctgggcgcccgtagcgcggccctcctgtgtccccacttccacccggcggccgctggaagccgggagaaggaacggcaccaatcccctcac

SEQ ID NO: 86735 - DNA, 679 bp, Homo sapiens
  chr2:66653255-66653934
  hyper
cttctcccaggacgtctgatcccattagcgcacctgaaatcacaaccttggccacaaatgcgcgcttgttgcgacccctccgagtgggccgccgtgccgcaggagccactctggggccggggtccccaacctctcccccctgcaagtcctaaaaggaatcgtagagcaattgatctcggaggagatgagcgcaccccggggctcattgctgcccctgaggaagagccgtccaggaacggaggcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggatcgcagtcaaaactggcggggatggggcacactggtgggagaggggaccttttcaccttttgctcttcccaggggacacagtcccccaaacctacgtccctgcgccaaaccaggtgcgagcaaactccgcggaccccgcagctggaagtgcatcctgccgggacccccacc

SEQ ID NO: 86736 - DNA, 351 bp, Homo sapiens
  chr2:66659963-66660314
  hyper
tctttcaaggcaaagcgcttctgaaggttttgggagaacgtgtgtcagcccttcaggcacacagggtgccagtacggagttgggggcggggaagggtgcagtgcaggcggctgggaaggctcatctgctcggctttatggaaacgctccactgttgggggcaaccaaccccgcgttgactcctgcgaagtgctaaaggaagcgatagatgtcgcctaaggagactacggacgctcggtggaacctcattccagacctatgttctcatgctcgccctgtgtctcctgctcctcggaagcccactctatagaatcttcagtcctacctcgcagacggacgcaaattatctttt

SEQ ID NO: 86737 - DNA, 126 bp, Homo sapiens
  chr2:66660578-66660704
  hyper
aagctccctgctgatcgattatttgataattgattttccccgcagccaatgcgcggcggcctgggcgggggcgcctcctgattggccgagcactcctccacggctgcctaccgagatttgggtgag

SEQ ID NO: 86738 - DNA, 72 bp, Homo sapiens
  chr2:66801890-66801962
  hyper
ctcgctcaatggttccgttaagaacattttacacgttggaaattccgtcttctcagacggcttgctgtttcc

SEQ ID NO: 86739 - DNA, 353 bp, Homo sapiens
  chr2:66802594-66802947
  hyper
ggaaaagaggaaagtcggcttcgactgccatcttttggggatttcgaaaaacgactcggtaggaaacggagggaggcggaggcgcgggagtgggggaaacccccttattatccagtgtcggaactggctcccttaatctgatgcttaaatatttgatgtggaaaaattacccataaaattagttactaacaatttcaaattgaaatcacttatcgaattataaacgcattaaagctgtatggatggtattaggagttcctcgggaggcagcgggtgtctccttgaagtgagccaggcgggcgagtttcgccccggggaaaagagcccccagccgagcccgggggcaaggccgg

SEQ ID NO: 86740 - DNA, 457 bp, Homo sapiens
  chr2:66803297-66803754
  hyper
ggttgggcccggctccgtgccccgagaggaaatccagcgggcaactgcgcagagctccagccaggacgtgctacccctgagtccctcgatgcgctgggtcccggcctaggccccagtgcgtgggcgggcaggtctttgcccagagaccacagctctggtcgcggggggtggcgggggtgggggggctgcacgggcgcctgccttaccctcctgccctcacccccatctgagtctagtctaagggactgttgactttgtctctggagatggggcgaccaggggtctgcgaaggaggttgtggagaggcacctcctgggtgcaggtccgggcgctctttcctcggaacctcacggagtgctttgtagtagcctggagacttcctaatagactttgccacatcgggggccccagactccagagtcccatagtggccctgggagcgcgacccagagagcct

SEQ ID NO: 86741 - DNA, 109 bp, Homo sapiens
  chr2:66808525-66808634
  hyper
agacaaaagggggagcgatgcaggtctgtttgttttctttccccgccgccccactgtcccttttctcgtctccccgcgcacctccccagacgccctgccggggtggctc

SEQ ID NO: 86742 - DNA, 841 bp, Homo sapiens
  chr2:66808726-66809567
  hyper
cgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtacctca

SEQ ID NO: 86743 - DNA, 39 bp, Homo sapiens; identical to SEQ ID NO: 39545
  chr2:67625453-67625492
  hypo

SEQ ID NO: 86744 - DNA, 38 bp, Homo sapiens; identical to SEQ ID NO: 39546
  chr2:67625732-67625770
  hypo

SEQ ID NO: 86745 - DNA, 30 bp, Homo sapiens
  chr2:67626227-67626257
  hypo
gaccttggggtcttacgaagtaaggtaatg

SEQ ID NO: 86746 - DNA, 30 bp, Homo sapiens; identical to SEQ ID NO: 39426
  chr2:6809103-6809133
  hypo

SEQ ID NO: 86747 - DNA, 39 bp, Homo sapiens; identical to SEQ ID NO: 39547
  chr2:68530252-68530291
  hypo

SEQ ID NO: 86748 - DNA, 39 bp, Homo sapiens; identical to SEQ ID NO: 39548
  chr2:68537171-68537210
  hypo

SEQ ID NO: 86749 - DNA, 9 bp, Homo sapiens
  chr2:68546222-68546231
  hyper
tccaacccc

SEQ ID NO: 86750 - DNA, 268 bp, Homo sapiens; identical to SEQ ID NO: 173
  chr2:68546249-68546517
  hyper

SEQ ID NO: 86751 - DNA, 589 bp, Homo sapiens
  chr2:68546552-68547141
  hyper
cggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcgggaggaggctgagggggggtaaagggaggc

SEQ ID NO: 86752 - DNA, 128 bp, Homo sapiens
  chr2:68547142-68547270
  hyper
ggaaggggggacaggaaaccgctagccggtgatttaaatttcaggaaatatgagtctttccaaagcttaggggaaatggccgaggaaaggcgcaattccacgtgatggagccacgctggatgaggaat

SEQ ID NO: 86753 - DNA, 138 bp, Homo sapiens
  chr2:68559325-68559463
  hypo
aattacaggcgtgagccgctgcacccggccaacacaacattattcttcacaagtggatatatttgtgattagtttgtgcacattcctcactgaacagcagaaatttaatcaaacacatccagtcgagttgggtcttct

SEQ ID NO: 86754 - DNA, 17 bp, Homo sapiens
  chr2:68561789-68561806
  hypo
gggcatggtggctctcg

SEQ ID NO: 86755 - DNA, 30 bp, Homo sapiens
  chr2:6859708-6859738
  hypo
tcctataagcctgcacgcagctatgagcag

SEQ ID NO: 86756 - DNA, 249 bp, Homo sapiens; identical to SEQ ID NO: 39549
  chr2:68672689-68672938
  hypo

SEQ ID NO: 86757 - DNA, 51 bp, Homo sapiens
  chr2:68674579-68674630
  hypo
cccaggagacagtcccgttctctgagctgagctggtcgcacctgatgtcac

SEQ ID NO: 86758 - DNA, 276 bp, Homo sapiens
  chr2:68675493-68675769
  hypo
ctcagaagcaccacccggttctcctggcaccagaacgcaatcctggacgcggcaaacctctggggggacctggaggtccgcggactcttggagactgtggaggtgacagaagtgaagttggcggccgcttctgtactcccagagcctcagggtgcaggccccggaggaggatggaagcagctcaggctgagtgggcaacatggagatgtagttcacaaactgtgtgcccgaggcaggaggactcaatgctgcggggcatggcggccctgctgacct

SEQ ID NO: 86759 - DNA, 732 bp, Homo sapiens
  chr2:68870336-68871068
  hyper
gaggtgtgtgagcagcgggggaggctcctcggtcctttgcaagctcgcggctgagcggggccgtgtccgtccactccgacggcgctgggctgccaaggtgagccgccgaggagccccgtgccccgaggcgggcacagccgccctgcatgggtgcccccggcgcgggattgacgcagagccctgcccggagccccagcgaccccgttcctgccccaggcggccgttccgaagcctgagccgggcaacgcgcagcccgcctggcccggctccctcccgcgcgtcctcgtcgcgagctgccgcctgggagctccagacgctcccgcccagggcgatccggacgctcccgcccagggcgatcccggcctctgcagcccagctggcgacacgcctcgccaagagcccgcacctcggcgcctcacggccaccggaggcggggacagggagtccggcgcgggccgggtcgggggatctgcagcggcggcgcgaaggtaactcccccgccagagccgggaaagagccccgagcagaggaggaagggagcggggacctgcccttcgcctgccggcttctggaagaagcgtctcctgatccggccccggaataagaaacccggaccttgcctgccgggctccgcgatgccgcaggtacagagcgcgccctcccggggaggatgctccagggaccccgcgctgcactggctgcggccgtggggtgcggcggcttctgagtgaa

SEQ ID NO: 86760 - DNA, 87 bp, Homo sapiens
  chr2:68882389-68882476
  hypo
catcctcaccgcctacgtgctatgctgggcgcccttctacggcttcaccatcgtgcgcgacttcttccccaccgtgtttgtgaagga

SEQ ID NO: 86761 - DNA, 30 bp, Homo sapiens
  chr2:68979044-68979074
  hyper
gtggccactagatggcggcaaactcagcca

SEQ ID NO: 86762 - DNA, 30 bp, Homo sapiens
  chr2:69171628-69171658
  hypo
ctcaaacgcggaggccgggggtcctctgca

SEQ ID NO: 86763 - DNA, 139 bp, Homo sapiens; identical to SEQ ID NO: 39551
  chr2:69182056-69182195
  hypo

SEQ ID NO: 86764 - DNA, 652 bp, Homo sapiens
  chr2:69240068-69240720
  hyper
acaaggaaatttatacgcgaagcctggaagcgcccccgcccccgacgcactcccgcgggtcccacgcgtgctttcgccgcctttgtccacaaggtggcagcctttgaactttcttccccgtaagaacgcgaaaggggggcagagaggaaggagagaaggcaaagcactgcccccaccaagaacaatttgaaacccccccccccccccatcatatttaaaatctgggacaaagaaccgtcgggacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaaggggg

SEQ ID NO: 86765 - DNA, 40 bp, Homo sapiens; identical to SEQ ID NO: 27267
  chr2:69241225-69241265
  hyper

SEQ ID NO: 86766 - DNA, 35 bp, Homo sapiens
  chr2:6936496-6936531
  hypo
taggaagtggcttcacgcttcggtcactgcatgta

SEQ ID NO: 86767 - DNA, 469 bp, Homo sapiens
  chr2:69533515-69533984
  hyper
ttctctcctcaatgtcggctgcgtggggatttaaactcatttaaactggtgggcctgggaccggctgtatccatcaaaaaccaggaaggggagccggcgcggggcgtgcacagctgtaggagggctctctgtgtgcgaatccaggccctgagttcgcacgcccacctggggcggtggtccagccgccaggaacccgcttcccagccgctccccctcacgcaggaagccgggactctgggcgcagctctcccggaccacggccacgtcctggctccagctacggaggcagaaagaagccacagaaacctaaaggacaggaggggaaactgagctttccgcgtgggtgcggctgcccttgacacccgcttgggggctccggagggggaggcagggcggccccgcgctgagggtggaagcgtgaacatccgagcagagagagcggggaggggccgtccggagagatgccccg

SEQ ID NO: 86768 - DNA, 125 bp, Homo sapiens
  chr2:69534538-69534663
  hyper
tgtttgcaggcatggcgcgccccgcagagcgagaaatgtaaggaagggcacagggccgagacgcgtggccgccccttaactgcgcttcctctcgactctcgggggcttcgcggcgtctgtgctca

SEQ ID NO: 86769 - DNA, 141 bp, Homo sapiens; identical to SEQ ID NO: 39552
  chr2:69720070-69720211
  hypo

SEQ ID NO: 86770 - DNA, 86 bp, Homo sapiens
  chr2:6989494-6989580
  hypo
ctgagggagatgcagcgagcccatcatgacgagtgcaaccagatgtggaagaagccaatgtgggcatgtcacgatctcatcagcat

SEQ ID NO: 86771 - DNA, 95 bp, Homo sapiens; identical to SEQ ID NO: 39553
  chr2:69914132-69914227
  hypo

SEQ ID NO: 86772 - DNA, 37 bp, Homo sapiens
  chr2:69990379-69990416
  hypo
ggaacttgatgacttcggggcgcgggaggccccagaa

SEQ ID NO: 86773 - DNA, 36 bp, Homo sapiens
  chr2:7005433-7005469
  hyper
ggaagccttgctgtgcgccgccggcctggccgcccg

SEQ ID NO: 86774 - DNA, 29 bp, Homo sapiens
  chr2:70055440-70055469
  hypo
tcagacattagtccacggggaccctcaaa

SEQ ID NO: 86775 - DNA, 20 bp, Homo sapiens
  chr2:70140798-70140818
  hypo
attcttggccgggtgcggtg

SEQ ID NO: 86776 - DNA, 38 bp, Homo sapiens
  chr2:70203999-70204037
  hypo
cacacactcatacaccgaggagacacaaactgggcaaa

SEQ ID NO: 86777 - DNA, 152 bp, Homo sapiens
  chr2:7024377-7024529
  hypo
ccatctgtgatggtgcggacatggactgtgggggagggacgctgtggatgtgggttggagggtccatctgataagggttaagcaggtagagaagagtcaaggtgtcagatgcaggtgaattaggaagggcctacaagcgtgtaaaaccaaaa

SEQ ID NO: 86778 - DNA, 127 bp, Homo sapiens
  chr2:70313348-70313475
  hyper
ccgaccccaatttctcgttggcgacgaatgctaaccacgtgtcgccattttgtgttcaggaaacatggcggccgccccaagggtaaggaacaggggaggcggagtagcgccacgttagccgctttcc

SEQ ID NO: 86779 - DNA, 67 bp, Homo sapiens
  chr2:70351496-70351563
  hyper
ccaagtagagaaaaccgggaacggttccggctctggggactgacattcatcgcggcagtttctggtg

SEQ ID NO: 86780 - DNA, 184 bp, Homo sapiens
  chr2:7035292-7035476
  hypo
aaaacaaagagccttcgcaggtcatggaagactcttcttgatctggcacctgccatggaagactcctcttgatctggcacctgcctgcctcagcagcacctttcttttcatcctctctccgtttctcaaaacaagcctttattaatatttacatatatgcatgcatgcacggatgcatgcacat

SEQ ID NO: 86781 - DNA, 64 bp, Homo sapiens
  chr2:7036178-7036242
  hypo
tgattttctgctgcacgtggcatctgattacctgtggtcactgaacacacgaataacttggata

SEQ ID NO: 86782 - DNA, 48 bp, Homo sapiens; identical to SEQ ID NO: 14421
  chr2:70364215-70364263
  hypo

SEQ ID NO: 86783 - DNA, 94 bp, Homo sapiens
  chr2:70367805-70367899
  hypo
gattacaggcatgagacaccgtgcccagcgacaagataattttaaaaggagagggaacgtctgcttttgttgcctttctcgtcttttgtggttc

SEQ ID NO: 86784 - DNA, 25 bp, Homo sapiens
  chr2:70418457-70418482
  hypo
acttgagttgctggacgtggtggct

SEQ ID NO: 86785 - DNA, 25 bp, Homo sapiens
  chr2:70418602-70418627
  hypo
aaaaatcgcccgagattttctacat

SEQ ID NO: 86786 - DNA, 28 bp, Homo sapiens
  chr2:70430867-70430895
  hypo
ccgatgggttacctccgcttgtcaatac

SEQ ID NO: 86787 - DNA, 23 bp, Homo sapiens
  chr2:70466510-70466533
  hypo
actgcgcccggccaataaagggt

SEQ ID NO: 86788 - DNA, 25 bp, Homo sapiens
  chr2:70477736-70477761
  hypo
gtgatgtcggctgagcggggcggct

SEQ ID NO: 86789 - DNA, 187 bp, Homo sapiens
  chr2:7057229-7057416
  hyper
agctgcacagctcaacgccggttcgcgccctggtttacagcgttgggctgggtcaccccttctttcctagcttgctgctgtgtgttccctcggtgtaggaatcaggggagtgtcttctggaggccactaaagcaggaatagcattttcatgttagcgtgcacgggcggtctccgcagcccctcctcg

SEQ ID NO: 86790 - DNA, 325 bp, Homo sapiens
  chr2:7058053-7058378
  hyper
cgcttagggacctggcgtccccctgcctgccctgcgcggtcgcgggtctgcgctgcggcgcgggacagggcgccccgggccagggtcccgcgggcgagctggcggcgggggctttcaaggttcgcggccccgcccgcagaccctggggctggagcctcggccccaagaggaggtctgggaaaggacgacgcgtccggggcatcgccaccggcggggaaggtcggaactggccaagaggatgccccgcacatcccctgcgcgcggggtccgcggctgctactgcccctggtccccaccgcgagccctttcccggggaatgagccgc

SEQ ID NO: 86791 - DNA, 30 bp, Homo sapiens; identical to SEQ ID NO: 39557
  chr2:71270959-71270989
  hypo

SEQ ID NO: 86792 - DNA, 30 bp, Homo sapiens
  chr2:71272757-71272787
  hypo
atatcaagggggggtcgagggaacacaccc

SEQ ID NO: 86793 - DNA, 79 bp, Homo sapiens
  chr2:71355038-71355117
  hypo
agtcaccgcgcctggccgaacataagtctgaattttcactgaatatctggtttgaggaaacatacgtatttagaaagtc

SEQ ID NO: 86794 - DNA, 439 bp, Homo sapiens
  chr2:71453947-71454386
  hyper
ccttcacagccccgacggcggcagaaagggaggcgcagggcgcccccagagccgggagaacggcgtttccctcgagtcctttccccagcagcccgggcacccgagcccacctgggctaaccagaagcccctccttcagatcgtactctgccactcctccgagagcttaagccgttgccgtagaggtcgccgtcgccacaacagtctcggcctttagtaccaaaacgtgaagcacagcacccgagaagcgccactaccacttgccaggttatctcttactgcacactgcctcctcgccccgcccccgaacccaagccattggttgccgggcaccgccccattcgtctattgggccaaagaagatgccgttcggtcacctagaatggcatatgtggtttttattggtctaaatgtgaagcagtgcccgcccactccctcag

SEQ ID NO: 86795 - DNA, 85 bp, Homo sapiens
  chr2:71455203-71455288
  hypo
aatacaaattaaaataaaactttattgcctcccttggatttagaatgtccaatctgcttgcaaaggacttcgaattgtattccac

SEQ ID NO: 86796 - DNA, 41 bp, Homo sapiens
  chr2:71502899-71502940
  hypo
tagttgtcctctggccgaaatctcctcgtgccccacaccct

SEQ ID NO: 86797 - DNA, 918 bp, Homo sapiens
  chr2:71503413-71504331
  hyper
tctgtaaacagcaggcgaagaaattattagtcttaaaaaggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagcggcagaacgcctggccgggccggcgttttccgggacactcgtttcggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtcggtgaaatcgcttggaccagctc

SEQ ID NO: 86798 - DNA, 88 bp, Homo sapiens
  chr2:71504730-71504818
  hyper
gaatggtgtaaataacgccccccggcgcccatccacttagcggaaggaaagtcagccactaggctgcgggctccgggctgtccccagc

SEQ ID NO: 86799 - DNA, 51 bp, Homo sapiens
  chr2:71622692-71622743
  hypo
ttgatcatcctattgcgcgcaggactgctcccaaggcggtgggggtgacaa

SEQ ID NO: 86800 - DNA, 152 bp, Homo sapiens
  chr2:7164448-7164600
  hypo
gtctcccgtgggatccgtttgtgcagagtcctcacggcgtttctcccacagtgctgctttcaaaatggaagaagatgacgcgcccatcaagcgctgccccaagtgcaaagtctacatcgagcgagacgaaggctgcgcgcagatgatgtgca

SEQ ID NO: 86801 - DNA, 558 bp, Homo sapiens; identical to SEQ ID NO: 27271
  chr2:71680684-71681242
  hyper

SEQ ID NO: 86802 - DNA, 404 bp, Homo sapiens
  chr2:71693520-71693924
  hyper
ggtgcgcaccgggcccgggatccctggctggtgtggagccttggtcaccggaggcccccgcggagcaggccccacggcgccttgtgcgctctcggaggccgagctgcgcgcccgcgtcagcggcgcctcgttcctggccgggagctgggacccgcggagctagggaccagcacccccacaggcgcccgtctgacccctgtccctccccgcccgccgcgggcagggcggatctgggtaggggccggagggggagggtccgcccagcgggtgtccggtgtcctccctgcagcctctcccaggcattggtcacttctccgcggaggagcagcgaaggcgacagctctcttggcgcggctgcctgggagccgggcgcttgctgggtgggtgctcgggcccggtgctcc

SEQ ID NO: 86803 - DNA, 171 bp, Homo sapiens; identical to SEQ ID NO: 27274
  chr2:71694277-71694448
  hyper

SEQ ID NO: 86804 - DNA, 387 bp, Homo sapiens; identical to SEQ ID NO: 39430
  chr2:7172412-7172799
  hypo

SEQ ID NO: 86805 - DNA, 35 bp, Homo sapiens
  chr2:7185292-7185327
  hypo
gtttggtccaactggcgtgtcggggttggagagtt

SEQ ID NO: 86806 - DNA, 42 bp, Homo sapiens
  chr2:7190110-7190152
  hypo
ctcggctttttcagtcgaaaatgcattcgataccaagtttca

SEQ ID NO: 86807 - DNA, 34 bp, Homo sapiens
  chr2:72017134-72017168
  hypo
agcaacacaagatggcgttcgctcaagcatgcga

SEQ ID NO: 86808 - DNA, 61 bp, Homo sapiens; identical to SEQ ID NO: 14369
  chr2:720836-720897
  hypo

SEQ ID NO: 86809 - DNA, 170 bp, Homo sapiens
  chr2:72125970-72126140
  hypo
ggctcagccattacccgaggggctggtgtcagactggattctctggccccatgtcccatgattctgagtgggtagatctcgagtaggacctgcaccctcacccaaggtcacatctcttgtcttcgagccctgtgttcagctgcacggtaagggaacggagggaagagatg

SEQ ID NO: 86810 - DNA, 207 bp, Homo sapiens
  chr2:72372030-72372237
  hyper
gatccccggtggtggcggcgcaagccgaggatggcggggccggggccggccggactctcgaaacggctggcggagccggccgggcgcgggtaccggaaaccgtggagacctcagaggggcgggggcaagggcgtcccgctcacctttgacgtcggcactagttaccccaccccacgttaacccttctcctgccggggcagcacccgg

SEQ ID NO: 86811 - DNA, 16 bp, Homo sapiens
  chr2:7237247-7237263
  hypo
ccgcccctcatggtgg

SEQ ID NO: 86812 - DNA, 167 bp, Homo sapiens; identical to SEQ ID NO: 27276
  chr2:72372591-72372758
  hyper

SEQ ID NO: 86813 - DNA, 315 bp, Homo sapiens
  chr2:72373470-72373785
  hyper
ctggggatttctttgcggggggtgggggggtgatacatccattggttgaaaggacccccacctcattgcacgaacaaccccaaaaagagatgggcctaatccgggacgtggaaagaccacagggcagaggaacttcgaaccccctccccgcccccgctccgctgtcactcgtcccggggcagggtgagtgcgtgtgtgcgcgagcgcgcggattgcacgcgtctgttaatttcaagccaagctttcgcacctgtaaacccacaggtcgcagcgctcacctttcgcttcacctctctagtgcggggattgtcagtt

SEQ ID NO: 86814 - DNA, 151 bp, Homo sapiens
  chr2:72374375-72374526
  hyper
gggggcttgcagcaccgaggggaggcgaaagcggctcaggaccggaccctcccccgggaccgcgcctcgctaggcgcccccggggcgctccacgccccctgccaggccagccgcgacccaggcaagtccatcttgggagccccctcaggtc

SEQ ID NO: 86815 - DNA, 127 bp, Homo sapiens; identical to SEQ ID NO: 6212
  chr2:72374563-72374690
  hyper

SEQ ID NO: 86816 - DNA, 219 bp, Homo sapiens
  chr2:72374713-72374932
  hyper
cgcagctagcggaccccggagtgcagcggagcgagcgcgcccttacctgcagcagccagtggccggtctctccgatgagcgggaagcccatggatcccttggggatgggcagcttgcagctcttgtcgcgagtggcggcccagcgcagctgccacagctgctgcgacacggccagcagcagcgtcacggacaccaggcacgcggcgagggtggccagcg

SEQ ID NO: 86817 - DNA, 232 bp, Homo sapiens
  chr2:72375350-72375582
  hyper
agggagcctctctctcgtaagccccttcccctgctcggaaaaaaagaagggggcagagagctagcagagagaaagtgcggtcgatttgtcaaaagtattgcagtatggccccaaaattcctaggtgaaaaaaagaaaaaaagaaaaaattcctgaatccaaaaattccaacgaacccagaaactttgggggcgagggagaaagctccctggctgaggcgagtggagaggccg

SEQ ID NO: 86818 - DNA, 270 bp, Homo sapiens
  chr2:72375898-72376168
  hyper
cgggacgcggtctctcggctctggagttgctgctgggggaagaaatggggaaaaaagaaaggaaggcaaaaggaatgaaagagggggaaaagcaggaggcaggatttcagggctggtggttttaaaagcttctctcaatgtgaatttgagtccaaagcgaggcgatgcgtgtgtttatatagaggcgggaggctgcgccgtgggcgccccgccagcacccccccgccccaacccgcgcgctcacaaagccggaggcgtggtgagaggccg

SEQ ID NO: 86819 - DNA, 30 bp, Homo sapiens
  chr2:72376558-72376588
  hyper
agcggaggtcctggccggactgccccctcg

SEQ ID NO: 86820 - DNA, 358 bp, Homo sapiens
  chr2:72377029-72377387
  hyper
catgctgggtgagcacggccaccttctcagcgctggcagcagagggcccggcgcgcgtgcctgtgtacggtgtgcgtgtggcccggggccgcacctgtgtgttcgcgcgcgtggccttgcgtcggcccgacgtctgaggagcgacgtggtatgtctgtgggtttgtgtattctttgtagagccatgagtgtgtctgcgcatccgtgcatctgtcatctggcctctcctcctgcgagcctgtgttaacatggagctgcgtacagcaaccccgacattggtctagctaatgtctgcccctctctctcccgtgcatcctgcttccctcagccccccttggctctggcgttcactctcacac

SEQ ID NO: 86821 - DNA, 102 bp, Homo sapiens
  chr2:72778893-72778995
  hypo
ggattacaggcgtgagccaccgcgcccggccattaaaatcttaatagcttataaaaactagcatacacacagtgatgagatacaatgcggtcatactataat

SEQ ID NO: 86822 - DNA, 159 bp, Homo sapiens
  chr2:73121674-73121833
  hypo
tcagggtcacccgcccgggatgtactccatcctagcatctccccgtgcctcaccccagagagctaagccctggaatgctgcctcctggcctccttcaccttcgtcctttcccatagaacatggcctcataggctagcatgcatgcgataattctgactc

SEQ ID NO: 86823 - DNA, 88 bp, Homo sapiens
  chr2:73142014-73142102
  hyper
gagggaggacgaaaacggaactcctatcacccagcgcattccagcaccccctccccctcccccgggaagtctgcgactgcatcctcac

SEQ ID NO: 86824 - DNA, 62 bp, Homo sapiens
  chr2:73142786-73142848
  hyper
tccttccatatggaacgaaaatctccttctgtacctctgcccagctccgcacccccgccccc

SEQ ID NO: 86825 - DNA, 1008 bp, Homo sapiens
  chr2:73143487-73144495
  hyper
gcagcggcgaggaagcggaactctctgcggctccctctccgcagtgcgccggcaaggtccaggtcccagcctccccaccgccgcccgcgccctcctaggcctcggagcggcgcctttctgcggcctcgaaggtggggtgggaaagtttggggagtcccggctctcacagcctgtcgtgagaactgcccccggggaattcgtccgccgtacggaaaaactggccggagcagagtcgtccgcggttccgcggtcgcgggtggaaggtgaaggtcgagggaggtcaggctgcttctgcgtgtcctgacggctggcgtgttctcttgagatgggctcgggctacttggccagcttcaatttaagccacagtgtctccgaggccctgacctggtccggcccgccgacacttgagcccccagagcctcagagaaggcgagggggtggatctcccagtgccgaggcccgccgtcctggtccaagccggtcgcggcaccgtgtctgggcactggagctgcttccagccccgcgaacagctggagggtggcagtgggaccgctccggcggcttctcccgcgcagtgccccgcctggccccttgtgaagggagtgagcgtcccctttccagagctgtcccccgtgacatccagaaaacgcgaaacctcaggaacaaggtcgcagcttcagaccgcggcccaggaggccgatggtgggtgagtgggagagtcccggagagcaggggggcagagagctggttttcgggaaaaccaatgtgttggaccccaaacatccaccctccgctcggatccaagttctctgagaactgaaacgacatcccgggacgaatgggagagttaggctgagctacacaccggggaggggagggttggagtttagccccaagcccttcggacgccttcttcggctcccgcgtgggttgagacggcggcacggccaccagactcagctaaagggcggagtcgcgaggagaagccagtggcgaggggaggaggag

SEQ ID NO: 86826 - DNA, 1554 bp, Homo sapiens
  chr2:73144718-73146272
  hyper
gtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcccaggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagccttcgctggcgcgtccgggcgggggaaagtccattcgcgtgccccagctctgggggaagcaagggcagcagggagggcgaatcggagagttaatgttcagtgtggagggcctggctgtcttgggatgtttctcggcaaccttggcccgacttctccaagtcacacgtgcctctcctacccaaggtggggaaggtttgcagtaagcaaactggcttccgccgttgctcgccgccttcgggagggagcccacccggctgctggaataccgaggacagttttcccgggcagggggcgggggcagagggcttttaaggtcgtagccagtccgaaccccggagtttgcatcca

SEQ ID NO: 86827 - DNA, 379 bp, Homo sapiens
  chr2:73147149-73147528
  hyper
ggagggataggggctcggaggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacc

SEQ ID NO: 86828 - DNA, 101 bp, Homo sapiens; identical to SEQ ID NO: 176
  chr2:73147966-73148067
  hyper

SEQ ID NO: 86829 - DNA, 43 bp, Homo sapiens; identical to SEQ ID NO: 27289
  chr2:73148174-73148217
  hyper

SEQ ID NO: 86830 - DNA, 47 bp, Homo sapiens; identical to SEQ ID NO: 27290
  chr2:73150907-73150954
  hyper

SEQ ID NO: 86831 - DNA, 664 bp, Homo sapiens
  chr2:73151185-73151849
  hyper
agagctgttattccccgcgttcccccgcggagtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtcaagcgctaaagacctagc

SEQ ID NO: 86832 - DNA, 53 bp, Homo sapiens; identical to SEQ ID NO: 6222
  chr2:73152398-73152451
  hyper

SEQ ID NO: 86833 - DNA, 23 bp, Homo sapiens
  chr2:73152656-73152679
  hyper
agagttgcgagaggccggctccg

SEQ ID NO: 86834 - DNA, 261 bp, Homo sapiens
  chr2:73152739-73153000
  hyper
cgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcaggacccg

SEQ ID NO: 86835 - DNA, 89 bp, Homo sapiens
  chr2:73339571-73339660
  hyper
tggtgagcaccagctcgcaggcggcggcggagctcgcggcccagggcgccgggcccgcgtcggcctcctgcgcccgcagcaggccatcc

SEQ ID NO: 86836 - DNA, 631 bp, Homo sapiens
  chr2:73429292-73429923
  hyper
ctaggtgaatctggccgaggcttctgcgtcaaggacggcgcgggtcagctgaggccaagaccgcaggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccgga

SEQ ID NO: 86837 - DNA, 215 bp, Homo sapiens
  chr2:73429976-73430191
  hyper
cgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccgg

SEQ ID NO: 86838 - DNA, 172 bp, Homo sapiens
  chr2:73430201-73430373
  hyper
cgggggactgggcgggggctggagagcctaggtcgccactgccggcgccccagtgcaggagagggcactgagtgtgagaatcacacacggctggagtgggaaggggctctgccaccgtttaccttgcagttgaagccgaggaccgcgacagtcttgctgaaaaagaccccgg

SEQ ID NO: 86839 - DNA, 376 bp, Homo sapiens
  chr2:73430442-73430818
  hyper
cggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgctcttaagtagtgcttaagggccaggcacttaaatctcatgagaaagtaattgtaaggttgggc

SEQ ID NO: 86840 - DNA, 23 bp, Homo sapiens
  chr2:73440127-73440150
  hypo
caggtgatcctcccacgcatcac

SEQ ID NO: 86841 - DNA, 23 bp, Homo sapiens
  chr2:73440270-73440293
  hypo
cgacaaagcgagaccctgtctca

SEQ ID NO: 86842 - DNA, 30 bp, Homo sapiens
  chr2:73493641-73493671
  hypo
caggctggcgctgggcgtgctgccacagct

SEQ ID NO: 86843 - DNA, 139 bp, Homo sapiens
  chr2:73512023-73512162
  hyper
gcagcgcgcctgggtcgtgcactcggcgacctcgggtcagatgcttggtctccgcggagaccgcctgggatgatcccctctgggcattcctagggaacccgcggaactgctgctggaccccatccggagacccaattct

SEQ ID NO: 86844 - DNA, 1662 bp, Homo sapiens
  chr2:73518205-73519867
  hyper
tgctgtacaaagtcccgcgcgagaccgccttggcgctgccccagcctgtctctgggggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcactgcctgaatgaagaagctaccgctgtagctgaggccgggagggggtgtgggcgcaggcccctccaggaagcaggagtcggctaagtccccac

SEQ ID NO: 86845 - DNA, 861 bp, Homo sapiens
  chr2:73520242-73521103
  hyper
ttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcagtggacttgacgaggagcgcgtcgggttcggaaaactcgctaaggtggagcatggcgcggcgccggctgtggggcgcccggggcctcgcccgctgggcttgggggcgcgcgggtggcggggaggctggcggtaggggttccccgcagcgcacagacctaggcgcccgggctcctggcttcgggcactcacctctgggaaaggagtcggggagccgcggcgccctcgctcgcccgcaccggcctcgggcggcggctcctcgcctctccaaagcgctgccgggctcccccagcccacagcccccccacttatatagctgcggcggcgctggctccgggcttccgactccccgggccactgccattttgggaggccccggccctgccgccgtgacgtaaatgcccaaacatggacacaggatgtgtgccggggactcccgaaaaggaaagctcgagctgtgacgttgttgttgtcgccgccgccgccaggctcgcgccgctgcgtgcgcgcgcgctccccaggcgtggagcgctggggccgcggatgcgccagtctggggcgctgcgcctcaccgggccgaccgtccggtagatgcgcttcccacctggaggcagaggccgaggggcagcaggggaggaccgtgttgggtttgaatctgccctctgccactaactagcttgacactcagtcccccttaacgtcagtttctcacc

SEQ ID NO: 86846 - DNA, 30 bp, Homo sapiens; identical to SEQ ID NO: 39565
  chr2:73723848-73723878
  hypo

SEQ ID NO: 86847 - DNA, 93 bp, Homo sapiens; identical to SEQ ID NO: 39566
  chr2:74010528-74010621
  hypo

SEQ ID NO: 86848 - DNA, 38 bp, Homo sapiens
  chr2:740885-740923
  hyper
ccttagagcccggcgagcgggcgcggccctgcctacac

SEQ ID NO: 86849 - DNA, 30 bp, Homo sapiens
  chr2:74152651-74152681
  hypo
gcagcaagatcctggcgaggcagagagcct

SEQ ID NO: 86850 - DNA, 707 bp, Homo sapiens
  chr2:74229462-74230169
  hyper
ggggttagagagtggcgaagcgggaatccccccccacccccccggcgtctgctccgctccgctccacccggaggcgcagtctgtcatctttgatcctggaggcgcagaggacgccttctgggtattaccttcggggtccccgcgggaggaggccgggggtgccctgggatgccccagcctgccggggagcggcacggcgggcctgggaagcagccagcgcggctcagcagcaccctcggctgcgcccccgcctcccggctgggcaggtccaccaggcgggggcagggccggccgcggggattggctggcgagcgcgccgccccctcgcacaccagccccgcggcggggaggggagcgcagccggcagctggccgccgcctcctctgcagtgcctccctccgtgcgctccctccggcggggataatgggaggcccgccggccgatgcaccagaggaggccggccgaggtagagcgcgcggggccggggatggccgggcggacgcgggccgggggtcgccgtcctctcggatctcggggggattctcagaggagaaatgaaaacaaaaacacactggaaggcgggggagcctgtctgccgtgatccaggcggcagctggaggcaggaagatggtcccagatagcctttctttcccaggctgtatcccctcccgttcgccttcttcccctccggccgggctgggggctgt

SEQ ID NO: 86851 - DNA, 22 bp, Homo sapiens
  chr2:74315939-74315961
  hypo
gctcatgcctgtggtcgcagca

SEQ ID NO: 86852 - DNA, 31 bp, Homo sapiens
  chr2:74350360-74350391
  hypo
tcgcttgaattcaggcggcaaagatggcagt

SEQ ID NO: 86853 - DNA, 17 bp, Homo sapiens
  chr2:74425137-74425154
  hypo
atatggtctcactctcg

SEQ ID NO: 86854 - DNA, 71 bp, Homo sapiens
  chr2:74425719-74425790
  hyper
cgtggcccgcgcgcgcgcttccctcccggcgcagtcaccggcgcggtctatggctgcgacttctctaatgt

SEQ ID NO: 86855 - DNA, 317 bp, Homo sapiens; identical to SEQ ID NO: 39568
  chr2:74454002-74454319
  hypo

SEQ ID NO: 86856 - DNA, 96 bp, Homo sapiens
  chr2:74454965-74455061
  hypo
tgtagaggaagactccgtacagcaccggcagggggatacactaaaatgagagcagagctttggatcggcctctgcctggggcggcccttggccacc

SEQ ID NO: 86857 - DNA, 22 bp, Homo sapiens
  chr2:74669781-74669803
  hypo
cataaagagcagctgcgcgcgg

SEQ ID NO: 86858 - DNA, 22 bp, Homo sapiens
  chr2:74691369-74691391
  hypo
gccaccgcgcccagcctctttt

SEQ ID NO: 86859 - DNA, 92 bp, Homo sapiens; identical to SEQ ID NO: 39570
  chr2:74700397-74700489
  hypo

SEQ ID NO: 86860 - DNA, 44 bp, Homo sapiens; identical to SEQ ID NO: 6233
  chr2:74726199-74726243
  hyper

SEQ ID NO: 86861 - DNA, 56 bp, Homo sapiens
  chr2:74726718-74726774
  hyper
ctgggccccagtgctcggctcccaatccgggcccccagcctcggacccgcccccgg

SEQ ID NO: 86862 - DNA, 33 bp, Homo sapiens
  chr2:74729900-74729933
  hyper
agcggtgggaaactccgacgccctcctcgacac

SEQ ID NO: 86863 - DNA, 473 bp, Homo sapiens
  chr2:74730171-74730644
  hyper
acggccgagtgcgtccgggggtgcagacggcgccctggggtggtcctgccgccacctctcctttgactcaggagcgccgcgccgcgtccgggcgcgttctcagtcgcgcgaagccagagaggaccctgggcgtgattctccctccctggcacagacggagacccgagtgaccccggggtccgggtgggcgtggggaatggacccatagacccgggacgagcggcgcggagcccgcagctggccagcttcagccaccttgggagacgcagtgcagctgccgctgctgacagacaagaccaaggctcggctgggccccaccccagatccggcctgagcgccttccgcgctgctcggcctcaaggcgtgagtcaccaagggcaagtcccgtgacttggtcctcagggtctccggcctcggcacattaatcttcagacccggctttttcgacgccgagctgccgcccagccccaatg

SEQ ID NO: 86864 - DNA, 66 bp, Homo sapiens
  chr2:74733315-74733381
  hypo
gtgggctgggtgacccggtccaaacctcgggactggtagaattcccgaatccgtttctcttcacct

SEQ ID NO: 86865 - DNA, 621 bp, Homo sapiens
  chr2:74740515-74741136
  hyper
taaggctcaggggcccgcccgcgggggtcccatccccgggaaggacgcagagttcacgcactcccggctcctggattcatggccagaggtcacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccgggggtaagtgccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgcc

SEQ ID NO: 86866 - DNA, 708 bp, Homo sapiens; identical to SEQ ID NO: 27308
  chr2:74741137-74741845
  hyper

SEQ ID NO: 86867 - DNA, 279 bp, Homo sapiens; identical to SEQ ID NO: 27309
  chr2:74741872-74742151
  hyper

SEQ ID NO: 86868 - DNA, 324 bp, Homo sapiens; identical to SEQ ID NO: 180
  chr2:74742324-74742648
  hyper

SEQ ID NO: 86869 - DNA, 452 bp, Homo sapiens; identical to SEQ ID NO: 181
  chr2:74742693-74743145
  hyper

SEQ ID NO: 86870 - DNA, 15 bp, Homo sapiens
  chr2:74743766-74743781
  hyper
cgaagcaatagaggg

SEQ ID NO: 86871 - DNA, 30 bp, Homo sapiens
  chr2:747532-747562
  hypo
gcacccattaatcatcgagataaaacgttt

SEQ ID NO: 86872 - DNA, 30 bp, Homo sapiens
  chr2:74764874-74764904
  hypo
gcttggaaatgctgccgagatgtttgagag

SEQ ID NO: 86873 - DNA, 153 bp, Homo sapiens
  chr2:74781935-74782088
  hyper
accaaggtagtctggcgcatggatgccgaaccttatccgggctagtagtgggtgagagagcccagaaacagggagaggtgggcagcgggctggagagcggcgccgggagttggagagcctgtgactttcccgtgaagttgctttgcacactcc

SEQ ID NO: 86874 - DNA, 131 bp, Homo sapiens
  chr2:74782218-74782349
  hyper
cgtcgggacccgggccgcctgcgcacgccactccctctcgagcactctctctctctccctagaggtggaggaagacctgggccgtgctctacccggccagtccccacggcgtagcgcggctcgagttcttt

SEQ ID NO: 86875 - DNA, 24 bp, Homo sapiens
  chr2:74874703-74874727
  hypo
tgggttcactttaaacgaaatgaa

SEQ ID NO: 86876 - DNA, 32 bp, Homo sapiens
  chr2:74875128-74875160
  hyper
cgggcctgggggccccgcggaggaagctccgg

SEQ ID NO: 86877 - DNA, 41 bp, Homo sapiens
  chr2:74875477-74875518
  hyper
ggcgcggctgggcgggaggctcactgcgggcaaggcggggc

SEQ ID NO: 86878 - DNA, 127 bp, Homo sapiens
  chr2:7488706-7488833
  hypo
tgtcacgcaggtttccgtggcaatacggcagcactggttgcagggtgagggcgaggtttgctgttcctgctgatgctgaagctggggagcaagagcagggggtttcggtctgcgttcccacagttgc

SEQ ID NO: 86879 - DNA, 30 bp, Homo sapiens
  chr2:75031726-75031756
  hypo
ctcaggaaggcaatccgtgggagagaatgt

SEQ ID NO: 86880 - DNA, 30 bp, Homo sapiens
  chr2:75090539-75090569
  hypo
gtgcctttaatgacacggagtattgaatac

SEQ ID NO: 86881 - DNA, 104 bp, Homo sapiens
  chr2:75146952-75147056
  hyper
attacaggcttgaaccatcgctccaggcctcgataaatgtttaatgaataaaacgatgaaaggacccgtcgcctcctaaatgcagatctcgagggagcctccag

SEQ ID NO: 86882 - DNA, 54 bp, Homo sapiens
  chr2:75179952-75180006
  hypo
aatgctggaactggccggttgctcctctctggcgggagccggctctgtgcaggg

SEQ ID NO: 86883 - DNA, 140 bp, Homo sapiens
  chr2:75426430-75426570
  hyper
tatttctccttcctccgcagggaaaggcaaagccctgtgctgcgtgaggacttaggagcgaagtgggggcccattgcagcgcgacctgtaaaagttctgagcctatggccaggattctggagcttcgtatccagctggag

SEQ ID NO: 86884 - DNA, 91 bp, Homo sapiens
  chr2:75426784-75426875
  hyper
ccgccgcagctaccacgccttttgctgcttgctacttgccgtgggagtctgcgagccgggagccccacgcactccgcgagggggcagtagg

SEQ ID NO: 86885 - DNA, 892 bp, Homo sapiens
  chr2:75427383-75428275
  hyper
gcgaatcttggtgagcgcaggagccacactcataggcagcttgtcgctcagacgcgcggctctgggctctccgccagcaatcactgcggcgctgcgtttgcctcccggggacctggcagcctccgcctccgcgcctgccaagcctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaaggctgggaaatttactatacacttatgccgggcaaaaattggatcccacgccggggaggagaatctgctgtttcactctgtattttttcggagcctgggattttagcgtatataggaaccgcacattgctttgccaggttctcctaggcacccgtaaacacactgcatagaaaactctagagatgctttcaagagaacagcgtccctttatttagagcggctgcacaagagg

SEQ ID NO: 86886 - DNA, 170 bp, Homo sapiens
  chr2:75608174-75608344
  hypo
aataaaattcttctccgcccatcctcacccttcaactgtcagcatatcttcacttttcttgggtacaggacaagagcttgggaaccttccaacgtgtttacaagctataatacagtggactagggtgtacttggcccagctgcgggatgagctggcgtgcaagccagact

SEQ ID NO: 86887 - DNA, 33 bp, Homo sapiens; identical to SEQ ID NO: 27039
  chr2:7571090-7571123
  hyper

SEQ ID NO: 86888 - DNA, 320 bp, Homo sapiens; identical to SEQ ID NO: 27040
  chr2:7571157-7571477
  hyper

SEQ ID NO: 86889 - DNA, 150 bp, Homo sapiens; identical to SEQ ID NO: 27041
  chr2:7571576-7571726
  hyper

SEQ ID NO: 86890 - DNA, 157 bp, Homo sapiens; identical to SEQ ID NO: 27319
  chr2:75787200-75787357
  hyper

SEQ ID NO: 86891 - DNA, 482 bp, Homo sapiens; identical to SEQ ID NO: 27320
  chr2:75787804-75788286
  hyper

SEQ ID NO: 86892 - DNA, 15 bp, Homo sapiens
  chr2:75788330-75788345
  hyper
cggtcctccaggctt

SEQ ID NO: 86893 - DNA, 29 bp, Homo sapiens
  chr2:75851938-75851967
  hypo
caggtgggagccaccgcctccagtcgtta

SEQ ID NO: 86894 - DNA, 145 bp, Homo sapiens
  chr2:76036826-76036971
  hypo
tttggctcaaaaccacgaaagcctcataatcactgtgggtctaacctgggaggtgtcctgtttgcaaagcaaggtgattgggatatttatatcctctgtacacaacaggacagacactgactaagagttgcacacggccaggtgc

SEQ ID NO: 86895 - DNA, 40 bp, Homo sapiens
  chr2:7605196-7605236
  hypo
agaaaatgtaccgagttgtttctaccgtgtaggtaatgtg

SEQ ID NO: 86896 - DNA, 30 bp, Homo sapiens
  chr2:76975878-76975908
  hypo
atgaagctgtggtctcggcccagctccagg

SEQ ID NO: 86897 - DNA, 54 bp, Homo sapiens
  chr2:7739638-7739692
  hypo
gtgtgcgcttctacccgctcattgttgcgattgccagaccgaaggccagaaggt

SEQ ID NO: 86898 - DNA, 159 bp, Homo sapiens
  chr2:79159337-79159496
  hypo
gtgtgtgtgtatgtgcgtgtgtgttctgcacttgacagtaagctgtatgaaggcagggaatatatctttcactcactcttctgtcctcagcacctagcctagtgcctacaataaaatgctcaatacctgtaatccccgcagtttgggtggctgaggcgg

SEQ ID NO: 86899 - DNA, 166 bp, Homo sapiens; identical to SEQ ID NO: 27322
  chr2:79739850-79740016
  hyper

SEQ ID NO: 86900 - DNA, 259 bp, Homo sapiens
  chr2:79740063-79740322
  hyper
cggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccacc

SEQ ID NO: 86901 - DNA, 13 bp, Homo sapiens
  chr2:79740323-79740336
  hyper
acccacagaggtg

SEQ ID NO: 86902 - DNA, 147 bp, Homo sapiens
  chr2:80529296-80529443
  hyper
ccccagcctggtgcccgccggcccgtcccggctgcccaggcgtatttggtagcgcatgggttgagagccactgggacaatcacacctcgcattccctcgcgggctgctggtggcaggtacacgagccatactcgttgatgatcacca

SEQ ID NO: 86903 - DNA, 247 bp, Homo sapiens
  chr2:80529662-80529909
  hyper
ccttgtggatctgcacggcgttctcggcgtgctcgccgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactc

SEQ ID NO: 86904 - DNA, 270 bp, Homo sapiens; identical to SEQ ID NO: 1999
  chr2:80529985-80530255
  hyper

SEQ ID NO: 86905 - DNA, 72 bp, Homo sapiens; identical to SEQ ID NO: 27327
  chr2:80530256-80530328
  hyper

SEQ ID NO: 86906 - DNA, 179 bp, Homo sapiens; identical to SEQ ID NO: 27328
  chr2:80530408-80530587
  hyper

SEQ ID NO: 86907 - DNA, 217 bp, Homo sapiens
  chr2:80530622-80530839
  hyper
cgtccccctgcacggagcagatgtgattgtgatccagatagagccacgtgagctgcattaaccccgtgaactggccggcgcgcagctccgagaggctgttgtagcgcagggacaagcccagcaggccggacaggttgtggggcgcctcggtgaggttgagcgcctcgcagtacagcagccgcccctcgcaccggcacagctgcgggcacccgctggg

SEQ ID NO: 86908 - DNA, 685 bp, Homo sapiens; identical to SEQ ID NO: 27329
  chr2:80531328-80532013
  hyper

SEQ ID NO: 86909 - DNA, 240 bp, Homo sapiens
  chr2:80549571-80549811
  hyper
cacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgccagcctggccccggcgcagatgcgctgccccggccgcagcccagccgccgcgtgtgttgtcaggacgatcggaaacgcgtgtgtggggagat

SEQ ID NO: 86910 - DNA, 30 bp, Homo sapiens
  chr2:80591074-80591104
  hyper
ttttcttgcatgcaacgggagtggtaatag

SEQ ID NO: 86911 - DNA, 75 bp, Homo sapiens
  chr2:81421356-81421431
  hypo
ctgggggtctctccccgcccgggtggacgtggcgctccctcctcggcccctggggctcagcgcagccatgcagcc

SEQ ID NO: 86912 - DNA, 30 bp, Homo sapiens
  chr2:81421864-81421894
  hypo
tcagcttctactgctcgatgctgtgctgca

SEQ ID NO: 86913 - DNA, 54 bp, Homo sapiens; identical to SEQ ID NO: 39574
  chr2:81424249-81424303
  hypo

SEQ ID NO: 86914 - DNA, 82 bp, Homo sapiens
  chr2:81694612-81694694
  hypo
gctgcgtccccagctcgctgcaggcccaggcagcgtccaaagcgcccccggggcgagggcagctggccgtgcttggcttgct

SEQ ID NO: 86915 - DNA, 30 bp, Homo sapiens
  chr2:817019-817049
  hypo
cgaaagacggtgaatcggatcgagtttgat

SEQ ID NO: 86916 - DNA, 32 bp, Homo sapiens
  chr2:82462336-82462368
  hypo
taagaaactgaatttcgataaaacagcttttg

SEQ ID NO: 86917 - DNA, 18 bp, Homo sapiens
  chr2:83283948-83283966
  hypo
ctccgcctcaaaaaaaaa

SEQ ID NO: 86918 - DNA, 49 bp, Homo sapiens
  chr2:84101246-84101295
  hypo
gggtttgttgagtttcgcgcttctgagtgtgacgcgccctagtgggcat

SEQ ID NO: 86919 - DNA, 36 bp, Homo sapiens
  chr2:84104568-84104604
  hypo
acacagtggccgctccgaggccggggcagtctgacc

SEQ ID NO: 86920 - DNA, 213 bp, Homo sapiens
  chr2:8499980-8500193
  hypo
ctcctccggttatcccggcgctggagaatcaggcacaggatgggacagagcacgtggataaaatgttctcccgattaaatgtaggccagaagtcaggggaggtggggagtggggaggagatagcgatgtgcttagaaattcccggcttctcattattaaagtgctctcggctcacctgctacgtccaaatcaaactggcgggattggcgtcag

SEQ ID NO: 86921 - DNA, 479 bp, Homo sapiens
  chr2:85107340-85107819
  hyper
gacgcaagacctgtccgctatagagctgtgttgactcgggcaggtcactgagcctcccttgcctgggtttccctcacccacaaaacgttgatgcgaacatctaaagcgcccggctggacacgcaaggctcggacagtggtcactccgcgaacgcactctgtgacctggagcacacaggtcccccgctgagtgtcagtttcccagatcggtaaaaacaagggaaatggcttcaactccctaaagtcccttctaactcaggcactgaacatatgaaggttaagccaagcagcttcagggcgctgttaatattttgataagagcaggtgaaattaaactcttaaggaagagagggaagaagaaacttcaaataaatgtgcccaagttcctggtccggtactccctggcggatccgtcccccgaaagctcgcgaaaatggctggcgagaccccagaggctctctcggacgcccttgggctggc

SEQ ID NO: 86922 - DNA, 65 bp, Homo sapiens
  chr2:85280281-85280346
  hypo
ctaaaatgtctgaaacggagcgccagtccatggaaagcgagcgtgcagaccgcagcctgtttgtc

SEQ ID NO: 86923 - DNA, 29 bp, Homo sapiens
  chr2:85287855-85287884
  hypo
tgaacgaccgtgcccggccaagccaatgg

SEQ ID NO: 86924 - DNA, 427 bp, Homo sapiens
  chr2:85360043-85360470
  hyper
gtccgtgcatcagctcgcgcactcggagggactctaggcagggggagggccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgcagccggggctcctccctc

SEQ ID NO: 86925 - DNA, 438 bp, Homo sapiens
  chr2:85360872-85361310
  hyper
cgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctc

SEQ ID NO: 86926 - DNA, 63 bp, Homo sapiens; identical to SEQ ID NO: 6255
  chr2:85361466-85361529
  hyper

SEQ ID NO: 86927 - DNA, 30 bp, Homo sapiens; identical to SEQ ID NO: 39575
  chr2:85533655-85533685
  hypo

SEQ ID NO: 86928 - DNA, 18 bp, Homo sapiens
  chr2:85534085-85534103
  hypo
cagcgactgcatttatag

SEQ ID NO: 86929 - DNA, 64 bp, Homo sapiens
  chr2:85542210-85542274
  hypo
ggggacagttcagcccggcttaggcatgacctctgttttcatctgcctgcgaggcaccaaggag

SEQ ID NO: 86930 - DNA, 49 bp, Homo sapiens
  chr2:85641060-85641109
  hyper
gggagcccaggtccccggcgaccggaccccgaagcgcactacttgcctg

SEQ ID NO: 86931 - DNA, 275 bp, Homo sapiens
  chr2:85645262-85645537
  hypo
agggcccaggaccctcgcctgacccagccttgcctgccaggcctgggctgggtctcccagcccaaattctcacaagagggccgactccggccagagcgcgcccctctttgtgcctcggtttgcccacctagaggtcagtcccgcaggcgtggcgggtacatctcagggtcggcagaaagtgccaccgggagcccagccggagttgagggcctcgcgccgggcccactgtccagatccagggctcacgagaaaaacgaggacgcaggagagccaca

SEQ ID NO: 86932 - DNA, 43 bp, Homo sapiens
  chr2:85698940-85698983
  hypo
aggactcaagacttacgggttaggcattgctgatccagttaat

SEQ ID NO: 86933 - DNA, 34 bp, Homo sapiens; identical to SEQ ID NO: 39577
  chr2:85769773-85769807
  hypo

SEQ ID NO: 86934 - DNA, 95 bp, Homo sapiens
  chr2:85837713-85837808
  hypo
caatgaattaatatacgtaagatctaaaagcactttcactaatgcctaacaaaggtagtggcacacacctataatcccagcactttgggaggccg

SEQ ID NO: 86935 - DNA, 35 bp, Homo sapiens
  chr2:85838288-85838323
  hypo
ccattgcactccagcctgggcgacagagacctagt

SEQ ID NO: 86936 - DNA, 30 bp, Homo sapiens
  chr2:85890872-85890902
  hypo
aggatgacggagtagcgctcagccaggcac

SEQ ID NO: 86937 - DNA, 30 bp, Homo sapiens
  chr2:859874-859904
  hypo
cacagcccaggcctgcgggtccagccacac

SEQ ID NO: 86938 - DNA, 22 bp, Homo sapiens
  chr2:86346762-86346784
  hypo
gccaccgcgcccagctttccta

SEQ ID NO: 86939 - DNA, 39 bp, Homo sapiens
  chr2:86423730-86423769
  hypo
tgattctgtaatcaaaataaaacacgttaaatattaagc

SEQ ID NO: 86940 - DNA, 24 bp, Homo sapiens
  chr2:86425865-86425889
  hypo
ccccaggctggagtgcggtggctc

SEQ ID NO: 86941 - DNA, 16 bp, Homo sapiens
  chr2:86455870-86455886
  hypo
gcgcctggcaaccctt

SEQ ID NO: 86942 - DNA, 22 bp, Homo sapiens
  chr2:86562959-86562981
  hypo
cgagactcggtctcaaaaaaaa

SEQ ID NO: 86943 - DNA, 30 bp, Homo sapiens
  chr2:86564715-86564745
  hyper
acgtcagtcagctcacggcagccgccgcca

SEQ ID NO: 86944 - DNA, 142 bp, Homo sapiens
  chr2:8658308-8658450
  hypo
gggaagcactccatccgggccgagggaggagtcatttcccagctccagtcagcacctgtttctccgcctctggcccatggtaggaagggagctgccaggcatcccgcccttgaggcctctgagcgaacgagagctggttcac

SEQ ID NO: 86945 - DNA, 23 bp, Homo sapiens
  chr2:86783937-86783960
  hypo
ccctagcccgctttttcactgga

SEQ ID NO: 86946 - DNA, 44 bp, Homo sapiens
  chr2:86815266-86815310
  hypo
ggggaggctacacatgtgtggtggcatggcgtataagggaaacc

SEQ ID NO: 86947 - DNA, 30 bp, Homo sapiens
  chr2:87016267-87016297
  hyper
cgggaagggctttctcgcattctatctccc

SEQ ID NO: 86948 - DNA, 362 bp, Homo sapiens
  chr2:87016575-87016937
  hyper
cgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggc

SEQ ID NO: 86949 - DNA, 101 bp, Homo sapiens
  chr2:87017490-87017591
  hyper
ggagttgctcagggccgagcagaaatagtagccctcgttctctcggcggaagtcgctcagggtgaggacgaaggtgtcccccaacctcttgcccgagaacc

SEQ ID NO: 86950 - DNA, 644 bp, Homo sapiens
  chr2:87017592-87018236
  hyper
ctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatga

SEQ ID NO: 86951 - DNA, 33 bp, Homo sapiens
  chr2:87034656-87034689
  hyper
ttcgtccggcttcatcgccggctgctgacccgg

SEQ ID NO: 86952 - DNA, 90 bp, Homo sapiens
  chr2:87056531-87056621
  hypo
tatgatctttctgaatattttgtttactgtggattcctaattagggaaaaaggagtcaggctggggggagtcaggcgggtgggagcaagg

SEQ ID NO: 86953 - DNA, 493 bp, Homo sapiens
  chr2:87088683-87089176
  hyper
cctccccttctcctgcgtccaggcttttgaggggaggtggcctcagtccaggggctctccggtcccccggggtaatgcgatatgggggtattttatttccacccttagggaccgtgcctgccaagctgcctcccgggcgccccgccaccgcgggctcgacgctgcaccctgccaggaccagggccaggacagccacttatcacctccccgctcaggccccgggagcgcagacccttgggtagcccgcgcgccgccgccttacctgtcagctgcgcggccaagaggagccacagccgcggccgcatcgtggcgcgcccgggacacctggccccgggggctcggcggagacagtcgcggctggggtgggtgaggagctggccgggcggggcgcctgggtcggggagctgggggggcagtggggagggcgggaccgggcgcggtggcggcgggagtctggtgttggggaccgcgaggtctccgccctcatcctcct

SEQ ID NO: 86954 - DNA, 37 bp, Homo sapiens
  chr2:8731409-8731446
  hypo
ggtgaaaaatggcatcgtcttccgatttgcatttatg

SEQ ID NO: 86955 - DNA, 155 bp, Homo sapiens
  chr2:8751867-8752022
  hypo
cggggtcttccacctcggaactgaacacaccagaaaagatcaaacatttctctgaggacgtttcccactgagaccacgctgctgttactttcaaaccaaggagaaatgtctaacctgccaacagcgatcataaagtttgtcgtcaaatattgaga

SEQ ID NO: 86956 - DNA, 84 bp, Homo sapiens
  chr2:875937-876021
  hypo
gtggaacccgggacacgtgtacgtcctcagtggggcctccgcattccacactcgagcacatttgaaccccggacacctttacgc

SEQ ID NO: 86957 - DNA, 118 bp, Homo sapiens
  chr2:8768562-8768680
  hypo
cccgaggcagacgcccgggagtcatgcactagggcctcccagggctgactgggccaggcacctgcgcaaccctcactgacatggcacggagaaggcagttggacggttcctggtggtc

SEQ ID NO: 86958 - DNA, 80 bp, Homo sapiens; identical to SEQ ID NO: 39581
  chr2:87961966-87962046
  hypo

SEQ ID NO: 86959 - DNA, 179 bp, Homo sapiens
  chr2:881951-882130
  hypo
cacgaatctccacaccgaggtgggtcctcccacgacggattcctccaagcacaagagctggcctgggactaatgtggacagaggccagcgctcatgaattctcaaagatgccgcctttgtggcccctccccatagggactattcctccaacctgattgcttccacgtgcacatgaatac

SEQ ID NO: 86960 - DNA, 30 bp, Homo sapiens; identical to SEQ ID NO: 39582
  chr2:88306721-88306751
  hypo

SEQ ID NO: 86961 - DNA, 171 bp, Homo sapiens; identical to SEQ ID NO: 14378
  chr2:8833973-8834144
  hypo

SEQ ID NO: 86962 - DNA, 174 bp, Homo sapiens
  chr2:8834722-8834896
  hypo
aagttgtcaaaatcacggcacccaaacttcacattataaaattttaatcacaacctgttttatcacaatcgctttgcagcaacggaaattattcgtagtaattattaagttggtgcaaaattatttgtggtttttgccatcacttttaatggcaaacgccgcaaataattttgc

SEQ ID NO: 86963 - DNA, 28 bp, Homo sapiens
  chr2:8835589-8835617
  hypo
gaccccctgcgcccggcctgaccacaca

SEQ ID NO: 86964 - DNA, 196 bp, Homo sapiens
  chr2:88469231-88469427
  hypo
agaatcttaaaggaacgcagggcctttcttcttcacaccttgctgtccattttctaaactgaaaagtgaggttctgtggggctcacaaccctgcagcgaagactccgaggctgaacgtcaataaagcgtttactaaagcgccttaaaaaatgggccgcggggctgggcgcggtggctcacgcctgtaatcctaaca

SEQ ID NO: 86965 - DNA, 30 bp, Homo sapiens; identical to SEQ ID NO: 27339
  chr2:88469803-88469833
  hyper

SEQ ID NO: 86966 - DNA, 60 bp, Homo sapiens
  chr2:88470136-88470196
  hyper
cttgggagggtggtgcggggggtttctgatgctttgcgttttctgcgggatttgagcagt

SEQ ID NO: 86967 - DNA, 87 bp, Homo sapiens; identical to SEQ ID NO: 39584
  chr2:88573562-88573649
  hypo

SEQ ID NO: 86968 - DNA, 30 bp, Homo sapiens; identical to SEQ ID NO: 39438
  chr2:8860441-8860471
  hypo

SEQ ID NO: 86969 - DNA, 229 bp, Homo sapiens
  chr2:88650232-88650461
  hyper
tccaggcctgccagccgcctcccccgccgccttcccgggccgtttgtccgaaggcattatgcaaaataaagccgccttgtttcccgcgcctggtaaccccgggcttcccggaggctttcttggtgagagggaggatcccagagcggcgacccggctgaatcaccgcgagccgcgagccttcttcctgccacttgttctggcccacctgagaattcgcagtggggagcag

SEQ ID NO: 86970 - DNA, 30 bp, Homo sapiens
  chr2:88650807-88650837
  hyper
gagacgataggtccccgaactggatttcag

SEQ ID NO: 86971 - DNA, 125 bp, Homo sapiens
  chr2:8870339-8870464
  hypo
cagaacgctggatctcggtttactcagcctctccctgtagcgtcacaggctgtgcactcacctaggtgagcccctaagagcagggtttgcttctgcttcacctaacgccacgtcttccctcaaat

SEQ ID NO: 86972 - DNA, 103 bp, Homo sapiens
  chr2:88750914-88751017
  hyper
ctattcaggacacagcgaacctctctggaacccgatgaggaggaagtgcacctagggacagccgggctggaccccagttctcccaccgcgtcttctgcgaaac

SEQ ID NO: 86973 - DNA, 149 bp, Homo sapiens
  chr2:88751271-88751420
  hyper
ggttattcctccatccgctcccacccgcagcctggacaagaagactcctggcagatcttccagccgcacaccgacccctgcgccggcccttgcgacccgcgtccgccctccccggctgggaagcacctgccagcggccctcacctgggt

SEQ ID NO: 86974 - DNA, 356 bp, Homo sapiens; identical to SEQ ID NO: 2005
  chr2:88751460-88751816
  hyper

SEQ ID NO: 86975 - DNA, 936 bp, Homo sapiens
  chr2:88751942-88752878
  hyper
gtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttattcgttttctgtgcggtttgtacgggctttcgttgtgatttgtta

SEQ ID NO: 86976 - DNA, 45 bp, Homo sapiens
  chr2:88753098-88753143
  hyper
tgtaaaatactgtggcgacctcacgttccacgtaatcatcctcga

SEQ ID NO: 86977 - DNA, 30 bp, Homo sapiens
  chr2:88755765-88755795
  hypo
aaatagcaatctacccgtgtcttctgtcta

SEQ ID NO: 86978 - DNA, 232 bp, Homo sapiens; identical to SEQ ID NO: 39585
  chr2:88990189-88990421
  hypo

SEQ ID NO: 86979 - DNA, 224 bp, Homo sapiens
  chr2:89006626-89006850
  hypo
cttgttgagtttggacgcatgcaattttccatcactgggttttggcatggctccttgttagttgagtagttgatttaccttcttaacaatagtgtcattatctttttgtgtagcttcccaacccataccttccttctgaaagaatatttcttttaatctgtttagactggtaaatattgacttttcttgtgattttcttttttttttgtcgttgttaaatacac

SEQ ID NO: 86980 - DNA, 171 bp, Homo sapiens; identical to SEQ ID NO: 184
  chr2:89064805-89064976
  hyper

SEQ ID NO: 86981 - DNA, 398 bp, Homo sapiens
  chr2:89065128-89065526
  hyper
cgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctacagtttgtagccgacgattgtggaagact

SEQ ID NO: 86982 - DNA, 44 bp, Homo sapiens
  chr2:89071937-89071981
  hypo
gattacaggcgtgagccaccacgcccggccgtgaatgatacatt

SEQ ID NO: 86983 - DNA, 30 bp, Homo sapiens
  chr2:89121162-89121192
  hypo
ggctgcctcttaaagcgccagttctggaag

SEQ ID NO: 86984 - DNA, 30 bp, Homo sapiens; identical to SEQ ID NO: 39587
  chr2:89371674-89371704
  hypo

SEQ ID NO: 86985 - DNA, 260 bp, Homo sapiens
  chr2:8978038-8978298
  hypo
ttccggatccaggagcgagacctctgcctttcgcggggcctgtagttcacactccttccaggtctcccagcacctcccctcacctccttcagcctccacattcctaggccttgctgccaacaagcgtcaatcttgatttttgaaaaggtccaaggatgattacgacgtgcgtaggttgcgaaccatcgaaaagcacccaccaatgtgtcaacctggcaactcaggaaaaagccaataaggagcctgacttcatcagaagt

SEQ ID NO: 86986 - DNA, 30 bp, Homo sapiens
  chr2:89866048-89866078
  hypo
ccattccactcgactcgactcctttacgtt

SEQ ID NO: 86987 - DNA, 32 bp, Homo sapiens
  chr2:90003862-90003894
  hypo
aaacagctccttggccgggcgcggtggctcac

SEQ ID NO: 86988 - DNA, 20 bp, Homo sapiens
  chr2:90209634-90209654
  hypo
ttcaccgtgttagccaggat

SEQ ID NO: 86989 - DNA, 75 bp, Homo sapiens
  chr2:90413666-90413741
  hyper
tacggctttttgcgcccatcaccgtagctttttgcctccgccaccgcagctttttgcgtccgcaaccacggcttt

SEQ ID NO: 86990 - DNA, 321 bp, Homo sapiens
  chr2:9134235-9134556
  hypo
atcacaccagccctgcggactctaaacatgctccgtgccaagaatggtcctaggcagacgggacacaaagatgagtaagtggaggtccttattcttaaggaatttagtttgggagggagacttgtaaagcaaacaaaaaaaaaatcaatgctccaggtgttatcagagtagaatacagtgaaagcggggcatgatgggactgttcggagggccctaaccaacagggcagcccaggcattctctcgcagcactgcttcctggagttggaggggtactcacatatgacaagaaggcagtggagaggggcgaggaccccgcatg

SEQ ID NO: 86991 - DNA, 220 bp, Homo sapiens
  chr2:9143144-9143364
  hyper
gcccctagcacccatcgacgccgtctctaaggcacccagcacacccagacccatgcatcagcctctccgggggtcgctcagaggcgcgcgcggggcaggcagcaccacgccaggctccccaaagcgcagccttccgcaccctttccacaacccggtccatgcgcaccgggggctgctccgggacccgaccaccggatccgagcgccgctgccgcgaaggg

SEQ ID NO: 86992 - DNA, 251 bp, Homo sapiens
  chr2:91635152-91635403
  hyper
cgtatgcggcttccggcccccgccgccacggctttttatcacccccgccgctttttgcccccgccgccgcgggtttttgcccccgcccccgttgctttttacccccgccgccgcggctttctgcccctgccgacgagggtttttgcggctttatatccccgctgtcatggctttttgcggccgtggctttttgccccctcagccgtggtttttttgcggcttttggcacccgtcgccgcagctttttcagg

SEQ ID NO: 86993 - DNA, 20 bp, Homo sapiens
  chr2:91874180-91874200
  hyper
gttctcgggagtctgcggcg

SEQ ID NO: 86994 - DNA, 39 bp, Homo sapiens
  chr2:92261800-92261839
  hypo
tggtttttccacccccgccgctgccgcggctttttgccc

SEQ ID NO: 86995 - DNA, 84 bp, Homo sapiens
  chr2:9242700-9242784
  hypo
gaggctgtgaaaacacggacactaatatttcactagtgtgtcattgacgctgcagcaagactacattaccgttttgaagttaaa

SEQ ID NO: 86996 - DNA, 30 bp, Homo sapiens
  chr2:9244301-9244331
  hypo
aagccctccaggcagcgagtcacttagcac

SEQ ID NO: 86997 - DNA, 30 bp, Homo sapiens; identical to SEQ ID NO: 39390
  chr2:925888-925918
  hypo

SEQ ID NO: 86998 - DNA, 117 bp, Homo sapiens
  chr2:9347560-9347677
  hyper
agacctcccctctctcggcctcgtggccctcgcggggttccgcggcctggtcttttccccgcagcgcggccaactttgtccagagtcggggtccgcggcgagcgggggatcccgctg

SEQ ID NO: 86999 - DNA, 30 bp, Homo sapiens
  chr2:9347993-9348023
  hyper
tcacctgcttgaacccggaatgccgccctt

SEQ ID NO: 87000 - DNA, 180 bp, Homo sapiens; identical to SEQ ID NO: 14383
  chr2:9352635-9352815
  hypo

SEQ ID NO: 87001 - DNA, 458 bp, Homo sapiens
  chr2:945552-946010
  hyper
agccttgcctgcccccgccgcactggaatttatcctaaacttactttcatttacattaaaacaagacgatttgagtctaccaaacccaatactgcatctgtgaggctccttttggcacaaacctgaatgaacagcgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggcc

SEQ ID NO: 87002 - DNA, 207 bp, Homo sapiens; identical to SEQ ID NO: 1921
  chr2:946011-946218
  hyper

SEQ ID NO: 87003 - DNA, 115 bp, Homo sapiens; identical to SEQ ID NO: 1922
  chr2:946289-946404
  hyper

SEQ ID NO: 87004 - DNA, 135 bp, Homo sapiens; identical to SEQ ID NO: 27015
  chr2:946432-946567
  hyper

SEQ ID NO: 87005 - DNA, 128 bp, Homo sapiens; identical to SEQ ID NO: 27016
  chr2:946916-947044
  hyper

SEQ ID NO: 87006 - DNA, 55 bp, Homo sapiens; identical to SEQ ID NO: 27017
  chr2:947126-947181
  hyper

SEQ ID NO: 87007 - DNA, 30 bp, Homo sapiens; identical to SEQ ID NO: 39391
  chr2:951526-951556
  hypo

SEQ ID NO: 87008 - DNA, 189 bp, Homo sapiens
  chr2:95663943-95664132
  hyper
ggttgagagctaggtcggccaccgagcgccccactgggtggcgcgtgggctccgcgcgcaggcagggagggcggccctcggtggggtcgactgggcggagccgccgcctcctatcttcccttgaaggcacctgcgcagggggacccgcggtgcctgggaggggagggggactttcgcatgaagcccctc

SEQ ID NO: 87009 - DNA, 753 bp, Homo sapiens; identical to SEQ ID NO: 27348
  chr2:95690747-95691500
  hyper

SEQ ID NO: 87010 - DNA, 1037 bp, Homo sapiens
  chr2:95691501-95692538
  hyper
ctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacctgggaggggtgtgccctgtatgtcctgtgggtgcggtccgtcaccgcctgagggacacc

SEQ ID NO: 87011 - DNA, 30 bp, Homo sapiens
  chr2:95726475-95726505
  hypo
cctagggagatgctacgatcatttccacca

SEQ ID NO: 87012 - DNA, 39 bp, Homo sapiens
  chr2:95736152-95736191
  hypo
tgggattacaggcatgagccactgcgcctggcctgttcc

SEQ ID NO: 87013 - DNA, 40 bp, Homo sapiens
  chr2:95742095-95742135
  hypo
tgaaagtaaagctcacgggtttttttctacttcgggttgt

SEQ ID NO: 87014 - DNA, 20 bp, Homo sapiens
  chr2:95745778-95745798
  hypo
tggcccggacacaagcattt

SEQ ID NO: 87015 - DNA, 18 bp, Homo sapiens
  chr2:9580845-9580863
  hypo
tagtagtaggaggtacga

SEQ ID NO: 87016 - DNA, 187 bp, Homo sapiens
  chr2:95873374-95873561
  hyper
tagaggagggctgaacgcatccccttttaatctgagtgtccgggaggagggtggcgggaggacccccgggtgggggcgccaggctgcccacgcgtgcgttcccggcctcttgggggacccgagcggcggacctccggctccttcccctgtcgcggttgcctccagcgcgggccggaggaaggagtct

SEQ ID NO: 87017 - DNA, 223 bp, Homo sapiens; identical to SEQ ID NO: 39591
  chr2:95941629-95941852
  hypo

SEQ ID NO: 87018 - DNA, 30 bp, Homo sapiens
  chr2:95958861-95958891
  hypo
aggccctgatctgggcggatgtggacagca

SEQ ID NO: 87019 - DNA, 99 bp, Homo sapiens
  chr2:95988527-95988626
  hypo
ctcctgttcacgggacggggcctgccttcaaaacaccacccaaccccagcccttggcagctctccctggcgcttctgagtactgcgaggccctgtgccc

SEQ ID NO: 87020 - DNA, 30 bp, Homo sapiens
  chr2:95989378-95989408
  hypo
tttctgttcccaccccgtcacaactttggg

SEQ ID NO: 87021 - DNA, 32 bp, Homo sapiens
  chr2:95989755-95989787
  hypo
gaggcagagggagcccgcggccactgccttgg

SEQ ID NO: 87022 - DNA, 170 bp, Homo sapiens
  chr2:96011693-96011863
  hyper
gtctccccctctctgcggagcaggcggcggcggctgcgagtccgtgactcgaccaaggtcacgcagcaaagtcagcgaccaagctctgttccgcagacgccagggccaaagcccacactttccctaaagccccgagtgcacgcgcgtttccagaacgggagaactttgga

SEQ ID NO: 87023 - DNA, 242 bp, Homo sapiens
  chr2:96012441-96012683
  hyper
ctggcccgcgctggccgtccgcgctgcgtttcgcgccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagccgtcgccgcccccgagaggccgtgcgg

SEQ ID NO: 87024 - DNA, 127 bp, Homo sapiens
  chr2:961623-961750
  hypo
gggcccagctcctcccggctgctcccggctcctcccagctgctcccactcagtccctgcttctttggtcctgtgtgtcggacccatccctaccatggccttgctgcttctctcgcctccatgcatgc

SEQ ID NO: 87025 - DNA, 120 bp, Homo sapiens
  chr2:96192504-96192624
  hyper
cggcgcaggaaattccggcggcgcggcgaggggtggggggaggcaggcgcaggaggcgggcgaagaggagggcgcagagtagcataagccgctcggcctagcggccgctggctccacaaa

SEQ ID NO: 87026 - DNA, 202 bp, Homo sapiens
  chr2:96428959-96429161
  hypo
gcagtggacaacactcggttctgtccatctccctgccttggggaagtacttgcttgtagttttaatttacctttgaccctatggtgcacttctggaatgttccctccatgagggtggggacttggtcttgttcacggggatctctctggcacctggagcagctgcgtagcccagggtgctcagtcatcgtctgctgcccgaa

SEQ ID NO: 87027 - DNA, 77 bp, Homo sapiens; identical to SEQ ID NO: 27353
  chr2:96781907-96781984
  hyper

SEQ ID NO: 87028 - DNA, 224 bp, Homo sapiens
  chr2:96782022-96782246
  hyper
cgagcggggcctaggaggtcgggaacacccaggaccagcagccgccctcctacatcctcctccaccggtgcccggggtccctgccgtccgccccagagaagtttcccaagttgtcccgccgccgtccccgtcccgcccgggaccggagaaagtcgcgccctcccgccacgcggatgccgtacgctctgggggcgcgggccgggctgggccggttcttaaaggag

SEQ ID NO: 87029 - DNA, 184 bp, Homo sapiens
  chr2:96784561-96784745
  hypo
ccttggcatccataccgctgccccaggctgtcaccgtctactgcagctgtctcctcctggctccaccccaggatggacaagtgcagcgtgggtgcgccagctctccacggccacgcaggccataacataactcagctcctgctcctctcggcggctcaccatctccccccgcacacacacacct

SEQ ID NO: 87030 - DNA, 34 bp, Homo sapiens
  chr2:96872240-96872274
  hypo
cttaaaagtggaacacggccgggcgcggtggctc

SEQ ID NO: 87031 - DNA, 30 bp, Homo sapiens
  chr2:96970484-96970514
  hypo
gccttgtctcccatacgggtgccctccagc

SEQ ID NO: 87032 - DNA, 300 bp, Homo sapiens
  chr2:96987012-96987312
  hyper
atcaagctgcgtccacgcggttaggaagcatcgcttgggccctgggggatgggcagcggcaaaggagagctttttcctgtccgctcggggaagagcgcccaggggaaaggggttgtgggtcccggcacgcggcactacgctccccgtcccccgcctcgtctttcttcggctcggcccgtggggcttccgccgccctgggcttgcagctgggactcatttccagatcggtcgaaggcaggtcttccttctagggaccggtagctcagaggaaggaccggcggcaaccgctgccctgtccga

SEQ ID NO: 87033 - DNA, 435 bp, Homo sapiens; identical to SEQ ID NO: 27356
  chr2:96990881-96991316
  hyper

SEQ ID NO: 87034 - DNA, 30 bp, Homo sapiens
  chr2:96993641-96993671
  hypo
atcattttaagtctccggcagcatcagagc

SEQ ID NO: 87035 - DNA, 102 bp, Homo sapiens
  chr2:96996017-96996119
  hypo
ttcccagaagctgatgccagtcaatcattggggctcccagtgcacaatagctactgtgttcctgtgttgcctgcatctgtcaggtaccgctttcaatgcaag

SEQ ID NO: 87036 - DNA, 39 bp, Homo sapiens
  chr2:97101384-97101423
  hypo
tgggattacaggcgtgagccactgcgcctggcccatttt

SEQ ID NO: 87037 - DNA, 36 bp, Homo sapiens
  chr2:97135614-97135650
  hypo
tacaggctgagccaccgcgcccggcatctgtttctt

SEQ ID NO: 87038 - DNA, 30 bp, Homo sapiens
  chr2:97159065-97159095
  hypo
ccagtcacggtcagtcgatcatggaccacc

SEQ ID NO: 87039 - DNA, 172 bp, Homo sapiens
  chr2:97174612-97174784
  hypo
cagcctggaaacaagcgaatgtccactgctgtccacctcacactcagctgggggagctgaactgctcagatccccgggaatgcagggcccattccccggaggccaaggccagtgtcccacccacacccagtccaggcctatgcttccccgggtctgccgcctaagcagccct

SEQ ID NO: 87040 - DNA, 49 bp, Homo sapiens; identical to SEQ ID NO: 27357
  chr2:97193015-97193064
  hyper

SEQ ID NO: 87041 - DNA, 401 bp, Homo sapiens; identical to SEQ ID NO: 27358
  chr2:97193251-97193652
  hyper

SEQ ID NO: 87042 - DNA, 169 bp, Homo sapiens
  chr2:97203376-97203545
  hyper
ggaagagggcaagagcgtgggctacgagcttgcaggcgatgcccggcttcgcgctcggcgggagctgcgggccaacccgggcccgcgctccgtccctccgcggtgtctaggggtcgcccgggctggggtcgcgtcaccctccgcccagcgccggcgtggtggggcttgc

SEQ ID NO: 87043 - DNA, 30 bp, Homo sapiens
  chr2:97275430-97275460
  hypo
gtaatgcaacctctccgaacctgtttccgt

SEQ ID NO: 87044 - DNA, 49 bp, Homo sapiens; identical to SEQ ID NO: 39392
  chr2:973406-973455
  hypo

SEQ ID NO: 87045 - DNA, 639 bp, Homo sapiens
  chr2:97427454-97428093
  hypo
actaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtct

SEQ ID NO: 87046 - DNA, 30 bp, Homo sapiens
  chr2:97435640-97435670
  hypo
agctggttaatactccgggtgcaggcagag

SEQ ID NO: 87047 - DNA, 30 bp, Homo sapiens; identical to SEQ ID NO: 39596
  chr2:97437788-97437818
  hypo

SEQ ID NO: 87048 - DNA, 30 bp, Homo sapiens
  chr2:97553301-97553331
  hypo
gcgttgagaacagagcgtttctgggagagc

SEQ ID NO: 87049 - DNA, 30 bp, Homo sapiens; identical to SEQ ID NO: 39597
  chr2:97603228-97603258
  hypo

SEQ ID NO: 87050 - DNA, 139 bp, Homo sapiens
  chr2:97605950-97606089
  hypo
ggagtaaagggcacccggcatgagaacggtatggggtccagggcccaggcacttaagtgctccacacatatgggcagctgctgctgccaccgccacaggagacgcgacctgcagatgagaaggtcgtggggcctccact

SEQ ID NO: 87051 - DNA, 97 bp, Homo sapiens
  chr2:97651788-97651885
  hypo
ggagggcccggctcacgtcggaacccgaaccacgcggggtcgcaggaacctgaaaagcgccagagtagcccggcggccgcaccggggctgacctgca

SEQ ID NO: 87052 - DNA, 209 bp, Homo sapiens
  chr2:97652196-97652405
  hypo
atccagggccgccaacgtggaacctaaagatccagttctggggattgagttccgactccaaaccaagcggccagctcacagccgccgccgccgccagctggggagctcgccggccaagtgcgcaccctcttcctgttagccctccacgtgcgcgccctcttcctgctcgccctccacgtgcgcatccacgtgcgcgggaattggctggc

SEQ ID NO: 87053 - DNA, 30 bp, Homo sapiens
  chr2:9784906-9784936
  hypo
tcttcacttggtgaccggttttacaggttt

SEQ ID NO: 87054 - DNA, 62 bp, Homo sapiens
  chr2:98025655-98025717
  hypo
atcagacatgcaaatcgactccagggaaacctgtgcttattgggccccgcttctggagaaac

SEQ ID NO: 87055 - DNA, 30 bp, Homo sapiens
  chr2:980380-980410
  hypo
gcactgccttagctccgtgactcaggacag

SEQ ID NO: 87056 - DNA, 30 bp, Homo sapiens
  chr2:9809292-9809322
  hypo
aaagcccagacagatcgtcaagatgaaggc

SEQ ID NO: 87057 - DNA, 30 bp, Homo sapiens; identical to SEQ ID NO: 39601
  chr2:98263541-98263571
  hypo

SEQ ID NO: 87058 - DNA, 89 bp, Homo sapiens
  chr2:98351134-98351223
  hypo
aactttggctcagtgcgccagggcgtgtaccgcatgcgcaagtatggccgcccctgccgtggtgggagcaccgccgcctggggcagagg

SEQ ID NO: 87059 - DNA, 30 bp, Homo sapiens; identical to SEQ ID NO: 39603
  chr2:98354137-98354167
  hypo

SEQ ID NO: 87060 - DNA, 145 bp, Homo sapiens; identical to SEQ ID NO: 39604
  chr2:98357736-98357881
  hypo

SEQ ID NO: 87061 - DNA, 30 bp, Homo sapiens
  chr2:98614089-98614119
  hypo
agtgagccaagatagcgccactgcactata

SEQ ID NO: 87062 - DNA, 215 bp, Homo sapiens
  chr2:98633480-98633695
  hypo
gaattgctcactcaacggttatgatgctgccaatgcctggccttatattgtgcgttgaggacatctagatgaatcagattggtcactgctcttgaggaggtgacagtccccacaaggaggtcacaagaagagccatgtaaacatataattatattgcagcatggcaaatgatgactcagtggatgtttctacaaagtgctcgggaatctcaggag

SEQ ID NO: 87063 - DNA, 189 bp, Homo sapiens; identical to SEQ ID NO: 39605
  chr2:98702143-98702332
  hypo

SEQ ID NO: 87064 - DNA, 154 bp, Homo sapiens
  chr2:98703234-98703388
  hyper
cctcccctgtctgctcgcaccctatatttctaccccagctcatcagtgtatttgtttgttaattcattcattctttcattcatattctccgctgttgttaattttcccattgacagtaggcgcaaggggcaacgccactcgccctgtccctcta

SEQ ID NO: 87065 - DNA, 150 bp, Homo sapiens
  chr2:98957243-98957393
  hypo
tgtctcaaaaaaaaataaataaataaaaaataaaaacacataaaaccaccaaaaagagagtagatattatatatgtagtagaagtacgcatttcttggctttcaaatatttgcaagtctctagaataaatattatcggaactcaaataaa

SEQ ID NO: 87066 - DNA, 208 bp, Homo sapiens; identical to SEQ ID NO: 27360
  chr2:98962692-98962900
  hyper

SEQ ID NO: 87067 - DNA, 161 bp, Homo sapiens
  chr2:98962973-98963134
  hyper
cggagaagctcaaactttggcagggtaaggatttttaggggctcttgagctggaattttttggggggcgccgggaggtgtgctggggccgcagaccccatacaggaggtaagttagagaaccacacgcaggggagggatgctgctgcttccaggggcgggc

SEQ ID NO: 87068 - DNA, 273 bp, Homo sapiens
  chr2:98963135-98963408
  hyper
cggcgctgtccgcagcccccggtgctgaaacgggccgcgggctggagagaaagtgaaaaaggatcggctacggcctcggctcccactccccggctcccatacccctccagtccagttcaaaggacaggaagccctccccgtgctccccaagccgatcgcacccccttttactcacgtcccacagccgcgctgggccgagcccgctgagccgtcggggcgggaggcagaaggagcagggctggctcccgctggggacgggtagggcttgcagcc

SEQ ID NO: 87069 - DNA, 417 bp, Homo sapiens; identical to SEQ ID NO: 189
  chr2:98963409-98963826
  hyper

SEQ ID NO: 87070 - DNA, 850 bp, Homo sapiens
  chr2:98963868-98964718
  hyper
cgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacatcttccaaaggggcgaggctgggatcagcaggaatggcacccacccgggttcagactccatcccggagtggacagctcggtgcccctaacattatgcactgtccgccaccccctccccccaacacatacacactttcattcatgaaaaccagcaagaatagtgctgtctgggcacggagtccaatgtacagcgtgcgttcacgctgagaattcatgggggacgcgggtggttgggccgggagaggagagatggtcacttgtgtgtggtatccaccaactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttgggg

SEQ ID NO: 87071 - DNA, 87 bp, Homo sapiens
  chr2:99004128-99004215
  hypo
aggcgtgtctgaactcggccacatttgcgaacctgcgaccacacgtatttgccactacatgcgtcacagacccgcctcttcgaatgt

SEQ ID NO: 87072 - DNA, 30 bp, Homo sapiens
  chr2:9908748-9908778
  hypo
atcctgtctccacagcgtcccctgcggcct

SEQ ID NO: 87073 - DNA, 30 bp, Homo sapiens
  chr2:9921447-9921477
  hypo
ccaacccctggttggcggctgggaggtgtg

SEQ ID NO: 87074 - DNA, 142 bp, Homo sapiens
  chr2:9921692-9921834
  hypo
tgcatcaatacattacgtggactttgagcatgtcagttctcctctctgagttttactatccttgtccatataatgaggtggggtgggtttcccactggatctgaacatctgttttttgttttttttttttgtttttgttgtt

SEQ ID NO: 87075 - DNA, 30 bp, Homo sapiens
  chr2:99264200-99264230
  hypo
agcactttatgaaaccgtatgatgctgtca

SEQ ID NO: 87076 - DNA, 139 bp, Homo sapiens; identical to SEQ ID NO: 191
  chr2:99439368-99439507
  hyper

SEQ ID NO: 87077 - DNA, 30 bp, Homo sapiens
  chr2:9949207-9949237
  hypo
caggcagccctgctccgctctggcctggct

SEQ ID NO: 87078 - DNA, 30 bp, Homo sapiens
  chr2:9949649-9949679
  hypo
aggggctgggggtctcgggtgtcccaacat

SEQ ID NO: 87079 - DNA, 985 bp, Homo sapiens
  chr2:99552170-99553155
  hyper
ctttgggcacttgcacgagcgcgtccggctccccctcggccgcaggagctgcccagggcttcggcggcgggggtggcgcctctccgggtccgaggggcccctggcttcacggcctctgccctcgaccccctagccccggcccgccccacctccgcccggtgcccccgcgcccaccccgccttcgacccacgcctgccttgggacacgcgatttcaaacccctcgaggtacctgggacaggagcgtggcccgggctcggcgagacgcgcagagaagggcaccttccgcggggtgcggcgagccggggctgctcccgccgcggtgcgcgtctagccccagcccaaagccggggcgacgcagcaggtggccgcgcggcctccagacagcccgggtctgcggccgaagagctggacgcgggcgctgacactaccctcccgcggccggcccggccctgcgcccggcgcgctcccagctcccagctcccagctgcaggcgcgccggcttcgctcggctccgctcggctcggcgggggcggacgccgctcagctcccctcgccggccgccgcgcgcacctcccccgcggcgcacagctcccaacgccgcctccgcagctggcccggcggagtggggccgagacctcggggcggggggcgcaggcgccggcctgggccttggacgccccgcgggaggcgggagggcgatcggggtgcggggagggcaatcggggtgcgggcccggctgcccagcgctccctcccaagcccgcgccgctcccgacccgcctcggcctgtccgcgcagcggcgctgtcggggctccgggagggccggggggcaccggagacccggaggtggtggcaagtcagtccgggactggcccagggcacccgcgcgcgtcggtgagagggacccgggactccaggtgacctccggatccgccctctaagtcagtggcctgcggcgggcgtgggcgccgagggaaggaagtg

SEQ ID NO: 87080 - DNA, 125 bp, Homo sapiens
  chr2:99553419-99553544
  hyper
gctgccttgggtggtcgcccagcgaatctcctccggagcccgagccgcggctttggtctgcggatggcacagcccggcgaccccgtcccggcctcttccccggcggtgcacgcccagggccaggc

SEQ ID NO: 87081 - DNA, 29 bp, Homo sapiens
  chr2:99553798-99553827
  hyper
cggctgtcggaggccgagagggcctggac

SEQ ID NO: 87082 - DNA, 590 bp, Homo sapiens
  chr2:9960219-9960809
  hypo
ggtgtcggcagtcaccgtgggcctctcttctctcttcatacaccaggaaccaacccagccaggttaaaggacttgcccaaggtcacgcggaggaaagctggttggtgccaagtggttaggagagaaagggtgaggtcatgagagcaaacctaagagggctgctaccgactcccaggatgaaatcacagatgaagtcacagaatcggaatgctggctttgggagagaccgccctgctccttcaggaagctgggggtgggggcgggagtgggggcggggagcaggtgcaggggaaggggtaagagctcagactctggacttagaaggatccgattgatgattccagatcccagtggcttcatgaacgtgggcgagttacacaacttctcggtctcctgcttttctccttagtaaaacaacccatgccccacggaggtgccgtaaagacagaacgactctgcagatagcgttaagcacgatgccagccaccttggaggcgcacagtacatacggctcatggcatttcagggagcggcaagccagttgctgccaacccgcccgatgactgtgtctaaggcggaatctggaagcc

SEQ ID NO: 87083 - DNA, 38 bp, Homo sapiens
  chr2:99694705-99694743
  hypo
cctgggcaagggaggaagactcccgtttgaaaaaaaaa

SEQ ID NO: 87084 - DNA, 93 bp, Homo sapiens
  chr2:99795933-99796026
  hypo
cactcagcactgaaacgtgatatctatgcttattgctgttgtcactgtcatcattatcatcaaataatgccccaggcaaggtagagtttacag

SEQ ID NO: 87085 - DNA, 152 bp, Homo sapiens
  chr2:99796326-99796478
  hypo
ggtagagtttgtagttctgaccaaagcaccaaaccataaagggctcccctctgctgccccaaagcttctgtaacactttaattataagaagcttaaactagaaagaacagagggagcttagtccagaccgggagtgtcgggggttggggagc

SEQ ID NO: 87086 - DNA, 100 bp, Homo sapiens; identical to SEQ ID NO: 1551
  chr2:99798646-99798746
  hypo

SEQ ID NO: 87087 - DNA, 101 bp, Homo sapiens
  chr2:99799327-99799428
  hypo
ttcctatggaattagcgtgctattgaatgtacatgcactaaacaacaaaacctaacagataattaagttacgttagaagataagcacgatagaaagcagtg

SEQ ID NO: 87088 - DNA, 31 bp, Homo sapiens
  chr2:99951500-99951531
  hypo
aatggagtattttgtacgagaaattttatac

SEQ ID NO: 87089 - DNA, 604 bp, Homo sapiens
  chr20:10198127-10198731
  hyper
taacattgcgaggcacgacttctaatcgcatccttcccggaaaagtacaaacagttcctcagacgaggtcccccacctcccacgcgctccccagccctccctccctgcggagagccccgcgacagcctccccaacacctgtgaatcatccgggaggctgccaccgccgagcgatccgcgcaccacccccttcccgggcccgggcacggccagggaggacagttagggttgttgctttataattatcacttttaatctctaatacgaccagcacaagtagcctttgtctccccgccctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 87090 - DNA, 15 bp, Homo sapiens
  chr20:10198940-10198955
  hyper
cggggatgcccctac

SEQ ID NO: 87091 - DNA, 453 bp, Homo sapiens
  chr20:10199315-10199768
  hyper
tagaaggtgaaaacacgcaggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtaagaacccccctccccaggtcgtggctctggctcgggatggctgcatacccagaagggacagcagctgggcagtccgagtgggcttgggtaaatacaagtattggtgcacttagggtgcggtattccgtgtgtgcacgtct

SEQ ID NO: 87092 - DNA, 42 bp, Homo sapiens
  chr20:10200073-10200115
  hyper
gaaagggggagttcccgccccgggcaagctgagctgctgcag

SEQ ID NO: 87093 - DNA, 43 bp, Homo sapiens; identical to SEQ ID NO: 37934
  chr20:10200153-10200196
  hyper

SEQ ID NO: 87094 - DNA, 202 bp, Homo sapiens
  chr20:10640930-10641132
  hypo
tgcagcctgacaccccggcacgcactgaaccacttgcaggcaggtaacactttactcgtttttgcaaataaacagaggccaaggaatgacaaaaatgtctctccattaactatgtttgctctgctggttcagttaaaaagcatagtgggctattaccacgcgcttacaagatcttcataaaagggatcggttaaacacacta

SEQ ID NO: 87095 - DNA, 30 bp, Homo sapiens
  chr20:10686912-10686942
  hypo
ttcttggtaaactgacgttgacctcgaagg

SEQ ID NO: 87096 - DNA, 30 bp, Homo sapiens
  chr20:10774557-10774587
  hypo
taaaagctgattatccggcttgtctccttt

SEQ ID NO: 87097 - DNA, 166 bp, Homo sapiens
  chr20:11589587-11589753
  hypo
cagctgaggcttgtccgccggcggggccgtgtcctccggcacctctttaggcgcctcctctgccaccttagcgcagccacctgctaactgctggttggacacggagcccagggtcgtcagctgagcccgcagccctgggtccctggttgggcggctgctggcccca

SEQ ID NO: 87098 - DNA, 30 bp, Homo sapiens
  chr20:1165419-1165449
  hyper
ttcacaaaacccagtcgatagacacacgca

SEQ ID NO: 87099 - DNA, 72 bp, Homo sapiens
  chr20:11667745-11667817
  hyper
ccgctgccaggaggccggcgtgcgcgcagctctgcggcggggcaggctgccagggcccggggagcagcggca

SEQ ID NO: 87100 - DNA, 30 bp, Homo sapiens
  chr20:1167086-1167116
  hypo
gaatcgtgcaggttccgggaagacacggtg

SEQ ID NO: 87101 - DNA, 30 bp, Homo sapiens
  chr20:11872354-11872384
  hyper
aaagaaagtattgttcgggcctgctgggga

SEQ ID NO: 87102 - DNA, 68 bp, Homo sapiens
  chr20:1206095-1206163
  hyper
caggtgtctcaggtccgagcgccaggacaaagccggagactgcgcactaggaccggtgcgccttgctc

SEQ ID NO: 87103 - DNA, 507 bp, Homo sapiens
  chr20:1206684-1207191
  hyper
attgcagacgcccagcggcgccaagaacccggccaagctgacttggcgactcctcgcagcccctgctctggcacgccacacctcagacgaggctttgaaagtagggcgcagcctgagaggccggccggaccccgagtgctgtaggcgggctgggagatgggggccgccgccacccacattcccacacgcacccggcgccggcgcctcacgccgtgttagctcgcggcgccaagcccggagggtcccgcctgaggaagaaaggtcgtcgcccgcagcccagctggggctggaggcgcgacccggggtctcctcgcccgcacgcggaagaaaatgggcgctgtggcctcagtttccctctgtgagcacccggcccggaactctgaggagtcgtctgtggaggagcctttggcgtccccctgcccctgagcgtggccgtcagctcttcccagcccctgcactttgctttcccctccctcacgcccggaagggtctcgccctgcccggctc

SEQ ID NO: 87104 - DNA, 227 bp, Homo sapiens
  chr20:13200556-13200783
  hyper
taaatctttctaggacgcggagaaggaaggtaggaaattggggagggggaaagggaggcgtgccgtcaagaaagagttgattatttatttaatttcattcaccaagggagaattcggaggctccatcccggaggcactggggtccgggacgcgggaaaggcttggaaatgtgcgacgcggctgtgtgcgaacgcgtggactaggtcttggctcgctgggagggaagg

SEQ ID NO: 87105 - DNA, 437 bp, Homo sapiens
  chr20:13201128-13201565
  hyper
tgggcgcggcacccccgggatgagccccccacagaggcaagcccactagagctgagattcactccgagttcctgagcgcctgagccgcgggcactgcgtctctgcagcttccagccaacacctgcgcccgtgaccagacgaacgcctagagagtcggactcccctcccttcccaggctctacggggcgccgcggatccgcgaacagccgtgcccggctagcgggcggcccagcaagtgtcaagacccttcggaacgacactttggcactcctcctctcccccgactgcttcaggcaggggtcgcaggcagacgcatggcttgtccggcgccccctccgttttccatcactgcaactccagctccagtttgccaataaaggtttctaaagcagcccaggcaccaccccacccacccacagccccgagcctcagtgtgc

SEQ ID NO: 87106 - DNA, 563 bp, Homo sapiens
  chr20:13201961-13202524
  hyper
ccagctgcggcgccgcggccacatctggggcgcccatgtgcgctcgggggctcggctgcgcccgccccgccgccgaccccgcagccccctgccagcagggtggcctccggcccggcccgggtcccgggctgtcccgggacccagtctccgtctccgccgccgccgccgccaggcagcgccggggcttgctccgcagccggcttggacacccccggcctcgcggtggctccgccgtggtgcggcggcggcggcggcggcggcgccggcagctcctgctcccccggccccgcacaccccgccgcgcccagcgccagccccgcgggcccgggaagcggagccctggcgggagccgaggcgggagccgcgctgccgggctcccgggctcctactcctcctcccccggcgtcaccgccgccgccgccggccgccgcgccgggtcctaaagccgcgcgtctcaaaaggatggtgcgcctggcggccgagctgctgctgctgctggggctgctgctgctcacgctgcacatcaccgtgctgcgcggctcgggagccgccgacgggcccga

SEQ ID NO: 87107 - DNA, 45 bp, Homo sapiens
  chr20:13202742-13202787
  hyper
cctggaggctgcacccggcttccaggtctgcgggctgcgctcctt

SEQ ID NO: 87108 - DNA, 156 bp, Homo sapiens
  chr20:1323452-1323608
  hypo
caggacacccaaacacgtatgcaatgcgtacactggaagttaaggtccatgacgacggggactcttttgtttactattgtgttataggaccttaataaatatttcttcagtgagtcactggaaccacacttacagtatattaaaaatatgcataga

SEQ ID NO: 87109 - DNA, 207 bp, Homo sapiens; identical to SEQ ID NO: 46091
  chr20:13243380-13243587
  hypo

SEQ ID NO: 87110 - DNA, 30 bp, Homo sapiens
  chr20:13641995-13642025
  hypo
ccaagtagaaactctcggatcacagaagta

SEQ ID NO: 87111 - DNA, 30 bp, Homo sapiens
  chr20:1644048-1644078
  hypo
gggaccaggaaggagcgatggaggtgagaa

SEQ ID NO: 87112 - DNA, 142 bp, Homo sapiens; identical to SEQ ID NO: 46092
  chr20:16554594-16554736
  hypo

SEQ ID NO: 87113 - DNA, 142 bp, Homo sapiens; identical to SEQ ID NO: 46093
  chr20:16555036-16555178
  hypo

SEQ ID NO: 87114 - DNA, 91 bp, Homo sapiens
  chr20:1692213-1692304
  hypo
tctaactccaaccagcgcaggaaccgacttggggaggcctgtggaatataaaagtaggagcaacggcgggaagacccgtgaatgcacttcc

SEQ ID NO: 87115 - DNA, 180 bp, Homo sapiens
  chr20:16954966-16955146
  hypo
acctggagcctctgccgctccagaccctggctccctgtcaccactgtcacccgctgctgctgtggggaaggtgcagggtggaaggcaaagctgggtccctgacgctgccatgctccatggagcaggtgggagccagggacaagtgggaaccctcccagagcccgccgtcatggtggccac

SEQ ID NO: 87116 - DNA, 38 bp, Homo sapiens
  chr20:17141814-17141852
  hypo
caaaaaaaaaaaaaaaaaattggcgaaaaaaatgctat

SEQ ID NO: 87117 - DNA, 500 bp, Homo sapiens
  chr20:17206513-17207013
  hyper
tagctttgaaacagtcgtcctcatttcgttacatacagaacgttcgtgcttcctccctctcaggcaagaagcggagtccgtcgtcagcagttagcagagtccagtgcgagtgcacgtttcttaaccggataacttagttgcccctgccccccgtcgctgcgcccgaattcgcctccagtagaagacgttcagcgggcgacttggcccggcgcctgggatcggtggctatgcgttccccaactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatc

SEQ ID NO: 87118 - DNA, 863 bp, Homo sapiens
  chr20:17207260-17208123
  hyper
cggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggggtgggcgggggcgggcccggggcggcccagggcggggcccgccgcttcccccgccctcattggccgctggcggactcacgtcacccgagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccg

SEQ ID NO: 87119 - DNA, 268 bp, Homo sapiens; identical to SEQ ID NO: 37942
  chr20:17208389-17208657
  hyper

SEQ ID NO: 87120 - DNA, 64 bp, Homo sapiens; identical to SEQ ID NO: 13668
  chr20:17208739-17208803
  hyper

SEQ ID NO: 87121 - DNA, 340 bp, Homo sapiens
  chr20:17209295-17209635
  hyper
aagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagag

SEQ ID NO: 87122 - DNA, 194 bp, Homo sapiens
  chr20:17482549-17482743
  hypo
acagggacacatgaacgggtctgaggctgccgctctggagtggcgagctttcatgtgcatggcaaagttgagaaaggtaattatttggagaggaaaagaaatgaagccgaaaggcaaagacaaacagaaattagggagccatggcaagagaaggaagagatggaaaaggagacggagagcggctgcctcagctc

SEQ ID NO: 87123 - DNA, 32 bp, Homo sapiens
  chr20:17511525-17511557
  hyper
gcgtgctcccagccccgcgccgccgggacggc

SEQ ID NO: 87124 - DNA, 30 bp, Homo sapiens
  chr20:17598565-17598595
  hypo
gggcggtaccagatccggtgaggctgggtg

SEQ ID NO: 87125 - DNA, 30 bp, Homo sapiens
  chr20:17674659-17674689
  hypo
agtctctccttgttgcgatgaattggcaga

SEQ ID NO: 87126 - DNA, 30 bp, Homo sapiens; identical to SEQ ID NO: 46095
  chr20:17702368-17702398
  hypo

SEQ ID NO: 87127 - DNA, 985 bp, Homo sapiens; identical to SEQ ID NO: 37870
  chr20:1783321-1784306
  hyper

SEQ ID NO: 87128 - DNA, 39 bp, Homo sapiens; identical to SEQ ID NO: 37945
  chr20:17919829-17919868
  hyper

SEQ ID NO: 87129 - DNA, 18 bp, Homo sapiens
  chr20:17971912-17971930
  hypo
gggcgcagtggctcacgc

SEQ ID NO: 87130 - DNA, 77 bp, Homo sapiens
  chr20:17972170-17972247
  hypo
cagagcgagactccgtttaaaaaaaaaaaaaaaaaaaagcctcctcactaagccctcagccacggtcacctagcaag

SEQ ID NO: 87131 - DNA, 93 bp, Homo sapiens
  chr20:18037359-18037452
  hyper
cggcgtcgccgggctcgggggtttcgctctcgggggcgtgcggggacgagctgctctctgctcctccaggctcccccgcgctgctgctgccgc

SEQ ID NO: 87132 - DNA, 109 bp, Homo sapiens
  chr20:18038494-18038603
  hyper
tcgcgagtgagaccacgccggggaaaaagtttcataaggtggaatagaaaaggcaccaggaaacttgggactgagcatgcgccctgcaacataacggtgtcaacaagct

SEQ ID NO: 87133 - DNA, 289 bp, Homo sapiens; identical to SEQ ID NO: 37946
  chr20:18039647-18039936
  hyper

SEQ ID NO: 87134 - DNA, 175 bp, Homo sapiens
  chr20:18051230-18051405
  hypo
acggagagagacctccgaagcttggagggtgctgtggccaggttcctggtggtcgagccctgtactcagcgagaatggtagttagttactcaggcatcctggacagagatggctgaaacagacaccctcgcaggagtggcctgcactttaatttgagcatcgattcaggacgctt

SEQ ID NO: 87135 - DNA, 76 bp, Homo sapiens
  chr20:18073083-18073159
  hypo
agggggagtgggctccgggtgcccgcagagataacttgcttgataacgcagctttcttttttcttttttttttgag

SEQ ID NO: 87136 - DNA, 30 bp, Homo sapiens
  chr20:18174471-18174501
  hypo
tttcacaattatcaacgttacatttgtcca

SEQ ID NO: 87137 - DNA, 30 bp, Homo sapiens
  chr20:18178355-18178385
  hypo
ctctggacagcttaccgctttcctcccctt

SEQ ID NO: 87138 - DNA, 217 bp, Homo sapiens
  chr20:18233341-18233558
  hypo
ccaggttttgttttccgagtcttggcgtccccagccaaagttcctgggtactggctgccacccatgggagaggggaacacccaccagctccaccccataggacattgctagggccttagtcacctagaaaagccctccacgtatttgcctggttaatgcaacaatagaagggttacgccccagcaactttggtctcctcactcggtcacctcaagaa

SEQ ID NO: 87139 - DNA, 30 bp, Homo sapiens
  chr20:18270495-18270525
  hypo
tcccaggaagctgcccgcagttcttttctc

SEQ ID NO: 87140 - DNA, 208 bp, Homo sapiens; identical to SEQ ID NO: 46097
  chr20:18489646-18489854
  hypo

SEQ ID NO: 87141 - DNA, 165 bp, Homo sapiens
  chr20:1856228-1856393
  hypo
gtgtacgaagagcatcggaccccctggccatctggccgtcccctgaacaagctgtgcactttcctccctccttacctttgctcatgcagtttcttcttccaaaaacccacttccaacaagttcttccagagctctcagggatcctctgcacgcaactcctcctca

SEQ ID NO: 87142 - DNA, 197 bp, Homo sapiens; identical to SEQ ID NO: 46098
  chr20:19080645-19080842
  hypo

SEQ ID NO: 87143 - DNA, 59 bp, Homo sapiens
  chr20:19186737-19186796
  hyper
cagcaggagaattaccgctgccaccagggggcgcaccgccacagcgatcctaggaagag

SEQ ID NO: 87144 - DNA, 957 bp, Homo sapiens
  chr20:19192659-19193616
  hyper
gcctctgggaggcagcgtgtgtgcttcccgagagggggccccctgcgccgtccctcttcccctggcacagaagggttgaaggactgcacacagggatccctccccagcccagtctcctcccagcgcgccccctccccgccatgccggccagcgccgggctgtgtcccaggcactgccccccgccaaccctggcccgaccagcctcgccgctgcaggctgccgggagctgcgctagctcatgctcccagctcgctcggtgctccctgttcgctccggcccggccccggcccccatcgcgccgaccatggaataggcgggcggccccgcgaggcgctcctgcagccggcgaggccagagccagtccggggtggctttgccaaccggcggagttggccagcggcgggccctcctaccgtcggtccttccccgctcctcctcctctgccccctccgcccccgcctcccggccgcccccgccgcccccgccgcgccgccgccccaggccgagcgcgggcgcggagcgtgggagccatggcgcgcgaggaggagcgggaccccgagcgccgggaggcggcggcgcgggcgagcggcgaggaggaggaggagggaggggaggagggactgggcgatagcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccggagggaccttctgctgagccagctctgcttcctggcctcggtggcgctgctgctctggtcgctgtcgagcctgc

SEQ ID NO: 87145 - DNA, 32 bp, Homo sapiens
  chr20:19193883-19193915
  hyper
tgtgcgctgcttactcgcgagctggaggtact

SEQ ID NO: 87146 - DNA, 30 bp, Homo sapiens
  chr20:19402623-19402653
  hypo
agattgtgaggaacacgcctcagcctcaga

SEQ ID NO: 87147 - DNA, 51 bp, Homo sapiens
  chr20:19579962-19580013
  hypo
ccctagactgtcttgcggtccctcccgcgcacctggcggactgcgtgtatg

SEQ ID NO: 87148 - DNA, 40 bp, Homo sapiens; identical to SEQ ID NO: 46099
  chr20:19674013-19674053
  hypo

SEQ ID NO: 87149 - DNA, 182 bp, Homo sapiens
  chr20:19738199-19738381
  hyper
cctggccagcgaggccgaagcaaaacaacccgcccaggcgtccagagcgtatccaaccctggagaacctgccccggaaccaagagccgcagccagctcaggcctctcgagtggggcctttccagcccctgcaacagatcccgggatctgtagttgggcggaggggctcgttatgggaaaggg

SEQ ID NO: 87150 - DNA, 151 bp, Homo sapiens
  chr20:19739010-19739161
  hyper
cgcacctagagagcccggagaggctccgggcacgggcggggctctctggggttccagacgtgggtgctgctgtgcgcactctctccctactccggaggggacttgaggaagacagccagagcgcgtcctcggggatcgtggggaacggaag

SEQ ID NO: 87151 - DNA, 135 bp, Homo sapiens
  chr20:19739431-19739566
  hyper
cgcgggtcagacccggtgtcgcacagctttgatccccagcgcggaccccactggtgagtccagccagtgtgcagggcagatgctccgaccggagatttcctcccccgggtggaaaagcaggagggttgttgtgtc

SEQ ID NO: 87152 - DNA, 174 bp, Homo sapiens; identical to SEQ ID NO: 37950
  chr20:19739612-19739786
  hyper

SEQ ID NO: 87153 - DNA, 47 bp, Homo sapiens
  chr20:19928306-19928353
  hypo
agtctaggagattcccggaaaccttcagggaacgagccctcaggctt

SEQ ID NO: 87154 - DNA, 30 bp, Homo sapiens; identical to SEQ ID NO: 46101
  chr20:19961658-19961688
  hypo

SEQ ID NO: 87155 - DNA, 32 bp, Homo sapiens
  chr20:2002327-2002359
  hypo
agtgctgggattacagacgtgagccaccacgc

SEQ ID NO: 87156 - DNA, 30 bp, Homo sapiens
  chr20:20321098-20321128
  hypo
tggagggccagagctcgtgacagaccacag

SEQ ID NO: 87157 - DNA, 99 bp, Homo sapiens
  chr20:20321680-20321779
  hypo
tttccttcccctgtgcgcacacacaacatccataaacagtaataagggcagctagctcacatccagaggagagcaaagcccacccgagcgacgtggctt

SEQ ID NO: 87158 - DNA, 30 bp, Homo sapiens
  chr20:20343755-20343785
  hyper
aaataaaataacacacgttggcctgtgggg

SEQ ID NO: 87159 - DNA, 1302 bp, Homo sapiens
  chr20:20344329-20345631
  hyper
accccatagcaagaacgctcgccagggtagaaagtatgcccttgtggaccccaggagtctggctgcctcttcgtcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcgataccctctgcggggtgagaatgcgggcccgcccggctcctcccgtgaggccagggcctcctgttctcctagacaccccaaggagccaactcctccgcagaagttccccgcttctgctcttatttccaagcttcgcgctttctacaaactccctgttgccttgactttgatttccagccgtggtgagggtcagagtgaaccc

SEQ ID NO: 87160 - DNA, 10 bp, Homo sapiens
  chr20:20346166-20346176
  hyper
gggtggtgaa

SEQ ID NO: 87161 - DNA, 464 bp, Homo sapiens
  chr20:20347246-20347710
  hyper
ccttttgtgtttcctcggggctgggctggacagaggatggaggcaggcggcccagtctgggtccaaacggaacggcagcggaggtgggggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgca

SEQ ID NO: 87162 - DNA, 486 bp, Homo sapiens; identical to SEQ ID NO: 1427
  chr20:20347736-20348222
  hyper

SEQ ID NO: 87163 - DNA, 2493 bp, Homo sapiens
  chr20:20348257-20350750
  hyper
cggctccggctcgcggattgaaccctcctgacatatttggggccattcttctcctttgttgctattttgctagcgacccgcgggtaatccccgcgcgggaggggggcgtgcattgtcgcgctgatggacgggcccatttggcggctccgcgccccccggaggagagacacaaagcccaggcacgtgcgcctccccatagagaagcagcagaccgtgaagggaggcggggccgggcgtgtgcctggaccgggcggggcggcggcgccgggcggggcgaccaggggcgcgcgcgggggccccgcgccctcaggtacatctgccgcacctaccgggcgacccccgagtcccggcccccttttggccgccccatcgccctcccaccctgccaggctgaggagctgcggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcct

SEQ ID NO: 87164 - DNA, 202 bp, Homo sapiens
  chr20:20367287-20367489
  hypo
catggtcttccagagcgtggccgacctgcctgggcatcacatcaagcatgaaaaacctgctttggctacctgctcttacctcaaagtctatttttcagagttgaagacgagcaatttttctttccagaggttccagtccatggcttctggagccagagagaggttaactccagcgttttcgtctctgcgtgtagggagagta

SEQ ID NO: 87165 - DNA, 142 bp, Homo sapiens
  chr20:20376831-20376973
  hypo
cccgcagcttttgtccgcttttccttccccagctgttccattcagcagcccccgccacaacctgccctccccgcatggaggtctcagaggcctccattaaggctggcggtcaaaggccggcccagcacgtgccgtgtcttat

SEQ ID NO: 87166 - DNA, 191 bp, Homo sapiens
  chr20:20377191-20377382
  hypo
tgtgggcagggcccccggggaggggaaggcccaggagggcgaggagcactgatgcagggtccgctaccgagggcagccgattagaaaagtcccaccccctccccaaagcagggtggctggacaaatccactgaagtgtctgtcttaccttgctcaaatattgaaatgagacctttacgtgttttaatctga

SEQ ID NO: 87167 - DNA, 80 bp, Homo sapiens
  chr20:20421118-20421198
  hypo
ggctcactgctggttcgttcttgggccagtcttattttctttcatcctaattgcgcagacagcatcggagctttgtcagc

SEQ ID NO: 87168 - DNA, 120 bp, Homo sapiens
  chr20:2058784-2058904
  hypo
cctgtgtacacataatttaattttcacaacaatgctataagatggttctattactgggttggagtatacttcttcaaatgaaattctgtgtcaaaactgacctgtgaaagacctcaggtg

SEQ ID NO: 87169 - DNA, 32 bp, Homo sapiens; identical to SEQ ID NO: 46105
  chr20:20914015-20914047
  hypo

SEQ ID NO: 87170 - DNA, 30 bp, Homo sapiens
  chr20:20952267-20952297
  hypo
tagatttctgcagctcgctggccagaacca

SEQ ID NO: 87171 - DNA, 395 bp, Homo sapiens
  chr20:21080562-21080957
  hyper
cccctctctggcagccgcggagacaaaggtctccaggaataattggagatgtgcatggaatattaaattaatttactgctcttaattcttatgcaaattctgacctccgatggcgcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagc

SEQ ID NO: 87172 - DNA, 817 bp, Homo sapiens; identical to SEQ ID NO: 1430
  chr20:21081028-21081845
  hyper

SEQ ID NO: 87173 - DNA, 30 bp, Homo sapiens; identical to SEQ ID NO: 1431
  chr20:21082094-21082124
  hyper

SEQ ID NO: 87174 - DNA, 2255 bp, Homo sapiens
  chr20:21082215-21084470
  hyper
cgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatcctgccccttggcacagaagaacggagaaccaaggagttaattcctattttataagaaaaaaaaaaaaaaaaaggagggggagagaggaagggagtggatggcccccactgagcggaacaattgtcactcagttgaacagtgtcaattaacaaaccgcagctctggcagacttcaaaaggcttgattctttttgaaatgtctgtggtgatgggtgtgcagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtggctggggctgtgcattttaattccaaagtcaagaggttgaaccatctcaaagttggcgggtggagggggcggtggcagggaactagatggctggatgcctttgcctgcggggtggcagggctgtccctaccaatagccacggctcggggctggctttgtagttatttttccaagttctgcccggtgcccatcatattgccctgaaaagcaaaagaggccgatgcaatttattccaatgggcggtttttaagaagctggcaatttgaaccggctgggtgttatttagtgcaatatgaaatcaaatgatcctatttctcaaataacagtgtctgtgaggagaagtgaatcctctgaaagggtaattgtctgctgatggtgtttcccattatacccgatcttggcctaaatggtgttcggcagcggggcggagagcgaggggtgaaatcaatgtgcgccaactcgcgctctggagacaggaaaaggtagcaccgctggcgtcctggcacgtcgagcgaacaatgccaccccacgcgtcactgatcgactcatcttgcag

SEQ ID NO: 87175 - DNA, 43 bp, Homo sapiens
  chr20:21085668-21085711
  hyper
tctaggaggaaggttcggccactgcacctggagcccgaagcac

SEQ ID NO: 87176 - DNA, 385 bp, Homo sapiens
  chr20:21085767-21086152
  hyper
cgggcagcctgggttcagcccaccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 87177 - DNA, 488 bp, Homo sapiens
  chr20:21086194-21086682
  hyper
cgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatccactccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatccagagagagactcagaggggcgccccttccccccaggggtctccgaatcctagggact

SEQ ID NO: 87178 - DNA, 282 bp, Homo sapiens; identical to SEQ ID NO: 37964
  chr20:21086906-21087188
  hyper

SEQ ID NO: 87179 - DNA, 147 bp, Homo sapiens; identical to SEQ ID NO: 5237
  chr20:2113428-2113575
  hypo

SEQ ID NO: 87180 - DNA, 111 bp, Homo sapiens
  chr20:21372082-21372193
  hyper
cgggccgggtgaggccggggtccctgcactcctttgctgggcgcgcctggaccgaactgaagggcccgggcgccgcgacctcgcagccgggggcgggatggtggcggcgcc

SEQ ID NO: 87181 - DNA, 437 bp, Homo sapiens; identical to SEQ ID NO: 37966
  chr20:21372294-21372731
  hyper

SEQ ID NO: 87182 - DNA, 130 bp, Homo sapiens; identical to SEQ ID NO: 1436
  chr20:21376207-21376337
  hyper

SEQ ID NO: 87183 - DNA, 32 bp, Homo sapiens; identical to SEQ ID NO: 1437
  chr20:21376702-21376734
  hyper

SEQ ID NO: 87184 - DNA, 253 bp, Homo sapiens; identical to SEQ ID NO: 1438
  chr20:21376876-21377129
  hyper

SEQ ID NO: 87185 - DNA, 168 bp, Homo sapiens; identical to SEQ ID NO: 1439
  chr20:21377473-21377641
  hyper

SEQ ID NO: 87186 - DNA, 920 bp, Homo sapiens; identical to SEQ ID NO: 37971
  chr20:21377737-21378657
  hyper

SEQ ID NO: 87187 - DNA, 743 bp, Homo sapiens
  chr20:21485917-21486660
  hyper
gtgtagaggacacctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccct

SEQ ID NO: 87188 - DNA, 132 bp, Homo sapiens; identical to SEQ ID NO: 4760
  chr20:21486785-21486917
  hyper

SEQ ID NO: 87189 - DNA, 322 bp, Homo sapiens
  chr20:21486954-21487276
  hyper
cgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagc

SEQ ID NO: 87190 - DNA, 338 bp, Homo sapiens
  chr20:21487336-21487674
  hyper
tgtgtctcggggcgttggtgaaagcaataaaactcagatcgcttccttggcgagatagcggcggctataatgcgccggggggatcaggggtttatttgcagatcctggataaaagatgatatatcgacacggtttagagtgtcactgcgcttggcctctcagggagccacaagtacatatttcctgaaataccgcccagcacagtatctaatccgcccgccacttaacaccgggaggggaacttcagcagcgcacaagcgcgctcccggtttcctggttctgggtggggagagcccaaatgagaaggatctggtatgcctagacgccccctcccctgg

SEQ ID NO: 87191 - DNA, 356 bp, Homo sapiens; identical to SEQ ID NO: 37975
  chr20:21488158-21488514
  hyper

SEQ ID NO: 87192 - DNA, 206 bp, Homo sapiens; identical to SEQ ID NO: 37976
  chr20:21488591-21488797
  hyper

SEQ ID NO: 87193 - DNA, 161 bp, Homo sapiens
  chr20:21488998-21489159
  hyper
caactttcagtgtcacggggcctaggcggggcaagcgccctccgaagccatcaaagacaggggtggctttttctcccctcctccagcctcctccccaatagatatagcacgaatttttaatgcgtcttcctttcacagacaacaatacagggtttgaaagc

SEQ ID NO: 87194 - DNA, 208 bp, Homo sapiens
  chr20:21489239-21489447
  hyper
cgtggatgacaaagggacccagtgacaggcccaacaaaaccccaaggagacttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctc

SEQ ID NO: 87195 - DNA, 155 bp, Homo sapiens
  chr20:21489621-21489776
  hyper
cgggcgccgggtccacctcccgggctcccggccggccacaggagcgcacacccagattgcaggcccgcggtcctggccacagctccaaatttgtcctcaatgagcaagtggtggaagcctgccagggtgaggaccttccacgcttcccccttcct

SEQ ID NO: 87196 - DNA, 588 bp, Homo sapiens; identical to SEQ ID NO: 37980
  chr20:21490175-21490763
  hyper

SEQ ID NO: 87197 - DNA, 532 bp, Homo sapiens; identical to SEQ ID NO: 37981
  chr20:21490814-21491346
  hyper

SEQ ID NO: 87198 - DNA, 107 bp, Homo sapiens; identical to SEQ ID NO: 37982
  chr20:21491616-21491723
  hyper

SEQ ID NO: 87199 - DNA, 18 bp, Homo sapiens
  chr20:21491742-21491760
  hyper
cgccgaatagctgagctc

SEQ ID NO: 87200 - DNA, 102 bp, Homo sapiens
  chr20:21492308-21492410
  hyper
cggcgtagagttcagccctctcccaaggttcagaaggagaggcatgggcagagctgggtgggtggaatctgccactccaaggagacgcaggcaacctcccgg

SEQ ID NO: 87201 - DNA, 319 bp, Homo sapiens; identical to SEQ ID NO: 1445
  chr20:21492507-21492826
  hyper

SEQ ID NO: 87202 - DNA, 111 bp, Homo sapiens; identical to SEQ ID NO: 37984
  chr20:21492990-21493101
  hyper

SEQ ID NO: 87203 - DNA, 892 bp, Homo sapiens; identical to SEQ ID NO: 37985
  chr20:21493102-21493994
  hyper

SEQ ID NO: 87204 - DNA, 895 bp, Homo sapiens
  chr20:21494360-21495255
  hyper
cgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaagaaagagggagggagggggagcgagagagggagcgggagaagggtggaaaaaagggggaagagacattaaaaacgcaaaggttggccacgtgtgggcgggtcttgggagtcaagtggatgaagacagtatttgcagatgtgaaattgtgggttttggggagctccgcgctcccagccaacggccctctagagcaagatgagaggtgtaacgtgtcaattaattgcaaagacggggcgagcctttttttttttaaacccagtatttacatacaaagggccaccgcgtcgctcgcgagtccacacacttgaaagggccgttttaacaaattgcatcttaaaaaaggtgggggtggggaggaggaggggagaaaacaaaacagaaaccaggaggagggaaaaaatcctctttaacattcaccggttcctacctccccgcccccgcgcgcccacccccggca

SEQ ID NO: 87205 - DNA, 816 bp, Homo sapiens
  chr20:21495662-21496478
  hyper
tcactttctgctttgcgggcggtcccggggagggcggggtaagagtgaggagctccaacttcgtctggggtcggaccctggccctgctgcctctgggctctgcgggcctctttccccgggtggaggaaagggcagacggccctgctctttcctgccctctattatccctccctctccggccccctccctctccagcctctggctagaggtggagcagcgggaaggcggcggggcgggattgcgggggtgggggtgggggttgtgtctccagcctgggtgaagacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccag

SEQ ID NO: 87206 - DNA, 2332 bp, Homo sapiens
  chr20:21496683-21499015
  hyper
cgctcccgttggaagcctttgtcccggctcggtttttgcatttatttcagtggcgaaataatacatgattgacgctctctttcaatgtgtcctaactgtttggaataaatctaaggttgttcctagttgtcatggcattcaacccttttcaatggactatctcttcattcatttctgaatccgtccacaatattaaggaaaccccttcatgtcgacgctccccgattcctctttctcctcctactttttcttttctcctttctccccctccttccccccttttttcccctggaagaattagaaacttgtttgaatcgtcttcctcgaacccattacttttcgtgctttttttttttttttgctcgctttccgtctctgtctttctcagcgccccccctcctccgccctttcacgtgggagctcgtcgctctgccccgtcggaggagggaagttggttctccaggagtcggggaagcgtcgagtttggatccaggggcgggagtgggcctgccactgctattgttactcagctgctaaataaataactggagagaaaaaaagttcctcaacccaagcgttgcagcaaagaccctccttttgttcctcctcttattcctcagtcctaagggggtggaggctgtcttggggtccagggcagccactaggttggggacccagaataggatctggttgggccaggcaaattcttgggtcaggtggcaaaggggtctttggcagcaagtgtcgtttctcgcatatccccagagccctcttaggtgggggagtgcccgcagaggcctcccaaagcgtgttcatttcttcagctgggaaccacctcgctgaagttccatgtagttcccaacttctctcccccttccccagcatagtgaccctttcttctcaggatctaaatcagcaccgctgctattgatcaagtcccctcccctcacccgtgggagcctgcaaggtccgcagagcgcctgagagaggattgctttcctaggggaatcctggctcctggaattaatcacggggagggagtgctgccataggcgcctagagaaggaggccctcagcccagttctcaaaggtcgggtttgcctttgcgcctgccccttagcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcgtccatttccagagcgttaacatttgcaattgaaaaggcgctgggagaccgctgggaggtccgtaattgaaggggagaaactgggcttgttagtggaagatcataaaatgcaagtcccccaggagcggcctgtggacgccgggaggcctgcgcaggcccagctggcggccagggcaagtccggtgcccagagcacagtccagtgtctcctcaatttcttgggcccggcttgcgcccaaagagcctaggggccaggcgccaaacgcaccttttctgtcccaattaaacaggtgattgcatcctgaggactccccaagaggcctccccgagagtaccacagctaggccttctagagcccaggagctttggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatcagcattggggctccagattccgtacacatctctagctctattcattcttcctaggttgagaacggacgcattgggagtcct

SEQ ID NO: 87207 - DNA, 374 bp, Homo sapiens
  chr20:21499224-21499598
  hyper
agtggccctctaagtcggctcagtgtttacctgtttactttcccaggtagctcaaacacgagcgccttttctgcgctccagggcacgggggccgcccagaggcaccctgctttcccggcttctgccctcccacgcctcagctttacgccccctgttgtgggggtgcgctctaaacaacagcaaaccaggcaagaaaggaagatacaggagagcaggcgaggcctcggcacaccctacggaggggagcctttcttgtgcctgtggaagaagtgggctccgtggacggcatccgaccctccccccatccctgttctgggcacctctttggagacggcgctcgcatccttccccgttcaagccggtggtgaaagctt

SEQ ID NO: 87208 - DNA, 247 bp, Homo sapiens; identical to SEQ ID NO: 37992
  chr20:21500104-21500351
  hyper

SEQ ID NO: 87209 - DNA, 701 bp, Homo sapiens; identical to SEQ ID NO: 37993
  chr20:21501444-21502145
  hyper

SEQ ID NO: 87210 - DNA, 257 bp, Homo sapiens; identical to SEQ ID NO: 1449
  chr20:21502443-21502700
  hyper

SEQ ID NO: 87211 - DNA, 337 bp, Homo sapiens
  chr20:21502837-21503174
  hyper
cgcacttgcccacctgctgcgtccggactacgcggcttggggatcgagccgagtcaggacccgggagagcgaggggctcataaccggggtccgccgtgaacccgagctccggcgccgctcggcggcgacgacggtgccccgagacccctctctgctggcaggccgcggtgaccgtgcccggagcgcgttcccgcgccgggcggctgtggcaggaggaccagacagtcagcgcctggcagcgagggcgacgccgggcttcctccatcgccaccgccgggctccgctgcggctcccgggctccgccgggtgccccgcgccatccccatcccgcgttcac

SEQ ID NO: 87212 - DNA, 324 bp, Homo sapiens
  chr20:21503574-21503898
  hyper
acatggtaggctttgcggggagggggcttccaccccgcctcggccccctgcccccaaacgcgcgggtagattccctccctcctgcgcccctctgagcaggagatctgggaccccaggtttctcctgaccctcgcccctcctccgtccccagcagtgccttggactccgcagctcctggcgagcccggactgctggttaacaaggtcgccatctataaattgctcggtcgctaagacgccataaaaccaaagggccagatgtggcacgttatttatgtgtgaaaccgcgtttacactagatacgcggatccaaggccgatagcac

SEQ ID NO: 87213 - DNA, 105 bp, Homo sapiens
  chr20:21503899-21504004
  hyper
acttcgcgggaggtcacagacctctcgccccggctccaggctcctcccccagcacgatctcctctccaggttgaggggtgtcggtcttgccgggaaagggattca

SEQ ID NO: 87214 - DNA, 30 bp, Homo sapiens
  chr20:21504416-21504446
  hyper
aggcagccctggcctcggaatatggaatcc

SEQ ID NO: 87215 - DNA, 17 bp, Homo sapiens
  chr20:21651132-21651149
  hypo
aaaccagctgcaggccg

SEQ ID NO: 87216 - DNA, 74 bp, Homo sapiens
  chr20:21682255-21682329
  hyper
gacgctctgaccttgcgctccgaggcggcgctcacaggcgccaattcagaatctagtcttcctctccccttcct

SEQ ID NO: 87217 - DNA, 158 bp, Homo sapiens
  chr20:21682361-21682519
  hyper
cgcggagtttcgttgtgttgttacacaagccagcttttggtttgttagttgttcgcattcccccagggtttgcagctccccgatctggctcagctcttcttcccatagtttctttgcagctagcagctcctcatttctcttttcgtcaattttcttct

SEQ ID NO: 87218 - DNA, 46 bp, Homo sapiens
  chr20:21682946-21682992
  hyper
ccctctgttacttcccgcaagaaccgaaatgcgcacctgtatgccc

SEQ ID NO: 87219 - DNA, 461 bp, Homo sapiens
  chr20:21683311-21683772
  hyper
ctcctttttgactcccgctttcggcaaagagtttacctctctttcttttcctgccttgggaaaactgggcgagggcccgaagcctctggggtaccctcagatccatcctctgccctgctaggagtccagccccaggcggaggagttttgccccaggtttctgagtgcgccctcagctaacaggctcccgcgaccctggaagcggaactttgttgcactccgcttccagaggacgctgaaatacggtgccaaacccagccaagcaaaaacgcagaatccgcgagctctttacctctgtgcgctcagcgctgactagtagctgtccccgggccatggagagggctaagctgcctccttgggaggtgggagagacgtttcttttccttctgcaatctcatcttagggccatctctcaccaagcctagcctgcagctcgggaacccgcgatacccggccggggga

SEQ ID NO: 87220 - DNA, 311 bp, Homo sapiens
  chr20:21683899-21684210
  hyper
cgcggactctgctaccggggagaaccaccccctctcatcgtgcgcaatccccagactcacccctctacagtagcccccagccacgggcggccttcacggggacgggggcggagttttgtcctggactgcgactccttgccacttttccaagctcggcagcagaggtggggtggacgttcccctgaaagggtagttgggcgaaccagctctcacggtgtcacgaccggctttatttcctcgtctttagagtgtgcctgttgactcctcacctactggggggaagaagcggctttagctgcttttccggatca

SEQ ID NO: 87221 - DNA, 86 bp, Homo sapiens
  chr20:21684347-21684433
  hyper
cgtccccactccccgcacccccggagccccgagcatactgtgcgtgcttagtcctctcttcgctgccttcgcggaactcctggctt

SEQ ID NO: 87222 - DNA, 30 bp, Homo sapiens; identical to SEQ ID NO: 38003
  chr20:21685666-21685696
  hyper

SEQ ID NO: 87223 - DNA, 109 bp, Homo sapiens; identical to SEQ ID NO: 4780
  chr20:21686184-21686293
  hyper

SEQ ID NO: 87224 - DNA, 448 bp, Homo sapiens
  chr20:21686294-21686742
  hyper
tcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcgacccagtcctggg

SEQ ID NO: 87225 - DNA, 420 bp, Homo sapiens
  chr20:21686963-21687383
  hyper
tcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgac

SEQ ID NO: 87226 - DNA, 56 bp, Homo sapiens
  chr20:21687755-21687811
  hyper
cgggcaggcttgcaggagaggactcacactcgctctcctcccgggaccggttctgg

SEQ ID NO: 87227 - DNA, 30 bp, Homo sapiens
  chr20:21689196-21689226
  hyper
ggccctggctgggagcgaaggcaccgctta

SEQ ID NO: 87228 - DNA, 149 bp, Homo sapiens; identical to SEQ ID NO: 38008
  chr20:21689912-21690061
  hyper

SEQ ID NO: 87229 - DNA, 45 bp, Homo sapiens
  chr20:21693467-21693512
  hyper
atcccttcccagacccgtgcctcccctcagcggtggtctcagagt

SEQ ID NO: 87230 - DNA, 141 bp, Homo sapiens; identical to SEQ ID NO: 38010
  chr20:21694434-21694575
  hyper

SEQ ID NO: 87231 - DNA, 322 bp, Homo sapiens
  chr20:21694952-21695274
  hyper
ggggtctctggagagcgcgagtctctgcttcactcttccagagccttcaagggttgagcgctcacgacctcgctctgcaggcgtcctgagtcccagtgcctctcgcactgcgcggcgctaggtagtgatccgacgcctctgtgcttcctcccgcagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccc

SEQ ID NO: 87232 - DNA, 261 bp, Homo sapiens
  chr20:21748255-21748516
  hyper
ggtgtgtgtccaggccgtgctcagctagcatgactgctgcatgttgcacactttttgtgctttttacttttaatgcctgtaagaaagcaactcattttcttcatttgatgtgattaatgggtgtccctcggagaggccgcacccgggagaaagcgctgacgcctccgacccagctccgcgcacagcggcgcccccttctggccctcgtcccgccggagctgcgcttgcgtgaacagccctcaaatgcgtgtttgccctgct

SEQ ID NO: 87233 - DNA, 323 bp, Homo sapiens
  chr20:2187713-2188036
  hyper
ggggcaggagagtggcgacggcgaggagcaactgcacgcgacttgggaccttgccctgccccgcggcccgcgtcaccatggcaactgcaggcagccagcaccgacggcgggaaaacgaggaccggagccgcgttacagccttggccttcgagcagcccagggagagtctctgcgtcctccagcccccgcttcccttcatgtcggaggtcctaagcccgcagcgaagtccgcaaagagctttccccgacgcctacgagaccggaagtgcctgggcccaggtggaggaaggacccgcgtggccgcctccgcgctctccctggggt

SEQ ID NO: 87234 - DNA, 233 bp, Homo sapiens
  chr20:22356457-22356690
  hypo
ggcctgagtaagctccgtgagccatcataagctgccaacctttagctgcacaagagaaatgaactctgtaggggacatatccaattccgatttaaatttaatctgtgtggtcaattatttgtgtaataatggaggaaaataaagtctatttcacaaaagtcaactctgtaattttagagcctttaagacatttgaaaatgccttgtgcaattatgtggcgcttaatactcaga

SEQ ID NO: 87235 - DNA, 887 bp, Homo sapiens
  chr20:22557396-22558283
  hyper
aagctggggagaaggcgggcgataaagattgggcgtttaaattggccatttggaagattacatctcttcagcgagggtctttctttcaaaactcgcactgaattaagggtcatggctactccgtacccggctctcaaaggcacggcacctttgaattaggttgcggagtggcctgggcgaggggacccggggccatcaaaggcccgagggaaggccgtggggcgacacccgtctaatgacaagtaattgaaggattcgacgccgcgcattaccagcggaacgggaggcattaattatttaaaaacgattagccttgccgtgtgtcctgcaggcgtcccatcatgttcagcgaagataaccagccacccgaggcgagccggggctcggagggcggcgggcgcgctccccagcaggcttcgggtgcggtggacacgggcgcacagcccaaggcaccagggaaggagaggaggggccaccaagggtccccacacaggaaggtgactacataacactgaccctgctgaacaacgaaacagatttctgcccacttgggttcgaagtctggtgactgcggcgcagatgggaaaagctttccggtcgggggtggtgggcaatttccatgtgccagttccctgtcgcatcagaccaaagacccaaagtaacccagccaggcacgggcctctcacagtgcctgctacccaggcgtttaaagaaaagaccccagagagaatgtggatctggcgtgggggcagggattgggggggggcgctggtagacacctggggaaatacaactttatgaggtttcaaggggcagcagcagaactactatttttccgaggtccacgcctttccgcaggcggcggaaagacgcggctggttctgttg

SEQ ID NO: 87236 - DNA, 155 bp, Homo sapiens
  chr20:22558541-22558696
  hyper
cgcctcttagaaaggcgcggcccctcccctgctgctgcttgatgacgatccccatcgtctcctcggcctgcctgtgtccgagaaagagttgagactggactcgaacccctgcgcgccaaggggagggcgtcaccatgctccggcctcagcctctt

SEQ ID NO: 87237 - DNA, 187 bp, Homo sapiens
  chr20:22559055-22559242
  hyper
tggctgggggaggggcggtgagcggacaggagtggggtgcggacgctgaggaggggagccgggcgcggtccccgggtgggcgcgctccctacctgcggcggccggcgggccggctggcgggcgggctgcggagcgtccagctcgcggagggaggaggccgactgctccgagccgaggcatccccgca

SEQ ID NO: 87238 - DNA, 54 bp, Homo sapiens
  chr20:22559622-22559676
  hyper
tagagttggggaaagcgcgcagtggcgatttgtgagctcgttatctcggaaccc

SEQ ID NO: 87239 - DNA, 95 bp, Homo sapiens
  chr20:22559677-22559772
  hyper
ggctaggggagggatttaagcgggaggggggcgtgaaagacacaagaagcacagaaaagcctccgaaagcgcctgctccccgacatcctttttat

SEQ ID NO: 87240 - DNA, 169 bp, Homo sapiens; identical to SEQ ID NO: 38018
  chr20:22559973-22560142
  hyper

SEQ ID NO: 87241 - DNA, 171 bp, Homo sapiens
  chr20:22560380-22560551
  hyper
tagcctccaggctttcggagtgtttttacccaccgcaagccactgcgcgcgggagtggctcccaagtctgcctgacccgcgacgacactgatcctgccctcgcccagccagcagatgtcctgggcaaaaccaacaccagactcccctttgcgctgtcggccttggttttca

SEQ ID NO: 87242 - DNA, 318 bp, Homo sapiens
  chr20:22562568-22562886
  hyper
cgttttgttcgtgaccgggcccatggccaagctgccaggcatgggggaaccgtagccggggtagtgcatcacctgttcgtaggccttgaggtccattttgtggggttggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccgg

SEQ ID NO: 87243 - DNA, 30 bp, Homo sapiens
  chr20:22563764-22563794
  hyper
cgttcatgttgctcacggaggagtagccct

SEQ ID NO: 87244 - DNA, 34 bp, Homo sapiens
  chr20:22564154-22564188
  hyper
gaggcccgaagtccccggacgccacctccggtcg

SEQ ID NO: 87245 - DNA, 30 bp, Homo sapiens
  chr20:22565429-22565459
  hyper
tccaatccccagacccggggcagcccattt

SEQ ID NO: 87246 - DNA, 254 bp, Homo sapiens
  chr20:22565952-22566206
  hyper
gttacagttcagacccggaacggcctcgggagaagcgcggggcgcacggtctggccgcctcggctctccgactcctcagacaccggccgccagggacccgcagtggggcggccggcgcctggcgcaagcagcccctctagcagcggccgacggttgggaggctgagatttgtctctgatattcaggccggcgtgtttcaaggttacttttcagtcacaaccgaggtgcccacagcatttcgtaactaaaacaaa

SEQ ID NO: 87247 - DNA, 211 bp, Homo sapiens; identical to SEQ ID NO: 38021
  chr20:22567354-22567565
  hyper

SEQ ID NO: 87248 - DNA, 163 bp, Homo sapiens
  chr20:22567605-22567768
  hyper
cgccttcggggggactcggcctttttggagccccaacccctaggttctgcgcgaacccaaaacggcctcctgcaccctggcgaggttctgggagctccggtagggtagggctggatgacgcctcctagagtctcggagcagccgctcccgcaccctcccggca

SEQ ID NO: 87249 - DNA, 73 bp, Homo sapiens
  chr20:22634183-22634256
  hypo
ttaagtaagatccagcgctaagaattcgatttcatgttttcaagagaattcatacacgcggctcataaattct

SEQ ID NO: 87250 - DNA, 23 bp, Homo sapiens
  chr20:22656661-22656684
  hypo
gcgcccggcgggtctggccatgc

SEQ ID NO: 87251 - DNA, 30 bp, Homo sapiens
  chr20:23015837-23015867
  hyper
gggcggggccggagacgactccagggctgg

SEQ ID NO: 87252 - DNA, 229 bp, Homo sapiens
  chr20:23029003-23029232
  hyper
gctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcc

SEQ ID NO: 87253 - DNA, 498 bp, Homo sapiens
  chr20:23029588-23030086
  hyper
cggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtg

SEQ ID NO: 87254 - DNA, 195 bp, Homo sapiens
  chr20:23030291-23030486
  hyper
cgaggcagcctctgacatgcggatcggccagggctcgagtttataagtgcccggccctccctccctggacgttcgggaaaaggaaggaagtgcctggtgggaagggctgatgccgcatactcggattgctgggttctctggccgcccttgcgcccgccctcgcgcatgggatcacctcgccgggatgagtaaacc

SEQ ID NO: 87255 - DNA, 888 bp, Homo sapiens
  chr20:23030745-23031633
  hyper
acaggacctgcaagacgctgggaggggtgatcggcaccaagggcactttgggaggacctgcctaggacgtggacttccccgaagacaggatcgcaaggagagacagctggatcctgtccgcggccaaggtgcctggctcaggaaaccagcggagcgcgcttggcctcacaggacagtgggtgtggctggggtgacggggcagggtggggaagactggcctaacaccagcgccctctgccccatggctggccagggacccgcgagtccctggacacgcactggccaacgccagaccccatctcatcgggtggggaagtcgcggggacactgtcagggcgccgaagtccggacccggctcagaggcggtggcaggtgaattgctgcggcgccgggtaggggcgggcgcgtgggagcgagtcagcctggccagtttcggcccagcttccgaaggatggtgcttcttgcaccccaacagagtggctggcaaccccccaggggagcgcgcaggatcccagctgatcccacccgggtcggctaaggaggtttccatttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctactgtcctcacaacgagcgccagggggcggcgctgtcgagctctaaacaaagccaaggaagttggagaagtttcgggctaaaaagggt

SEQ ID NO: 87256 - DNA, 30 bp, Homo sapiens
  chr20:23031922-23031952
  hyper
cagagagcctccaaacgtcccgctgagttg

SEQ ID NO: 87257 - DNA, 45 bp, Homo sapiens
  chr20:23092381-23092426
  hypo
aactggctgggttctcgaaggcgttgttatcgccctgtgctcaca

SEQ ID NO: 87258 - DNA, 17 bp, Homo sapiens
  chr20:23114731-23114748
  hypo
gggcgcggtggctcacg

SEQ ID NO: 87259 - DNA, 107 bp, Homo sapiens
  chr20:23117794-23117901
  hypo
cagcagaggggcctacggctgggactgtgggaacagggaagctgcacccagggcttcacccacaggcaccatcgcttactctgcctggctcgcgggtcggtgaaggg

SEQ ID NO: 87260 - DNA, 85 bp, Homo sapiens
  chr20:23138452-23138537
  hypo
cacgcgtgagccaccgcgcccggcctcctagtgtcttctgagtcttccaagggttgggcaattttccctccggtcatggagctga

SEQ ID NO: 87261 - DNA, 397 bp, Homo sapiens
  chr20:23618248-23618645
  hyper
gcacgcacctgcttgcgggcgcgcaccacctgcagcgcgcggctgtggtacatgtcgttgctggctttgttgtactcgccgacggcaaagtccagtgcacgccgcacaccctcctcctccacgctggcgtccatggggcctcccactaggcgcggcggcttgccgggactggagccggccgcggggctcacggccagggccacggccaggatggccagcaggagcagcggggcgcgcaggggcccggccatggtcggctaggacgcgggacgcggggagtggggcgcaggcgagaggctggagctagatagagaggacccgctgcgataccgaggcgaggccgtgagccccgcgaggccggcgactgcggttttatcccttccggccttcgccgccc

SEQ ID NO: 87262 - DNA, 83 bp, Homo sapiens
  chr20:23969237-23969320
  hypo
gcgggtacctggctgcgcttattaatccgttaagctcactctgtcaccggcgccattaagtgctcacgcgcccactccctcag

SEQ ID NO: 87263 - DNA, 30 bp, Homo sapiens
  chr20:2398195-2398225
  hypo
ccgtgaggctggggccgcaagaaggtaagt

SEQ ID NO: 87264 - DNA, 99 bp, Homo sapiens
  chr20:244370-244469
  hypo
cacggctgtgaaccccggcctccctgtgttcttgtgggtgctgggagcaggcaggggtcctgcacttttgggtgcagctgcaggcgcccaaaccatggc

SEQ ID NO: 87265 - DNA, 41 bp, Homo sapiens; identical to SEQ ID NO: 46074
  chr20:2444391-2444432
  hypo

SEQ ID NO: 87266 - DNA, 102 bp, Homo sapiens; identical to SEQ ID NO: 38030
  chr20:24449601-24449703
  hyper

SEQ ID NO: 87267 - DNA, 945 bp, Homo sapiens; identical to SEQ ID NO: 38031
  chr20:24449759-24450704
  hyper

SEQ ID NO: 87268 - DNA, 265 bp, Homo sapiens; identical to SEQ ID NO: 38032
  chr20:24450819-24451084
  hyper

SEQ ID NO: 87269 - DNA, 1100 bp, Homo sapiens
  chr20:24451085-24452185
  hyper
cgacagcctgcagccctgggagccacagccctggcgccgagatgggagcgagcacatacgcttttttggttccaatttgaatctcgctttttcctagtcgtgatttctgcctcttcatgtgcactctctgggcagtgaggaggaaggaatggctcactggatgagttgggcacttttcttagggaaggggctttgtccctatgcgctttttgcaagaccctactagagtggctctggcagccgagctttgaggaggcggccagaggggccgcttggcgtttctgaaagacgagaggaaggggtcttctggtagtcctgttttcctttgggggtttcgttgcacgcagaggcttgggcgcttggcacccagacttcaggtgcgcacagtcctcctgcgacgtcagatgcgctggcgccgcggcgctcctggctcggaccgatgcctgcgccttccctggccacgtcctggtgtttagtgcagcagacaccggccgaaggcttggctgattgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttggcggtggtgtggcccgttcttttggaggtccacaccacaggtatgaggcctgtgggccctgaggaagcgcgatccccttaattcctccctcccctctctctccaccgcccgcccctttgcaaggagcaagcctgacagtagctgatcggcgccctctctcaccc

SEQ ID NO: 87270 - DNA, 94 bp, Homo sapiens; identical to SEQ ID NO: 46108
  chr20:24467593-24467687
  hypo

SEQ ID NO: 87271 - DNA, 152 bp, Homo sapiens
  chr20:24485768-24485920
  hypo
tagctgagtggtcatcggcacagggtaggtaggtggcaccgcgggctacagggagatgagctggaaaaggctgaagagaggacctggcaaagagtcattgagaagtcattgggaagcaggaaaaccagccaagggtgcgcagccaggggagc

SEQ ID NO: 87272 - DNA, 251 bp, Homo sapiens
  chr20:24523851-24524102
  hypo
tgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaa

SEQ ID NO: 87273 - DNA, 30 bp, Homo sapiens
  chr20:24557052-24557082
  hypo
ctgatgattgttgagcgtttctgctgtacc

SEQ ID NO: 87274 - DNA, 188 bp, Homo sapiens
  chr20:24570981-24571169
  hypo
aacaggggcagaccccgagactctttaggctgtgaccgagcggggcttccactttgggataagaagcctcgggggtttgagcggaggagaagcccctgtggccacatgctcccgggagccttcagagaacagggcggagggggaggcgcagggcgacgacggcagtggtcaaacgcagaaccgtggag

SEQ ID NO: 87275 - DNA, 92 bp, Homo sapiens
  chr20:24571457-24571549
  hypo
cggtgatgaggggcccgtgggagcattgaccgctgatgagcagcttcaggcatgcagggagggacagcaccgaggagcggactccagagcaa

SEQ ID NO: 87276 - DNA, 34 bp, Homo sapiens
  chr20:24577284-24577318
  hypo
aattacaggcatgagccaccgggcctggcctcca

SEQ ID NO: 87277 - DNA, 30 bp, Homo sapiens
  chr20:24591039-24591069
  hypo
cccgccgtgggcactcggaagcatgtttat

SEQ ID NO: 87278 - DNA, 35 bp, Homo sapiens
  chr20:24646770-24646805
  hypo
atgtcaagccacctccggaacgtgtctacactcca

SEQ ID NO: 87279 - DNA, 30 bp, Homo sapiens
  chr20:24710156-24710186
  hypo
gggttggtagttattcgaagtggtggttac

SEQ ID NO: 87280 - DNA, 30 bp, Homo sapiens
  chr20:24710762-24710792
  hypo
ggggtggcagtcacacggggtggtagttat

SEQ ID NO: 87281 - DNA, 37 bp, Homo sapiens
  chr20:24859497-24859534
  hypo
acctgccgggagctgcgaagcccgcacatgggacaca

SEQ ID NO: 87282 - DNA, 30 bp, Homo sapiens
  chr20:24872315-24872345
  hypo
gggagtctaagggtgcgcttgtgaaatctg

SEQ ID NO: 87283 - DNA, 30 bp, Homo sapiens
  chr20:24872697-24872727
  hypo
actcaaggacccggacgggagcccctccca

SEQ ID NO: 87284 - DNA, 89 bp, Homo sapiens
  chr20:24872934-24873023
  hypo
tagactgatctcagccgcccacccttgctgcacggacacccccagccccgcagatgccctgcaacagacggaaacgtcctaacaattcc

SEQ ID NO: 87285 - DNA, 30 bp, Homo sapiens
  chr20:24873703-24873733
  hypo
cacctgatgagtgctcgggatgaggtcaga

SEQ ID NO: 87286 - DNA, 30 bp, Homo sapiens
  chr20:24947246-24947276
  hypo
cacagctgacctgtacgctttcaaaggatc

SEQ ID NO: 87287 - DNA, 30 bp, Homo sapiens
  chr20:25003625-25003655
  hypo
tgcccttgggcattccggtgctccctgagg

SEQ ID NO: 87288 - DNA, 246 bp, Homo sapiens; identical to SEQ ID NO: 46113
  chr20:25028280-25028526
  hypo

SEQ ID NO: 87289 - DNA, 474 bp, Homo sapiens
  chr20:25058288-25058762
  hyper
cgagccgtgcgatcccgggggcccttccttacccaggagccagggcgcgcaggagcccagcaggccgccctcggcggagttgagcacggagtctggcagcgggatgcagtggcgcaccatggccccgtacagcccgtactcggccatcacgctgctgccgccccagcgcttctcccgcttgcgccatttggccctgcggttttgaaaccagacctggttggaggcaggagaagcagaaggcacacagaagagacagtgaagaggggcgcctggaggagcggaggcggcgtcccagggctcggatcttctctcccgagcatgatcccatgctatttctgaaggaaatagctcccgagggccaaccagccgccctcagggagagcgcccaggagcccccagcagcgcccacgtgcggtccggactcacgggcattcaacgcagtagggacacttgtgaccacgtccactgaagttt

SEQ ID NO: 87290 - DNA, 43 bp, Homo sapiens; identical to SEQ ID NO: 1451
  chr20:25061746-25061789
  hyper

SEQ ID NO: 87291 - DNA, 334 bp, Homo sapiens; identical to SEQ ID NO: 1452
  chr20:25061978-25062312
  hyper

SEQ ID NO: 87292 - DNA, 136 bp, Homo sapiens; identical to SEQ ID NO: 1453
  chr20:25062510-25062646
  hyper

SEQ ID NO: 87293 - DNA, 111 bp, Homo sapiens; identical to SEQ ID NO: 1454
  chr20:25062707-25062818
  hyper

SEQ ID NO: 87294 - DNA, 418 bp, Homo sapiens
  chr20:25062870-25063288
  hyper
cgccgttccggaccccgcgagatggggacgccaccagttcccctcccctcggttaccgcccacccagctgcagtcccctcagtcacctccttctcctcctctcttctgtccagcccaccccaccccaccccacccccattctaggagggaggggaggaaagaaggtaagggacagtgactccgctgtctgcctgtccctcgaaaagtcgcaagttctacatcctggcgtggccttctccttccttccagactctctgggtggaggccccactcccagctgccctgaagcttctttgatgcgacccaactgcctattaagacctaggaccccattcccaaccacaccccgatggctaccccatatatgtccccagccagccctccacctccgccgccggtgccacgaaggccttcctgt

SEQ ID NO: 87295 - DNA, 209 bp, Homo sapiens
  chr20:25063698-25063907
  hyper
agcacaccttttcatcggggcttacaatttattgtccaatttcacgattattcaaagaaagcctgattctttgaataatcagtgaaactctgatattcgctaaagttggccccaagcacgtgggtaagtaactactggttcgcgctttgaacccaaccagccctcatcgctcggagccctgcgtcccccgcttcccaatcccagaaccc

SEQ ID NO: 87296 - DNA, 1214 bp, Homo sapiens; identical to SEQ ID NO: 38042
  chr20:25063993-25065207
  hyper

SEQ ID NO: 87297 - DNA, 318 bp, Homo sapiens
  chr20:25065208-25065526
  hyper
ggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgggctccttccagcttccccctaccggataccacctgcaaatctattgccagaggcgcagctcccgcgaacgttcccgccccgggcggcccccaggagtcgttttgggtccctaaatccgttgagggttccga

SEQ ID NO: 87298 - DNA, 72 bp, Homo sapiens
  chr20:25065766-25065838
  hyper
cccgagaaggtgaaacggatcgccctgtgagtctgcagaaatgaccccccacggctccgttcttctgatttt

SEQ ID NO: 87299 - DNA, 29 bp, Homo sapiens
  chr20:25129464-25129493
  hyper
cgcccatccccgtgcgcacgtgttcgctg

SEQ ID NO: 87300 - DNA, 161 bp, Homo sapiens
  chr20:25230352-25230513
  hypo
acatagaagtggcaacgaatggccaaaacaggttataacaagggcttgggatgactttgccaggaaaagcagccaagaagcagtggctcccccagaattccctgctgttgggagagttctgatgcacagcaccattttttttttttttttaattctgagtc

SEQ ID NO: 87301 - DNA, 220 bp, Homo sapiens
  chr20:25230753-25230973
  hypo
gagttacaggcgtgagccaacgcacccgacccgcaacatcatttttattgtctaagtggcggatggcaaggacatagctctgccttcacattcaagggcatttccttggagctggaccaggactcagctctacaccttagggtgcccattggagtatttatgtataatcacatcctggagaggccagcgatgggctcagggattacggaaatgaccttca

SEQ ID NO: 87302 - DNA, 97 bp, Homo sapiens; identical to SEQ ID NO: 46116
  chr20:25251463-25251560
  hypo

SEQ ID NO: 87303 - DNA, 30 bp, Homo sapiens
  chr20:25260377-25260407
  hypo
aaagaaaccataaaacgattttttttaact

SEQ ID NO: 87304 - DNA, 30 bp, Homo sapiens
  chr20:25281398-25281428
  hypo
ggggcttcaggataccgggctgctgactgg

SEQ ID NO: 87305 - DNA, 30 bp, Homo sapiens
  chr20:25320569-25320599
  hypo
cccgtcaagccaggtcgccagcccagggtc

SEQ ID NO: 87306 - DNA, 23 bp, Homo sapiens
  chr20:25344133-25344156
  hypo
tgagtcaccgcacctggctgaca

SEQ ID NO: 87307 - DNA, 248 bp, Homo sapiens
  chr20:2539304-2539552
  hyper
gagggcaggagaaagcgcgacgagagggcctccttccaggagcggacagcagccccaaagagggaaaaggagattccgaggagggaggagaagtcgaagcggcagaagaaacccaggtgtgttgtggctccgattctgggcattcgctccgcgcgctcccgctccttcgcggcccttccccttcccccgtgagggactgatgcccccctccccggggagaggcagcccgtgccctcgctctggcttcc

SEQ ID NO: 87308 - DNA, 256 bp, Homo sapiens
  chr20:2539553-2539809
  hyper
tgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtggagaggtgacagggcagcgggtgggacacgatcccgcgtcccctgaactccagctggtgactcaccccggctctcgaagaggaggagct

SEQ ID NO: 87309 - DNA, 190 bp, Homo sapiens
  chr20:25565479-25565669
  hyper
tggtgtgtgtgactgcgcgcacaggcgggaggaaaggggcgaatctgcaaaacgagtacaacagataaaattcgcaacagacttctacaccctttcaatcaaccgtcccaagcgccacgaacgcgggtcccgctccgtggggggccgcagccacactggcaggagggaatcctgggcctcgaccagacgc

SEQ ID NO: 87310 - DNA, 419 bp, Homo sapiens
  chr20:25565825-25566244
  hyper
gtcgggaaaccgggttttcaagcgttcggcccagcgggcgctgtattttagggcgtgacccccgccccgccctcgagggcgaccggaagagcaggcaccacagcagatgcgccgagtctgcgccccgcaccgcgaggagcacccgaggccgcgctcccggagccgggtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctcccggcctcgaggcaccgccccctcggtgtcccggcgcagtgggcgaaca

SEQ ID NO: 87311 - DNA, 30 bp, Homo sapiens; identical to SEQ ID NO: 46117
  chr20:25603036-25603066
  hypo

SEQ ID NO: 87312 - DNA, 246 bp, Homo sapiens
  chr20:2583218-2583464
  hypo
ctcacagctttgcagcgccatacatcgtaaatcaagtgtctattaatgcatgggtatgattctgggctctcttttctattcctgtttgtctattcctgcacaaataacaaactgatatactatgcatttacactatgtcttaatatctgatagagcgagttttctcatcaagctccacaataaaacacattaaggttttattgtgataacacagaatccataaacctctttcgggaatttgacatc

SEQ ID NO: 87313 - DNA, 99 bp, Homo sapiens
  chr20:25968565-25968664
  hypo
tgatttcttgcatgtcggctggtctttggtgagcctctttctgcatctctgcctggttcatgtggccagctgtcagtcattttcctggccgttccactt

SEQ ID NO: 87314 - DNA, 30 bp, Homo sapiens
  chr20:25972523-25972553
  hypo
ggaggccggaattcacggagggtcatccaa

SEQ ID NO: 87315 - DNA, 30 bp, Homo sapiens
  chr20:26116723-26116753
  hypo
tcaggagtcagtggccgtatgctggaggct

SEQ ID NO: 87316 - DNA, 150 bp, Homo sapiens
  chr20:26188812-26188962
  hyper
aacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccac

SEQ ID NO: 87317 - DNA, 202 bp, Homo sapiens
  chr20:26189330-26189532
  hyper
cgctcggccaccaccgcggtggccggcggaaccctcgctctccccccgtcaccccgtcgagggggaagctgaggagggttcctctgcaagcgagtcgctactgcagcgctaccataacggagagagagacagaggcggcaggccgggggatcccgtaccccaaggcacacctcttggatcgctagagaaggctttctcaccg

SEQ ID NO: 87318 - DNA, 94 bp, Homo sapiens
  chr20:26189592-26189686
  hyper
ggcgctcagggaggcctggggaagggagggggcctgtggtaccaggaaaaacctgcgtgcggcaaccttgagcgttcgcggtcagggcggggac

SEQ ID NO: 87319 - DNA, 394 bp, Homo sapiens
  chr20:26189956-26190350
  hyper
cgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgggggcgggacagcgaggtcaggccggg

SEQ ID NO: 87320 - DNA, 23 bp, Homo sapiens
  chr20:2645508-2645531
  hypo
aacatagggagacctcgactcta

SEQ ID NO: 87321 - DNA, 30 bp, Homo sapiens
  chr20:2646617-2646647
  hypo
atcactattaatattcgtcactatttttct

SEQ ID NO: 87322 - DNA, 158 bp, Homo sapiens
  chr20:2668770-2668928
  hyper
agtggatccaagtgccggcatcacactctggggcctccggggggcgctatggcccaacacacagcgtggccaagcgcgcctcagcctaactcaccacttcctatctgttttatacggtttgcacccgcttaaggcggcggaggcgtgggggagttctg

SEQ ID NO: 87323 - DNA, 48 bp, Homo sapiens
  chr20:2672952-2673000
  hyper
gcgaaagctcggaggcgtcaaaatgagcagcaagtccaggcacaaggc

SEQ ID NO: 87324 - DNA, 33 bp, Homo sapiens
  chr20:2673201-2673234
  hyper
cgttccctcccgcggcctcgaccaggccgcagc

SEQ ID NO: 87325 - DNA, 20 bp, Homo sapiens
  chr20:2674135-2674155
  hyper
ggagcgcccaagaggcgagc

SEQ ID NO: 87326 - DNA, 30 bp, Homo sapiens
  chr20:2718301-2718331
  hypo
gcagctgagcctggacggcagcaagaaagt

SEQ ID NO: 87327 - DNA, 209 bp, Homo sapiens
  chr20:2728381-2728590
  hypo
ttacaacataaaatgcgtattaatgtatttgttctgtgtatttcctatttctctgtgcatatactgtgtagggtgggcatacaccgtgcatgatgggtacaggctctgtgtctgcttagtatgccatatgtgtgggatgagtgcaggctatatgtggagtacatgttgtttatgcttgtgtgaaggttataccccgagtgtgtgtgatg

SEQ ID NO: 87328 - DNA, 15 bp, Homo sapiens
  chr20:2731229-2731244
  hyper
tcctctccaccccac

SEQ ID NO: 87329 - DNA, 59 bp, Homo sapiens; identical to SEQ ID NO: 37876
  chr20:2731616-2731675
  hyper

SEQ ID NO: 87330 - DNA, 36 bp, Homo sapiens
  chr20:276977-277013
  hypo
acagttcttgatccacggcgtcagaaataaagtggt

SEQ ID NO: 87331 - DNA, 148 bp, Homo sapiens
  chr20:2774812-2774960
  hypo
ctagggctcttaaaccgcaggtatcaatccttctgtccccttagccgctccaggcgcctgcgaaggtccgggggcaccttggccccagctgccagcagctcgcgcagcctctgtttgggagtcttggtgagcacgaaattgcagggga

SEQ ID NO: 87332 - DNA, 212 bp, Homo sapiens
  chr20:2775721-2775933
  hypo
tctaacacgatgccacgctgccagcaaactgcacttcctgtcctgtgtgcttccaagacaatctgataccaagcatggcccatggcatcttgtgagtctgaatgctcagctggaccttagaagaacccctggtaggagctgtagcctaaatggacagcaggagtgattcaggcaggctgggggccgggacgcagatccgacctgctccaggt

SEQ ID NO: 87333 - DNA, 114 bp, Homo sapiens
  chr20:2777098-2777212
  hypo
catgggggcttgcagcgggttcatgcctggggccctgccctgtgcctacctctccccactccccatgccagtacccagctcatgctccccaggcttgtccgacatttccatcac

SEQ ID NO: 87334 - DNA, 83 bp, Homo sapiens
  chr20:2780664-2780747
  hyper
gggaactggggctgccgagtcagcagccattgctcccagcagggagttgagggagtgtgagtgtgtatatgtgtgtgtgcact

SEQ ID NO: 87335 - DNA, 255 bp, Homo sapiens
  chr20:2780867-2781122
  hyper
tgtgtgagtgcgcgcgcgtgtgtgcgcgtgagtgcgagtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtccc

SEQ ID NO: 87336 - DNA, 847 bp, Homo sapiens
  chr20:2781123-2781970
  hyper
ggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatcaaggcaccaaaatatcgacaaatgtaaccatttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccacttcccggttccggagctctgacacc

SEQ ID NO: 87337 - DNA, 291 bp, Homo sapiens
  chr20:2785576-2785867
  hyper
gggcccaagaagaggcggcacggcggcgcttcccaccaccaccatcaccaagcccggccctgcccctcctctcctttcccttccctcccctactccttcgctcactcacccggctgccacgtcccgtcccggggttacataacccggagagagaagcctgagcgatagcctgcgggctggggctgcggtggaggagccaagggttgatgcactgcctgacctgccctccggctcctcgcccccagcccgtattctcctcggggagccggcagccctgggtctgcccagatc

SEQ ID NO: 87338 - DNA, 134 bp, Homo sapiens
  chr20:2785955-2786089
  hyper
cggtgtgcctttggccggcgcttggcctttgcaaagggctctccagggagatgctcccatccccacgaggagcgatgcccagaagtggcccgcaatcctctggcgtaagcggggccctgcgcaaatgttttttg

SEQ ID NO: 87339 - DNA, 147 bp, Homo sapiens
  chr20:2820440-2820587
  hypo
cccccaagatgaccacgaacttgttgtgtagcagctgctggacttccgaggcctggaagtggaccatgtcgcttcgcagcgggcggcgcggctcctcgctcgacagacagaagaccatgccgccaccagcaacgacaggctgcaggg

SEQ ID NO: 87340 - DNA, 135 bp, Homo sapiens
  chr20:2820726-2820861
  hyper
ccagaggcagggggtcgtccagccagcaggcctccagggcactggggagcttcccgcgcggcgccgccctgcgcctcgccacgtgcccgccgccgtcccgcgcatgcgcgcacccgctcgcgccaattaccaagt

SEQ ID NO: 87341 - DNA, 399 bp, Homo sapiens
  chr20:2852724-2853123
  hyper
ggcggtggtggggaccggagatggtaggactggagatggtaggggctgctgatgtgagcccacaatacggaggagtggggcacagagtccctaactggcgccccaacagaaggcggtggtggggaccggagatggtaggactggagatggtgggggctgctgggagccccttttgcgccgcagtgtttcctgccatgaagagttgccgccggtcacaacccttccccgggggcgccccgaatgtgggactccttccggcctggggtgcgtgagggggactcaggggttgcccggtctggaggagagactcgccgccacctaccccgggaaccgcagactctgggtctgggataaagcgtcccctacccgcaagctcggtttgtgcgctactgtgcaatc

SEQ ID NO: 87342 - DNA, 111 bp, Homo sapiens
  chr20:291052-291163
  hyper
cccccaaatccaggccgccctgccccctccggaaaggggagttgggggcgagcgccgaaatctgagtggctctttcaagcctccgttgccatagaaaccggccgcacaggc

SEQ ID NO: 87343 - DNA, 153 bp, Homo sapiens; identical to SEQ ID NO: 1417
  chr20:291220-291373
  hyper

SEQ ID NO: 87344 - DNA, 30 bp, Homo sapiens
  chr20:29873905-29873935
  hypo
tccctgtcctccactcgtacaccgttgagt

SEQ ID NO: 87345 - DNA, 30 bp, Homo sapiens
  chr20:29958799-29958829
  hypo
cgcctcagcctccctcgtgctgttgtttta

SEQ ID NO: 87346 - DNA, 30 bp, Homo sapiens; identical to SEQ ID NO: 46076
  chr20:3001373-3001403
  hypo

SEQ ID NO: 87347 - DNA, 30 bp, Homo sapiens; identical to SEQ ID NO: 46118
  chr20:30022593-30022623
  hypo

SEQ ID NO: 87348 - DNA, 206 bp, Homo sapiens
  chr20:30063043-30063249
  hyper
ctcccccggccgaggcggcgaggggaggggaactggcctgaggggctgctcactgaggcgggtggtacagcctggagcatccagccgctggagctgcgagggaccctggacccctcccacgccgaggtaaagccctgcgctacgcgccgccaacttgctcaagttggagcagagttcgccaggcgattgaagggggattcggcagc

SEQ ID NO: 87349 - DNA, 384 bp, Homo sapiens
  chr20:30063250-30063634
  hyper
ttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccgtccccaaaagcagttggaggccgtagcgccagccgctcctgaatttttcacacagggggcgggtcagacacgcggttcccatggcactagggcactcgggttacagtcgggttacccccata

SEQ ID NO: 87350 - DNA, 30 bp, Homo sapiens; identical to SEQ ID NO: 16575
  chr20:30101713-30101743
  hypo

SEQ ID NO: 87351 - DNA, 28 bp, Homo sapiens
  chr20:30134312-30134340
  hypo
ggaggctgaggcaggcggatgacttgag

SEQ ID NO: 87352 - DNA, 30 bp, Homo sapiens
  chr20:30151940-30151970
  hypo
gagcacccatgaagacgcaccatgaaggag

SEQ ID NO: 87353 - DNA, 47 bp, Homo sapiens; identical to SEQ ID NO: 46121
  chr20:30153940-30153987
  hypo

SEQ ID NO: 87354 - DNA, 93 bp, Homo sapiens
  chr20:30175456-30175549
  hyper
ccgtcctagtggtgccgggcggcggccacgccagccgcaccttcccccggccagcccagagctgccgctggggaagggcggagggaaggcaag

SEQ ID NO: 87355 - DNA, 42 bp, Homo sapiens
  chr20:30175841-30175883
  hyper
gcaatgtctttcaggcgggtgcgcccccgaacaaagtcgggg

SEQ ID NO: 87356 - DNA, 20 bp, Homo sapiens
  chr20:30181151-30181171
  hypo
cacatcgttgcttttgcatc

SEQ ID NO: 87357 - DNA, 44 bp, Homo sapiens
  chr20:30191611-30191655
  hypo
tcggccttccaaattgttgggattacaggcgtgagccaccgcgc

SEQ ID NO: 87358 - DNA, 36 bp, Homo sapiens
  chr20:30193856-30193892
  hyper
cggcatgcgttcctgcggacgatcgcatcttgtgtc

SEQ ID NO: 87359 - DNA, 99 bp, Homo sapiens
  chr20:30193893-30193992
  hyper
ctgaagcgcctcccccagggaccggcggaccccagccatccagggggcaagaggaattacgtgctctgtgggtctcccccaacgcgcctcgccggatct

SEQ ID NO: 87360 - DNA, 30 bp, Homo sapiens
  chr20:30199446-30199476
  hypo
tgtgagccaccatgtcgcccagcctcattc

SEQ ID NO: 87361 - DNA, 37 bp, Homo sapiens
  chr20:30244648-30244685
  hypo
ggattacaggcacgagccaccacgcatggcccatttc

SEQ ID NO: 87362 - DNA, 22 bp, Homo sapiens
  chr20:3027758-3027780
  hypo
aagggtggctgggagcggtggt

SEQ ID NO: 87363 - DNA, 30 bp, Homo sapiens
  chr20:30407129-30407159
  hypo
ccgcctctgcccacccggcccaatccctta

SEQ ID NO: 87364 - DNA, 40 bp, Homo sapiens
  chr20:304445-304485
  hypo
attacaggtgtgagccaccgcgtcccgtctatcataagtt

SEQ ID NO: 87365 - DNA, 215 bp, Homo sapiens
  chr20:30464460-30464675
  hypo
gggcctataagatatcgtctagtagtggaatatctgggttgtaaggtgtgtgcattttcaactttatgagatattgccaaattgcctcccaaggtgtgaatagcatgtaaaggctcccgtttccccacgtcctcactaacatctgacctcatgaaaaacattgacatattttttgtatagctgatgtatttcaaatcatacgattatttttattt

SEQ ID NO: 87366 - DNA, 39 bp, Homo sapiens
  chr20:30468269-30468308
  hypo
taaaattcagctctccgcaccccaaccgacttttttttt

SEQ ID NO: 87367 - DNA, 173 bp, Homo sapiens
  chr20:3052519-3052692
  hyper
ctgagcggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgcccc

SEQ ID NO: 87368 - DNA, 423 bp, Homo sapiens; identical to SEQ ID NO: 37884
  chr20:3052693-3053116
  hyper

SEQ ID NO: 87369 - DNA, 517 bp, Homo sapiens
  chr20:30555886-30556403
  hyper
aggaggaagaggagccgcccgcgcagggtcctccccacgccgcacccccctccgccgcccggaagtcgctccccgcctccctctccgccaacatggccgcgaagtcggatggagcggcggcctcggccagcccggacccggagggggctgccggtggagcccggggcagtgccggcgggcgcggggaggcggcggcggcggccgggcccccgggggtcgtcggggcgggcggcccggggccgcgctacgagctgcgggactgctgctgggtgctgtgcgcgctgctcgtgttcttctccgacggtgccacggacctgtggctggcggcctcctactacctgcagaatcaacacacctacttcagcctcaccttgctgttcgtgctcctgccctcgctggtcgtgcagttactgagcttccgctggttcgtctacgactactcggagcccgcagggtccccgggacccgccgtcagcaccaaggacagcgtagccggcggagccgccatcagcaccaa

SEQ ID NO: 87370 - DNA, 275 bp, Homo sapiens
  chr20:30582750-30583025
  hyper
aggaaacaggctcagcgtagggagtgacttgccccctgcgcctgtgggcggctcggggctggtgcgacagagcgagaggaaccagcgcgcgggagcctgagcaccgcgtccttcccgcaggtacctgcgcgccctgtacctggggctgcagagccgctggcgcggggagcggctgcggcgccacttctactggcagatgctgttcgagagcgccgacgtgagcatgctgcgcttgctggagaccttcctgcgcagcgcgccgcagctagtgctgc

SEQ ID NO: 87371 - DNA, 57 bp, Homo sapiens
  chr20:30584443-30584500
  hypo
cagcattgccgcccgcggcctggccttcgcgctcttcgccagcgtctacaagctcta

SEQ ID NO: 87372 - DNA, 51 bp, Homo sapiens; identical to SEQ ID NO: 46125
  chr20:30585053-30585104
  hypo

SEQ ID NO: 87373 - DNA, 266 bp, Homo sapiens; identical to SEQ ID NO: 37885
  chr20:3063125-3063391
  hyper

SEQ ID NO: 87374 - DNA, 229 bp, Homo sapiens
  chr20:3063597-3063826
  hyper
ccccaggcccgcccccgccgcgcaccgtcgttgcagcaaacgccgaaggcggcgcagcggcccccgctcccgcacgccttctggccggactggcagggcgacggcaggtagttctcctcctggcagcgcagcgcctcagccgtgcccacgaagcagcccagctcgtccgcgcagcagatgctgggcccgaagcagcggcctttgcccccggggccgcaggggaggcact

SEQ ID NO: 87375 - DNA, 389 bp, Homo sapiens
  chr20:30639105-30639494
  hyper
ccagggtggttccttcgggcagggaactttgcatggccatggtggttccttcgagagaggaactttgcatggtgtctgaatggagcaggcctgcggaagagaaaccgctgaccacagacctgcctggaagtctcgggccgcggagttggggagggccgggccagaagggaggggtcggagtggtggggaaaagagatcacgatgcttccggggtagggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcgcgcaggagcaggagc

SEQ ID NO: 87376 - DNA, 561 bp, Homo sapiens
  chr20:30639695-30640256
  hyper
ttagacgggcgggttcgaatccctaggagtgggatttgggatcctttggagactggggtaggacgctgggcggtgggatggggaggtgttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatcc

SEQ ID NO: 87377 - DNA, 186 bp, Homo sapiens; identical to SEQ ID NO: 38059
  chr20:30640257-30640443
  hyper

SEQ ID NO: 87378 - DNA, 45 bp, Homo sapiens; identical to SEQ ID NO: 38060
  chr20:30640724-30640769
  hyper

SEQ ID NO: 87379 - DNA, 42 bp, Homo sapiens
  chr20:30671697-30671739
  hypo
aagctactctttgtccgtgcgagactacgaccctcggcaggg

SEQ ID NO: 87380 - DNA, 30 bp, Homo sapiens
  chr20:30689127-30689157
  hypo
aaccctgaagtgatccgagctctggagcgt

SEQ ID NO: 87381 - DNA, 30 bp, Homo sapiens
  chr20:30727301-30727331
  hypo
acctgttccagtcaccggtgtcactcatgc

SEQ ID NO: 87382 - DNA, 141 bp, Homo sapiens; identical to SEQ ID NO: 37887
  chr20:3073251-3073392
  hyper

SEQ ID NO: 87383 - DNA, 468 bp, Homo sapiens
  chr20:3073560-3074028
  hyper
cgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaaccagcgcagagaggccgcgctgccaggcgcgtggtggtccgggggtccacgtgtgagcctcgccctaggctgccaattgagagttccacctccgcccagagagaccccacctcacccctccaacctggggcgcgcgggccggcggaggggtcctggggcgagtgggcaggata

SEQ ID NO: 87384 - DNA, 30 bp, Homo sapiens; identical to SEQ ID NO: 46127
  chr20:30770464-30770494
  hypo

SEQ ID NO: 87385 - DNA, 412 bp, Homo sapiens
  chr20:30777833-30778245
  hyper
tctggggcttcgtcccggacccggccattttccaggctcggagtagtcgccgtggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtgggaggaaggctccgccccacgcgcccccctctcggatgtgattcgccggggtctcccgcagccggggcgagcggcttggaag

SEQ ID NO: 87386 - DNA, 89 bp, Homo sapiens
  chr20:30814945-30815034
  hypo
aacagcaaggggtttcgtgctgctgagaggtagtctgggtttagctgaagagggaacacaggtttgctcctcatttgttcagtcaagaa

SEQ ID NO: 87387 - DNA, 138 bp, Homo sapiens
  chr20:30864881-30865019
  hypo
taaataattactctggccaccttatggaaaatggattgttcggacagagctggacaaaagaatggaaacagaccagatatttcaggcaggctagagatgagcgtggcctggccttgcctggggcggttgtgactgact

SEQ ID NO: 87388 - DNA, 48 bp, Homo sapiens; identical to SEQ ID NO: 46129
  chr20:31108565-31108613
  hypo

SEQ ID NO: 87389 - DNA, 213 bp, Homo sapiens; identical to SEQ ID NO: 46130
  chr20:31115617-31115830
  hypo

SEQ ID NO: 87390 - DNA, 33 bp, Homo sapiens
  chr20:31129565-31129598
  hypo
tgtccatgcccaggacgtcgctttaggactaaa

SEQ ID NO: 87391 - DNA, 30 bp, Homo sapiens
  chr20:31144605-31144635
  hypo
ccaaggccacacaaccggttaacagtggag

SEQ ID NO: 87392 - DNA, 30 bp, Homo sapiens; identical to SEQ ID NO: 46131
  chr20:31147343-31147373
  hypo

SEQ ID NO: 87393 - DNA, 420 bp, Homo sapiens
  chr20:31151587-31152007
  hypo
atgatggaaaagccacgacgtcctagagcctgggacattgcctggtctcccggccaaggtggcagcagcccccaggcagctgtggccccaattctggtcactgggccctaagcgtatcctcggcagccacctgctaattagccaggcggctcctgcctgctcagtggctgctttggagcaattctcccaggaaaggccgagcttgcaggagcaggaaaggtaattgctaatttgcacgagaggagacaaagggacaaaggcgcccttggctgcccggtgcagcctgagccagcttcacatccagagctccctgccacttgccatccaccacggcgggccccaggatgtctgtctgtccccatgacacatccacacagtctctgttcggtgtaggccacccggccgcgccccaggaaggcc

SEQ ID NO: 87394 - DNA, 149 bp, Homo sapiens
  chr20:31180087-31180236
  hypo
taaatgtgctgaggtcgcacagctagtggtggggcaagaggagggtttgcacccagatttgcctggctctaaagccagggcacattactgccatcccgccccactcaggctggctgggccaatgggcattaaaaaaaaaaaaaaaaaaa

SEQ ID NO: 87395 - DNA, 49 bp, Homo sapiens
  chr20:31210079-31210128
  hypo
ggctaggccatgcctcgtgggtgctggattcctccggggatggcagaag

SEQ ID NO: 87396 - DNA, 174 bp, Homo sapiens
  chr20:31226649-31226823
  hypo
aggcccctcctcctgcgctcccggcaatgtcggcctgactcacctggtgataccaagtgtatattctgtgtcaggagctgcggtgtgcaactcaagatgctctgacttacttaattcttacacccaacaagttccaacagggaaacagagttcaggcagcgaggtagctgccca

SEQ ID NO: 87397 - DNA, 181 bp, Homo sapiens
  chr20:31232544-31232725
  hypo
cttccctaggccctgcgaggtttggaaaatgagcttgatcagctagtcaagggaggagactgacatttattgagcaccagtgatgtgtcatgcatcgtgtacctgtatggtgagatctcaattctgataataatccctcttcacagatgggggaaactgaggctctcggtggtaaattaac

SEQ ID NO: 87398 - DNA, 71 bp, Homo sapiens
  chr20:31376743-31376814
  hypo
aaggccacctccaagcgacaggctatgtctggcatgcggtgggtccagtggtttggcgatggcaagttctc

SEQ ID NO: 87399 - DNA, 41 bp, Homo sapiens
  chr20:31485187-31485228
  hypo
tgaatgaatgaatgacgcactcagggcggtctgggtgatcc

SEQ ID NO: 87400 - DNA, 79 bp, Homo sapiens
  chr20:3154916-3154995
  hyper
tggccccagaccacacgctgtaacccggggtgagagggagtgaggtgggacttcgtaccggacccggagcgccggcctc

SEQ ID NO: 87401 - DNA, 30 bp, Homo sapiens; identical to SEQ ID NO: 46134
  chr20:31553994-31554024
  hypo

SEQ ID NO: 87402 - DNA, 30 bp, Homo sapiens
  chr20:31607353-31607383
  hypo
cagcagggcctcctccgcctctgcctcccc

SEQ ID NO: 87403 - DNA, 123 bp, Homo sapiens
  chr20:31671342-31671465
  hypo
agcatcagggacctccgaaacagtggctatcgcagtgccgagaatgcatatggaggccacaggggcctcgggcgatacagggcagcacctgtgggcaggcttcaccggcgagagctgcagcct

SEQ ID NO: 87404 - DNA, 30 bp, Homo sapiens
  chr20:31690556-31690586
  hypo
gatttgagccttctccgtgtggtgcatgaa

SEQ ID NO: 87405 - DNA, 30 bp, Homo sapiens
  chr20:31690858-31690888
  hypo
ggaaggagcccaggacgtgtcttccgggaa

SEQ ID NO: 87406 - DNA, 188 bp, Homo sapiens
  chr20:31744494-31744682
  hypo
ctgctgaggcaagagcggagggaggtaggcaaagaaggagagttgtcctggaccaaacttctggactaactgccgttatagggtgccttgtgccacttctcagtttctcaccgaggctgggcaccaggcaggaggcaggagaaaagatgggacactcctctcccccaagcaggcggggaagcctattg

SEQ ID NO: 87407 - DNA, 157 bp, Homo sapiens
  chr20:31797604-31797761
  hyper
tgaagtaggccaaggcgacgaggaagagccaccttaattgatgagaggaagtccagggaaacaatgagaaaacgttatccagagagaggcagtggatgggtgtcccgacaggaatagatttcagcaccacggacagcagtcacgccagtgcggaggg

SEQ ID NO: 87408 - DNA, 36 bp, Homo sapiens
  chr20:31920935-31920971
  hypo
cgccccagctcccctcgcccacgtggccctggcagg

SEQ ID NO: 87409 - DNA, 30 bp, Homo sapiens; identical to SEQ ID NO: 46135
  chr20:31940171-31940201
  hypo

SEQ ID NO: 87410 - DNA, 100 bp, Homo sapiens
  chr20:3202053-3202153
  hypo
ttgtattttcaggaacgctgtcatagtagccggcatctggcttgtccacggagttcagggtacttagcttcctattaggagaaaacgttttctgtctatc

SEQ ID NO: 87411 - DNA, 91 bp, Homo sapiens; identical to SEQ ID NO: 16562
  chr20:3202418-3202509
  hypo

SEQ ID NO: 87412 - DNA, 39 bp, Homo sapiens
  chr20:3203262-3203301
  hypo
ttgttctctgtagttcgcacaaatcgccccttgttcaca

SEQ ID NO: 87413 - DNA, 30 bp, Homo sapiens
  chr20:3204581-3204611
  hypo
ggacacgggcagcaccgtgtggaaggcatt

SEQ ID NO: 87414 - DNA, 105 bp, Homo sapiens
  chr20:3204870-3204975
  hypo
aggggctggagtcctcgaccccactcggcgtgatcgccacagttcagcctgcgggctgcaggcccctcgggaggccctgcttatgccacacgcccttactctgtg

SEQ ID NO: 87415 - DNA, 30 bp, Homo sapiens
  chr20:32155248-32155278
  hypo
acctgtggtacagtacgctaagacattctg

SEQ ID NO: 87416 - DNA, 307 bp, Homo sapiens
  chr20:3218629-3218936
  hyper
cctcggatgccaaggcgggggatctctctgcacatccctcttctcactctcagaccggtcctgggggccataaacgcccattgcaggcgcagttcccccgacccccgtcacgcgccccgggtcacacgggggccgacaggcaacggtctccagtcctgggaccgcgtcccggccgcctggaagccagagccgttggtccaaaagggagaacaattgggggtgggaggagtatctgagggacacatgggtcgggggaggctgcgccctccctgggccggtccccggatggtcccggctgtttgtgcct

SEQ ID NO: 87417 - DNA, 480 bp, Homo sapiens
  chr20:3220549-3221029
  hyper
cccaaatggcccttgcgccctgtcccctttcctggaccggctgcgacccgcccggggacgcgccttttcggggcgcttagtctcctgcgagtagggcgtgtgcgcgtgtgggtgcgcgtgctgcgatgcgatccggcaaatgcagctgacgaacccctggcctgatccacggtggctcccagtagaaggctctacagcccttggaaacggaacacgcagctccgtaaagcgctaaccaacctcccgacccctccggccgccatcgctttccggctcagccgcgctgggacggagtcctcggccactgtgccctaaccatggtagaggaacggggacaggccggggcaagcccacctctgcgaaggaagggcttctggcgcgttggggaagcctcatgcatagattgggtgagtaaggctggcccagttctcctcccggcaagataagaacgcattaggagggaagcgctggagtgctcct

SEQ ID NO: 87418 - DNA, 258 bp, Homo sapiens
  chr20:32242529-32242787
  hypo
tttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcagaggcttgagggcttcctccaggtccccacagccccagcccagctcagacgtctgttctgtggctgcagctccagccatgtctgcgctcagctccaccc

SEQ ID NO: 87419 - DNA, 73 bp, Homo sapiens
  chr20:3229253-3229326
  hyper
ttcctcacctccctgcgcggccagcgggggcccggggtgtggtcaggtgggaggcccgcgccacgtgcggcag

SEQ ID NO: 87420 - DNA, 102 bp, Homo sapiens
  chr20:3229557-3229659
  hyper
atcaggctggaaaggcgtggttcctactacagctcggccgcggcaggctggggccgagaaccggcacccgtgcacggcggactaagacgagggtgagggaca

SEQ ID NO: 87421 - DNA, 30 bp, Homo sapiens
  chr20:32298233-32298263
  hypo
ctctgtactgaaccacgcccccttccatca

SEQ ID NO: 87422 - DNA, 69 bp, Homo sapiens; identical to SEQ ID NO: 46137
  chr20:32301884-32301953
  hypo

SEQ ID NO: 87423 - DNA, 76 bp, Homo sapiens
  chr20:32378890-32378966
  hypo
ccgctgtgctggctgcgccaagggcttttcccgccacaaatacctcaaagatcaccgctgtcgtctcggcccccaa

SEQ ID NO: 87424 - DNA, 30 bp, Homo sapiens
  chr20:32379308-32379338
  hypo
caggcctccgagtgacggacctgaggtgtc

SEQ ID NO: 87425 - DNA, 30 bp, Homo sapiens; identical to SEQ ID NO: 46138
  chr20:32414088-32414118
  hypo

SEQ ID NO: 87426 - DNA, 201 bp, Homo sapiens
  chr20:32450357-32450558
  hypo
ttacaggcccgagccaccgcgcccggctggcttgtgtttatttaaggaatggaagcgttcactcaagccagacttcaggggcaaatgtacattgggaatctccaagggacatctcccaaactacctgaccagggtgtgggttccgccgaatatcttttgggaaacgctgtgcgggggtccctagagcgtgtgggtcctccc

SEQ ID NO: 87427 - DNA, 38 bp, Homo sapiens; identical to SEQ ID NO: 46140
  chr20:32459722-32459760
  hypo

SEQ ID NO: 87428 - DNA, 30 bp, Homo sapiens; identical to SEQ ID NO: 16581
  chr20:32524318-32524348
  hypo

SEQ ID NO: 87429 - DNA, 150 bp, Homo sapiens
  chr20:32677281-32677431
  hypo
acagaagtctatgaacgattttaaaaaagcacctccttaccccatatcacgtttctctgacaggtgttaaagtaggcaatgagtatgtcaacagcttgagcatcagcgtcttgcaaggacttcagaccaaccactcgccaaaaatcttgg

SEQ ID NO: 87430 - DNA, 30 bp, Homo sapiens
  chr20:32677661-32677691
  hypo
ctgcaggattgtgtccggtgatcggcatgt

SEQ ID NO: 87431 - DNA, 30 bp, Homo sapiens
  chr20:3274373-3274403
  hypo
ttaccctgctgattccggcaaggcctgaat

SEQ ID NO: 87432 - DNA, 26 bp, Homo sapiens
  chr20:32768436-32768462
  hypo
aaatattttctgggccgtgcgcggtg

SEQ ID NO: 87433 - DNA, 182 bp, Homo sapiens
  chr20:327689-327871
  hyper
ggccctgaggcgggccggcgccccctcccccgccccgaactgcggcgcaggcgcgaaccggacccgcctttgctcggcggagacagcaggcagagaggtgagcttagccctgccccacgcgcggccaggccccagccccagcccctggagaacccccgcgctctgcccgcatcctcagcccg

SEQ ID NO: 87434 - DNA, 67 bp, Homo sapiens
  chr20:32803867-32803934
  hyper
ggccctcgtccttgtcgccgtagtcctctgccacgaccgcagcgccaacgccagagacggagttggc

SEQ ID NO: 87435 - DNA, 192 bp, Homo sapiens; identical to SEQ ID NO: 38064
  chr20:32803954-32804146
  hyper

SEQ ID NO: 87436 - DNA, 69 bp, Homo sapiens
  chr20:32899446-32899515
  hyper
attaactggaggcttcgagatgggatagagaggggtgcaggcgctgagaaagcccgctgatggggatgg

SEQ ID NO: 87437 - DNA, 224 bp, Homo sapiens
  chr20:32950057-32950281
  hypo
cagctcttagaataccggacaggccacgttggctccactaagctgttgtcatcatccctaagggcacccagttaaaaggtagaaaagggaggatttgaatccggtcagtgtaactctcaagtgtacattttttttcttttattttctttttaaccacgccctttaatgtacattgttaaaggctaagccaggccaggtgcagtggctcacatctgtaatctcag

SEQ ID NO: 87438 - DNA, 30 bp, Homo sapiens
  chr20:33131612-33131642
  hypo
ctctcacctgggctccgtgagcagggccgg

SEQ ID NO: 87439 - DNA, 251 bp, Homo sapiens
  chr20:33134788-33135039
  hypo
cgtgaggagggctggcgtcctgcgcacagtggaaggactggccttaggaacagggacagtgattccactcagcatagccagggagcggcccagatggcagggcaaggtctctgtggagtgagggcagcagggaaggtgcctcgcaggagaggagagaaaacatacacttccctggggacgcgggcggggagtttgacgggttcggcaggtggcccttttgcagcatctttttcagccgggggtgcagcagt

SEQ ID NO: 87440 - DNA, 30 bp, Homo sapiens; identical to SEQ ID NO: 46144
  chr20:33137930-33137960
  hypo

SEQ ID NO: 87441 - DNA, 426 bp, Homo sapiens
  chr20:33146323-33146749
  hyper
tgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagcccttgagcgcgaggcgcggagcccccggagcccccaaaccgcagacacatccccgcgccccagagccccggcctgcgcgcccagccgggcccgcgcgatgccctcagaccggcctttcaagcagcggcggagcttcggtgaggcccggcaggcgagctgcgagctctggggcag

SEQ ID NO: 87442 - DNA, 29 bp, Homo sapiens
  chr20:33290324-33290353
  hypo
ttatcactagagtgccgggcacggtggct

SEQ ID NO: 87443 - DNA, 78 bp, Homo sapiens
  chr20:33547578-33547656
  hypo
tttcctcactttcaaagtgaaatctgttttttcctaacaataactaccctttattgatctggtcgctaagtgtcaggt

SEQ ID NO: 87444 - DNA, 32 bp, Homo sapiens
  chr20:33572900-33572932
  hypo
tgggaagctggcatccgcggatattgacagct

SEQ ID NO: 87445 - DNA, 128 bp, Homo sapiens
  chr20:33574767-33574895
  hypo
tggggaggagctcatcgccaccgacgtatgagctctggtgggaggggagctgtgtggacgcctgtggtggaatcgggcagcactgccggtgcccccagctgcatgaatggtcccggggcagtgcctgg

SEQ ID NO: 87446 - DNA, 65 bp, Homo sapiens
  chr20:33834734-33834799
  hypo
tatgcagcagttttacgggatcccggtcaccggtgtgttggatcagacaacgatcgagtaagatt

SEQ ID NO: 87447 - DNA, 41 bp, Homo sapiens; identical to SEQ ID NO: 46149
  chr20:33855099-33855140
  hypo

SEQ ID NO: 87448 - DNA, 30 bp, Homo sapiens; identical to SEQ ID NO: 16584
  chr20:33866905-33866935
  hypo

SEQ ID NO: 87449 - DNA, 320 bp, Homo sapiens
  chr20:33879960-33880280
  hypo
ggccgccagccgagccgcctcgctgtgccgcagcaccagcggtgagctctcccgccaccacggcagcttcagctcttccacccggccccgcaggggtcccgccatgccctgggctcccaggaccccaggccccgggcctccgaacatgcctgccacgcggctgcctcacccgccggcagggcccatggcccgcacgctgggctggctgcagcaggaagaggagaccagcagaaccgccttctgcccgcccgctcgctgtgtgtgtggcagggcccccaaactgttgccaccctaaatcagagccacgctccaccctattg

SEQ ID NO: 87450 - DNA, 180 bp, Homo sapiens
  chr20:3388001-3388181
  hyper
agcaaagaaccgtcccgaggaagccatgtcggaccacgccctgcggcgggaggcgtcgccggaccccgacagcccgcatcccccgcccggccgcccctcggctgcctctgccccgcgtacctgacggagggtgacccgcggctggagccgccaggggaccgagcgcggggcagcccctgc

SEQ ID NO: 87451 - DNA, 90 bp, Homo sapiens
  chr20:3388444-3388534
  hyper
ccacttcttaagctgcgaggccgccggaccggatgttgggagcgcgtgtccgcagggtgagggttgccacagcgccgcccggcctcgtcc

SEQ ID NO: 87452 - DNA, 83 bp, Homo sapiens
  chr20:3388884-3388967
  hyper
catgagcgttagaggcgcacaggatcccagaagacccctaacctttactgttaagatcctagctctaccggtttctgcaggga

SEQ ID NO: 87453 - DNA, 41 bp, Homo sapiens
  chr20:34041981-34042022
  hypo
atttatacacaaggccgggcgcggtggctcacgcctgtaat

SEQ ID NO: 87454 - DNA, 84 bp, Homo sapiens
  chr20:34044003-34044087
  hypo
ccgcgctcagccaaaggcctatttaatcttcccaacaatcctatggggtgagttctttctatagcttcacgttttacccatgaa

SEQ ID NO: 87455 - DNA, 30 bp, Homo sapiens
  chr20:34119886-34119916
  hypo
attatatcataccaacgtcaagttccaggt

SEQ ID NO: 87456 - DNA, 59 bp, Homo sapiens
  chr20:34147171-34147230
  hypo
ctcctcctctgctttcgcttcttcttgccagcctgagcctcctgcgcctcccgctccac

SEQ ID NO: 87457 - DNA, 374 bp, Homo sapiens
  chr20:34147978-34148352
  hypo
aagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacacccatttgcaatccccctagtgcaccgccgttgccccgcccggccagcagcctacctcttcacatagatgtcactcgacatctctccggtgagtggattct

SEQ ID NO: 87458 - DNA, 33 bp, Homo sapiens
  chr20:34183450-34183483
  hypo
ttcttttgcacattgcgccgtctcaggccgcgt

SEQ ID NO: 87459 - DNA, 67 bp, Homo sapiens
  chr20:34188565-34188632
  hyper
caagtgctgcggaaccgcctttggggtctgatcccttctggctttctttttcttctttcgggtgagc

SEQ ID NO: 87460 - DNA, 342 bp, Homo sapiens; identical to SEQ ID NO: 1461
  chr20:34188747-34189089
  hyper

SEQ ID NO: 87461 - DNA, 326 bp, Homo sapiens; identical to SEQ ID NO: 1462
  chr20:34189166-34189492
  hyper

SEQ ID NO: 87462 - DNA, 393 bp, Homo sapiens
  chr20:34189679-34190072
  hyper
cggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattgg

SEQ ID NO: 87463 - DNA, 30 bp, Homo sapiens
  chr20:34288804-34288834
  hypo
attgggatgggcatccgatgctaaccatgg

SEQ ID NO: 87464 - DNA, 116 bp, Homo sapiens
  chr20:34312502-34312618
  hypo
gtactatgattggcacgcctaaaactcgttggccagttaatcctattgctagaggcactgagctaacatcgacgaactccacataagcaattcctttggaacgtcttgaatttctg

SEQ ID NO: 87465 - DNA, 30 bp, Homo sapiens
  chr20:34632854-34632884
  hypo
ttcaggtaacaattacgatgcaagtgggct

SEQ ID NO: 87466 - DNA, 30 bp, Homo sapiens
  chr20:34639308-34639338
  hypo
taaaagggtagatagcgaaagtgctttgga

SEQ ID NO: 87467 - DNA, 215 bp, Homo sapiens
  chr20:34710563-34710778
  hypo
cagcctcacttctgccgccttttctacctttctcaagggaggcttcctgggaaactggaaggcagaagccacgcagacttctagtcctggttccactgcttactcggtatgtggcccttggccagcccctttcccttcttggacctcagtttcagcacctgtacaatggggctttgggctcagtgatcctcagacagccacgttgtatgattcta

SEQ ID NO: 87468 - DNA, 142 bp, Homo sapiens
  chr20:35089026-35089168
  hypo
gacctaccacaggtgcggcctggagagatgaggcccacaaggcagcgacaggacctggattcagtgaggagaggggactcgcggggtagaagccaggaactgggaaggcgaggaggcgtgaaggcaccacctactgccaacc

SEQ ID NO: 87469 - DNA, 84 bp, Homo sapiens
  chr20:35201464-35201548
  hyper
acaggccattgaggtcgtaacaagcgtctccatcagagcctagtccttaactagctgcgggtaagtgcccggactaagtggcct

SEQ ID NO: 87470 - DNA, 30 bp, Homo sapiens
  chr20:35441848-35441878
  hypo
aatctcagaagggcacgatggctcacacct

SEQ ID NO: 87471 - DNA, 30 bp, Homo sapiens
  chr20:35444175-35444205
  hypo
gcgccacgtccagctcgtgctccgagcgga

SEQ ID NO: 87472 - DNA, 30 bp, Homo sapiens
  chr20:35464204-35464234
  hyper
tctccgcccagactccggagagccacacac

SEQ ID NO: 87473 - DNA, 257 bp, Homo sapiens
  chr20:35491258-35491515
  hyper
cgcgggctgggccggctgccccgtacggacccccgccgggcccccggccgcggactcggcgtcgctgctcagcgccagctccaggcccagcaggcgcgcctcctccgacgcgcagtccgacacctccgagctgctatccgtgaggctggggggcggcggtggcggtcgcggccccgcacccgagcgcggacggcccttggcacggaccccggtgcggaccccggccacccgcacacccgcaccgcgcgccccgggag

SEQ ID NO: 87474 - DNA, 111 bp, Homo sapiens
  chr20:35506436-35506547
  hypo
agtgcctcagagattcggcaggtctgggcattgcccatggcacaagaatttcagccctaaacctaagagtctcaccctcctgccctacaccagccacgcccaggggcacct

SEQ ID NO: 87475 - DNA, 146 bp, Homo sapiens
  chr20:35874090-35874236
  hypo
caagtggagtctctccgacgccattcgtgccgtggttaatggtatggagcactggagttgttgctatggtggtttttcccctataattgcattcacctccaaaaccacaagtagcagcaggtcccagcagtcgttattttatttga

SEQ ID NO: 87476 - DNA, 282 bp, Homo sapiens
  chr20:35924130-35924412
  hypo
tggtggtgaagtatgcgagttgctgcctgtaaagtgctgttcgcaacacctggccgttcatttgccgactgctgctgctgctggaacaatggccagggaacaaaacctgtcacagccagtcgaaggggtgtctcctagttgagatctgcaggatgaataggacttgtttgactttggtcatcaggaaaggaaagcccagaaatactggcaggagggctgggaagtaaagcacagaggtgcagagagaactagatgagagccgtacggcgcacagtgtgtgta

SEQ ID NO: 87477 - DNA, 375 bp, Homo sapiens
  chr20:36012923-36013298
  hyper
gcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgcccctgcgccctctgctggcgctctgcggtcaccgcagccccggagag

SEQ ID NO: 87478 - DNA, 58 bp, Homo sapiens
  chr20:36043953-36044011
  hypo
agcacccacagggggcggacttagggatacggaggcagatccgcggccctggtccctg

SEQ ID NO: 87479 - DNA, 33 bp, Homo sapiens; identical to SEQ ID NO: 46158
  chr20:36049828-36049861
  hypo

SEQ ID NO: 87480 - DNA, 39 bp, Homo sapiens; identical to SEQ ID NO: 16588
  chr20:36151122-36151161
  hypo

SEQ ID NO: 87481 - DNA, 151 bp, Homo sapiens
  chr20:36192064-36192215
  hypo
ccaaactaaaccgcctttgtaaagataatgaaagagcactaggttaggaagatgagaagtgcctacattctgctaaggtggagctgtaaccgattatcagtcattattccagaggccacaagattcgcaacttctccggttactcctgcaa

SEQ ID NO: 87482 - DNA, 30 bp, Homo sapiens
  chr20:36296722-36296752
  hypo
tcctgagactgagagcgggtggagcgaggc

SEQ ID NO: 87483 - DNA, 18 bp, Homo sapiens
  chr20:3641207-3641225
  hyper
gcttcgcagtcctcacgc

SEQ ID NO: 87484 - DNA, 238 bp, Homo sapiens; identical to SEQ ID NO: 37894
  chr20:3641310-3641548
  hyper

SEQ ID NO: 87485 - DNA, 218 bp, Homo sapiens
  chr20:3641773-3641991
  hyper
cggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcaggtctcagtgcgccccgcatgcacacttca

SEQ ID NO: 87486 - DNA, 222 bp, Homo sapiens
  chr20:36526757-36526979
  hypo
atattttcacacatccggggcccctcctgctcccccctctccctctgggcttgttcacccacctcctagggtcagccctgctgctttctgggcatgtctatgccaagcctggagttccgcaccggtttcataccctcccatggcagataagactttaatagaattccattgctcctcagagctcagtaatgcattctggaaattaggcggctacatactaaa

SEQ ID NO: 87487 - DNA, 58 bp, Homo sapiens
  chr20:36530144-36530202
  hyper
tggggagtgggctgtcggaggggttgaccctgttcgacggggacggggaagaaagtct

SEQ ID NO: 87488 - DNA, 440 bp, Homo sapiens; identical to SEQ ID NO: 38073
  chr20:36531551-36531991
  hyper

SEQ ID NO: 87489 - DNA, 105 bp, Homo sapiens
  chr20:36571234-36571339
  hypo
gtcaaagtacaaagacgaatataacaaacatccttgctccccccaagtggagtgaatagttattagcatcctgatatatttgtcgtcagcctttatattgttttg

SEQ ID NO: 87490 - DNA, 893 bp, Homo sapiens
  chr20:3662307-3663200
  hyper
cagcggagtggcagccgggcagtgtgggcaagtccgggcccggggccagcccaagcacacttgagcgtccctgggcaggtcccacggagacccccccaaagagtccccacgccctgacctactggccgtatggtgccggggccgtgagaccctccgcgcgctgacccgagctctgagcagaacccatccccgccaccaccaccgcgcctagcctgcccctcagggcgcaccccgcccgcgtcctcaccttgaagcaccccggcgcctggcactggccagagcagcagcagtagtagcagcagcagcaacggggtcccccgagctctccggggcctccagcccatagctgtgagctcctcggcctctaggcagcggctcgcaactccggctccgcccaggctggattgcggccgacccgtgcccggtgcagcctcaggccgccgccttcggaccttcccgcccccacctcccaccgcccgccctcgctcccgcctcccctccccgccaaccccgctcggagcctggccaggggccccgacggcgcgcgccatgggggagccgggtcgccactcccggaccgccgcccctcgagggggtggagctgggcggaggagggaatccgtgcggcccctcggatgaccggcccgagccgtccctccccgtcggtctcagagggcctctactcctgagaggaggagagaaccgctgggaaggttcttggaggaccgcggcgtggtgggatgaggcggtgggcaaaggccgcctctcgctgctgaagttggccccaggagcgcgatcttccgtggtctcctggggccgatctctgtcccctccttgctacccgtcctgccccgagggtgccctggcggaggttgagtcgggtcatccacctg

SEQ ID NO: 87491 - DNA, 26 bp, Homo sapiens
  chr20:36666715-36666741
  hypo
tttttttttttgagacggagtctctt

SEQ ID NO: 87492 - DNA, 41 bp, Homo sapiens
  chr20:36760800-36760841
  hypo
tgataactggctccacgaggagggcccgcaccttgatgagg

SEQ ID NO: 87493 - DNA, 30 bp, Homo sapiens
  chr20:36764156-36764186
  hypo
gttcaggaaaggtcccgggcttctcgcctc

SEQ ID NO: 87494 - DNA, 41 bp, Homo sapiens
  chr20:36767876-36767917
  hypo
tgatcttcagcccaacgatcagggaacggttgatggatttg

SEQ ID NO: 87495 - DNA, 88 bp, Homo sapiens
  chr20:36775243-36775331
  hypo
tagttgttgtcccagcgtcccagcagcacaccctggtcatcgttgcagttgacctgcaaccagtggggcagcacggggactgagcctg

SEQ ID NO: 87496 - DNA, 57 bp, Homo sapiens
  chr20:36780994-36781051
  hyper
tgggggcactggggacgtgaagccttgcatataactggcactcgatcatattggtct

SEQ ID NO: 87497 - DNA, 33 bp, Homo sapiens
  chr20:36781339-36781372
  hyper
cgagggtggggacaccggcgtgttcctgtcctg

SEQ ID NO: 87498 - DNA, 379 bp, Homo sapiens
  chr20:36888856-36889235
  hyper
tgaaagggggcagagcgaggtggtccaggccttggcgcgttaccatggtgacgggctgccagcggcgggcggcgcggctcctctcctgggcgcggggtctgtgggtccgcgggtccgtctgtctggggcagccctcggtcccgcctagccctggagccaggggatagggcaggcccggggcaccgaccccggcgtcatctcggaggagcggccggggaggacagggagagagactgagagagagacagagagggactgaggctggagacggcgagagacataagggagccgcgggcggcgcgggtcgggccaccagacggggggcggcagcagaggcggggcggggcggggcgcggcgggacagcggcccctttgtgcc

SEQ ID NO: 87499 - DNA, 69 bp, Homo sapiens
  chr20:36978578-36978647
  hypo
aacgacaatcagactcgtagcacattgtacccctccctgctcactgctgttgggcgtttccttcattcc

SEQ ID NO: 87500 - DNA, 24 bp, Homo sapiens
  chr20:36990660-36990684
  hypo
gaggtcagggctgggcgcggtggc

SEQ ID NO: 87501 - DNA, 21 bp, Homo sapiens
  chr20:37088489-37088510
  hypo
aataaatgggctgggcgtggt

SEQ ID NO: 87502 - DNA, 188 bp, Homo sapiens
  chr20:3713295-3713483
  hyper
gggcggggtgggcggcgcgaggaggcgggaggcctcagggccgggcgcacgtcgagggctgcggccgccgcagcgggcacggccaacgagctgcgggcccgggatcgcggcggctggacggggctggagctgtcgggagggcggaggtgagttctggggcgggggctgccgggcgccccgagtggaga

SEQ ID NO: 87503 - DNA, 177 bp, Homo sapiens
  chr20:37208085-37208262
  hypo
tgcctgctctgcccacgcacaacaggacctccagctgggcctagtggccagagacgctgactgcacagtagccctgttttggtgtctggaaaggttttgtagccagaaaaaaaatgtgtgctcaagcctttcccagctatgctgctcagctctctctctgaccgcagccccttcagg

SEQ ID NO: 87504 - DNA, 38 bp, Homo sapiens
  chr20:37233304-37233342
  hypo
gggattacaagcgtgagccaatgcgcctggcccagaac

SEQ ID NO: 87505 - DNA, 30 bp, Homo sapiens; identical to SEQ ID NO: 38075
  chr20:37274701-37274731
  hyper

SEQ ID NO: 87506 - DNA, 74 bp, Homo sapiens
  chr20:3729991-3730065
  hypo
atccttggcccctaccgggcaccatatactgatggggggaagggcatgtttgcaaagcccgtctcttcctcctc

SEQ ID NO: 87507 - DNA, 999 bp, Homo sapiens
  chr20:37302402-37303401
  hyper
aggacctcttggaggcggtgatagttaagctgacacctgaagaagccagtcatgcaaagagtgggtcaacagctttccaaggcagagggaatcaggaaagcgatgggcttgtctgaggaacagaaaggacaacgaacgtgtgagtcacactaaggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagctggacccagggtagcgggatccggggcctctggggacccgagagggacgttaagttcagggcttcagggtgcagccctggggtcggtacccccagcctccaacccagagctggcagcgctcgcccccttctccgcgcgggccctcagctcagctccctcttcgctccccgtgtccccgcgagcgggagggaggggatgctaggacgccctgtcggcgtcgtcgccgctttccgccattgtttagtcgtgatgctctcattttctctgaatcaacaattttctgctcggctccgcgccgaccggcgaacgcggggcttttcctcgcccgcctgatgacagcagagcggcgcggagcagctggtccggaaggaagcgccaggcgcctgcccggtcccaggcgtccgctgccgcccacccacaccagaccccgcccccgcgcgtcaagccccgcccatccataccaagtcccgcccccacaccctcacccacacaccaggccgtccccaccccgcccccagagccccggggcgccccgcccgctagccgcgcacgcgcagtgagcacggcgacccccggtggtcgggtgtctccgcaggccgaacacgctgctcgcccagctgcggatcattaccgcccttttgttctccgtcgcgcgctcgccccacgctaggaatgcaaactgtaggcgccgccagccccccctt

SEQ ID NO: 87508 - DNA, 1094 bp, Homo sapiens
  chr20:37351422-37352516
  hyper
gagagaagcctcctccgggagactgggaggggcttgggatgggaggaggtggcaggaggcgggagggtgtagagagggaagcctgtcttgtcctggcagctccaactctctggccaaagccctcgggccgccctacttgtgcgctgacgtgagctaatctagaaatactgcagagaaagagtggctggggttcccagggagaaagggcctcgagagaggggagatggggagctgcttccttttttgtttccttcggtttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggc

SEQ ID NO: 87509 - DNA, 1113 bp, Homo sapiens; identical to SEQ ID NO: 38078
  chr20:37352606-37353719
  hyper

SEQ ID NO: 87510 - DNA, 1026 bp, Homo sapiens; identical to SEQ ID NO: 1468
  chr20:37353806-37354832
  hyper

SEQ ID NO: 87511 - DNA, 1050 bp, Homo sapiens
  chr20:37354993-37356043
  hyper
cgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatc

SEQ ID NO: 87512 - DNA, 660 bp, Homo sapiens; identical to SEQ ID NO: 38082
  chr20:37356168-37356828
  hyper

SEQ ID NO: 87513 - DNA, 1027 bp, Homo sapiens; identical to SEQ ID NO: 38083
  chr20:37357215-37358242
  hyper

SEQ ID NO: 87514 - DNA, 104 bp, Homo sapiens; identical to SEQ ID NO: 38084
  chr20:37359606-37359710
  hyper

SEQ ID NO: 87515 - DNA, 36 bp, Homo sapiens
  chr20:37367644-37367680
  hypo
gggattacagatgtgagccaccgcacctggcacttg

SEQ ID NO: 87516 - DNA, 241 bp, Homo sapiens; identical to SEQ ID NO: 38085
  chr20:37434112-37434353
  hyper

SEQ ID NO: 87517 - DNA, 234 bp, Homo sapiens; identical to SEQ ID NO: 1474
  chr20:37434488-37434722
  hyper

SEQ ID NO: 87518 - DNA, 158 bp, Homo sapiens; identical to SEQ ID NO: 1475
  chr20:37434736-37434894
  hyper

SEQ ID NO: 87519 - DNA, 440 bp, Homo sapiens; identical to SEQ ID NO: 1476
  chr20:37434930-37435370
  hyper

SEQ ID NO: 87520 - DNA, 229 bp, Homo sapiens; identical to SEQ ID NO: 1477
  chr20:37435487-37435716
  hyper

SEQ ID NO: 87521 - DNA, 215 bp, Homo sapiens
  chr20:37435717-37435932
  hyper
gaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtact

SEQ ID NO: 87522 - DNA, 30 bp, Homo sapiens
  chr20:37536400-37536430
  hypo
cacaggtcctggccccgtcccccacaacag

SEQ ID NO: 87523 - DNA, 30 bp, Homo sapiens
  chr20:37549668-37549698
  hypo
gcccaacccactgagcgcctgaggccattc

SEQ ID NO: 87524 - DNA, 1009 bp, Homo sapiens
  chr20:3758173-3759182
  hyper
ggggcagccctgagccgtaaccttcaaaccttccgcctcagtaccccgtgcgcgaggagggaggggcgactgctacgggcacatcgtcgatgtcctccctactcctggcgatcccacgcctcaccccttcctctccagctgctgcggtctccgtcgccgaggtgggtcccaggtaagctcccaggaggggcaggggagcccctcagcggcccgggacagattcccccatggctgagggcatggggaactagcctggatggagacgccgccgtcctcggagctgggcggggacctgattctgggggtgtggacagagccaagggaccgccccccaaggcccagcgccgggagatgcaaggccgggcccaaggtgttggacactgctttgggggacaggctaggtctctgcacgtggcttctgggctctggaaagcggtccattctcctgacccggatctccggagtggtaggaggcggctcagtcccgggcctgcgctcctagagttcctgtcccatctcctcccacgctcacccatcccaaggaaggagggcactcgggccccagcaggctcgtgagagcagcgggctccgccctcccaatggtctatccatcggtgggtgggtccggcgcggcgtcggggctctggcgggtacccgggcgtccccgcgcggcccgggccgccgctcaccgctgcttacgctccgcctgctggagccgccgggagaggtcttcgatccgcacattcttgagctggagcaggtgctccaggcgccttaccttcatctgcaggacctaagccgcaccgcgcaggcgtcaagcctggcggtctgctccctcctgcccggcctctgctggccgcgagcccccacccgcagccttcctagacccctcacctgcacggtctcttgagaggccaacagctcctgctccttttcagcgatctggaggacgaagctggggtcgccctgcaacgcccggttatacgctggaggccgaggcgccggcggc

SEQ ID NO: 87525 - DNA, 37 bp, Homo sapiens
  chr20:3763466-3763503
  hypo
tccaactccagggctcggatttcgggagggaaggtgg

SEQ ID NO: 87526 - DNA, 119 bp, Homo sapiens
  chr20:3764967-3765086
  hypo
gggagaggcactctccggccgggaacctccagggcccatccctggctgctgctgtggttagtccactgagggcacggtgtggtagcaccggacagctccccacccgccccacctggtcc

SEQ ID NO: 87527 - DNA, 85 bp, Homo sapiens
  chr20:3766966-3767051
  hyper
gacgccaggatggcgcgcttgttcttcaggatcgtgctcagcgtggacggcgggatgttgaagcgccgcgcgatctcgcccttgc

SEQ ID NO: 87528 - DNA, 30 bp, Homo sapiens
  chr20:37799258-37799288
  hypo
cattgagcacagctgcgggttgaggccagg

SEQ ID NO: 87529 - DNA, 30 bp, Homo sapiens
  chr20:3802377-3802407
  hypo
ctcttcagtctccttcggtctggagcagct

SEQ ID NO: 87530 - DNA, 31 bp, Homo sapiens
  chr20:38134545-38134576
  hypo
taaaataagaagattccgttctcactcatat

SEQ ID NO: 87531 - DNA, 26 bp, Homo sapiens
  chr20:38186909-38186935
  hypo
cctcggcctcccgaagtgcacattga

SEQ ID NO: 87532 - DNA, 120 bp, Homo sapiens
  chr20:3820930-3821050
  hypo
cactccagtcgctgcactctcgccaaaaacaaaaacaaataaatatgattgagtattaccataggctctggttcctgccctgagggaaggtgagttaaaaagcagtcagaggccgggcat

SEQ ID NO: 87533 - DNA, 30 bp, Homo sapiens
  chr20:38244640-38244670
  hypo
tgaatgtcaaactttcgataaccctttaat

SEQ ID NO: 87534 - DNA, 17 bp, Homo sapiens
  chr20:3826486-3826503
  hypo
gggcgtagtggctcacg

SEQ ID NO: 87535 - DNA, 168 bp, Homo sapiens
  chr20:38808911-38809079
  hypo
tgcaatgaaatagtacggtaaagatttgggatcaaaaaaaaaaagtctgcttcgtttaagaaacagggattagcgcagatggaatatagggtatgttgaaagaaatgagagagatgtgactagagaaacacatcagaaccatgtcaccattgtcgcagaggaccagct

SEQ ID NO: 87536 - DNA, 952 bp, Homo sapiens
  chr20:39315901-39316853
  hyper
atttttctatataatcgagcaggcaataaaactgatgagatttgggcgccgagcgtcctaactgaggcctgtgtctcagggctgagagccagtgttctccgaactctgacagacaggtccgtctgtccttccttctttcgctcagcctcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggtcccctgcccgcccgcgcacccgcccgtcgcccgcggcccgcgcgcccttcctccctctcgctcaagtcaaacaggtcaaggctggggccgcggcagggacagggtccggggtagtctgggactagggacgtgggacagggagtccgggccggggcaagggcgggggccaggaccggccacgactcacagaaagaactcgggagaggaggggctgtcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgt

SEQ ID NO: 87537 - DNA, 51 bp, Homo sapiens; identical to SEQ ID NO: 38092
  chr20:39316983-39317034
  hyper

SEQ ID NO: 87538 - DNA, 999 bp, Homo sapiens
  chr20:39317035-39318034
  hyper
tgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcag

SEQ ID NO: 87539 - DNA, 327 bp, Homo sapiens
  chr20:39318877-39319204
  hyper
gcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccc

SEQ ID NO: 87540 - DNA, 152 bp, Homo sapiens; identical to SEQ ID NO: 38095
  chr20:39319514-39319666
  hyper

SEQ ID NO: 87541 - DNA, 30 bp, Homo sapiens
  chr20:39435965-39435995
  hypo
atggctggcaggggccggggaggtagcggt

SEQ ID NO: 87542 - DNA, 40 bp, Homo sapiens; identical to SEQ ID NO: 46164
  chr20:39687444-39687484
  hypo

SEQ ID NO: 87543 - DNA, 30 bp, Homo sapiens
  chr20:39739532-39739562
  hypo
cctgctggatctaagcggggtggcttctgc

SEQ ID NO: 87544 - DNA, 250 bp, Homo sapiens
  chr20:399939-400189
  hypo
gtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtccttggcctcagtatcctcttctgtgcccctcccttgcctcaccctgcccagtcgggctcacagcacc

SEQ ID NO: 87545 - DNA, 201 bp, Homo sapiens
  chr20:39994530-39994731
  hyper
ctgcctggcataagccgaccgctgtggacggctgtgccacagcacaggcccggagccaggagcccgctctggctctgcagcccggccacgctggggctcccatggggttgctggggccaggctgactgcgagagggcagcggccgcccggatgcgcagctctatctcctacctggccgggccaggggagagaagggaggcc

SEQ ID NO: 87546 - DNA, 784 bp, Homo sapiens
  chr20:39994762-39995546
  hyper
cggaccgcctttcctcctctccctccacctggtccgctcgcccggagtctgcacacagcgcagctggaaaatgttacttcgctggaaaggtttccgctggcactgccaggatcccaagccgccgcgccaggccccctcggttcctttttcctcgccagccccgcaacctcccggagcgtagggcgctcgcctgggcaggggctcggccccgggcgccgccccctctgtgcagcggcctcggggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctc

SEQ ID NO: 87547 - DNA, 313 bp, Homo sapiens; identical to SEQ ID NO: 38099
  chr20:39995547-39995860
  hyper

SEQ ID NO: 87548 - DNA, 30 bp, Homo sapiens
  chr20:40020573-40020603
  hypo
ggctaaaggctcccacgcagcatggggcat

SEQ ID NO: 87549 - DNA, 41 bp, Homo sapiens
  chr20:4010137-4010178
  hypo
tataatcacacctgcatcctccctcccgacccgccttttcc

SEQ ID NO: 87550 - DNA, 1155 bp, Homo sapiens
  chr20:401016-402171
  hypo
cattccccttggacccggtgctgcccctggccaccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtct

SEQ ID NO: 87551 - DNA, 66 bp, Homo sapiens
  chr20:40321459-40321525
  hyper
ctcaggcaaaggccacgtctcggaacagttggctgcacaggtcacgtgacgcgcccctagcccggc

SEQ ID NO: 87552 - DNA, 106 bp, Homo sapiens
  chr20:40457626-40457732
  hypo
gggccaggatgcaagcggagtgcagcctgccaggcccagtgggcagagtgagcccagcaggcccaagcaaggccctaggcagtggtcatggcggccacagagattt

SEQ ID NO: 87553 - DNA, 17 bp, Homo sapiens
  chr20:4066865-4066882
  hypo
ctcgtgtcttcagttcc

SEQ ID NO: 87554 - DNA, 30 bp, Homo sapiens; identical to SEQ ID NO: 46165
  chr20:40715181-40715211
  hypo

SEQ ID NO: 87555 - DNA, 89 bp, Homo sapiens
  chr20:4085057-4085146
  hypo
ctcatgttgtagaggcgcaaaagccattcggcaccctttcatgtttttgttgtataaattctttcagtaaattttggattcccggctgg

SEQ ID NO: 87556 - DNA, 30 bp, Homo sapiens
  chr20:41607723-41607753
  hypo
gttgtcaacgtaaatcgagaaaaaatggta

SEQ ID NO: 87557 - DNA, 699 bp, Homo sapiens
  chr20:41817217-41817916
  hyper
accagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccggg

SEQ ID NO: 87558 - DNA, 742 bp, Homo sapiens; identical to SEQ ID NO: 38101
  chr20:41818007-41818749
  hyper

SEQ ID NO: 87559 - DNA, 390 bp, Homo sapiens
  chr20:41818804-41819194
  hyper
cgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccacaatcgtc

SEQ ID NO: 87560 - DNA, 35 bp, Homo sapiens
  chr20:4186660-4186695
  hypo
tattaaaagggaaaccttaccgaggacttccttac

SEQ ID NO: 87561 - DNA, 90 bp, Homo sapiens
  chr20:41935531-41935621
  hypo
aaaaacttctagtaagagtgtttctaaaccgcaccagaaggcttttatccctactgggtctgaccccaaaggggacgcattccaagagcc

SEQ ID NO: 87562 - DNA, 124 bp, Homo sapiens
  chr20:42019051-42019175
  hyper
gagcaggaaccctggcggcctctgaggcgggggcggtggggggcgctgggggcgcggagttgcagccggcagaggagcagtggcgccacctcctgacgccttcggggaacgcagctgatgccag

SEQ ID NO: 87563 - DNA, 273 bp, Homo sapiens
  chr20:4202505-4202778
  hyper
cggcgctccggggggcgcgtcgcccgaactcggggcgcagtcctggcgcaggccgctggtggaggcccgccagtggtggccgtagacacgccagagagggcggcggcgccggcgacgacggcactggcagcgcaggagacggaggaaggcgcgcttgaactcgcggctggaacaggggtagatgagcgggttcacgcagctgttgaagtagccgagccagaagatgaccttgaagacgccctccgatggcttcagctgcgggaacaaggagcc

SEQ ID NO: 87564 - DNA, 134 bp, Homo sapiens
  chr20:42088631-42088765
  hypo
atgttttaagatttccgagtctgaccaatcttgtctttcaggattttatgcgacaagcaggtgaagtaacctatgcggatgcccacaaggaacgaacaaatgagggtgtaattgagtttcgctcctactctgac

SEQ ID NO: 87565 - DNA, 691 bp, Homo sapiens
  chr20:42136052-42136743
  hyper
gctccgcggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcggcgcccggctcggaccgtagctaggcgctgggcggccaccggctggccaggcaggtaagcaaccagcggtgcgtgggctcagaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaagagtttttttattaatggaaaggtgtggagggcggggttttggtttt

SEQ ID NO: 87566 - DNA, 172 bp, Homo sapiens
  chr20:42199155-42199327
  hypo
gagagggagtgagctcgcagccgcacagggcggggagcaggtgcaccctagccctacagcagccacccaataactcctgtcacactcctcctcccctccagctcttcttccacctgcagcgggagcgccggttcctggagccccgggccaggttctacgctgctgaggtggc

SEQ ID NO: 87567 - DNA, 102 bp, Homo sapiens; identical to SEQ ID NO: 1637
  chr20:42218592-42218694
  hypo

SEQ ID NO: 87568 - DNA, 16 bp, Homo sapiens
  chr20:42292357-42292373
  hypo
tctttttttgctgggc

SEQ ID NO: 87569 - DNA, 1273 bp, Homo sapiens
  chr20:4229327-4230600
  hyper
tcaccaccagtcccccgacggccgccgtgccattcacgtcgccgcccgcgcccgcgctccccggctcccccgcggagctccggttgtcctcgccgctgcctgcgcccaccacgccgccgccgccgcccgcgccccccggcacgccgcccaccgccgggccctccgagggggccgcgccgcccgcgctgcccccgccgccgcccgcgctggagccccctgcgctgctgtccgggcggggtccctcgaaactgacgctcaggagatcgcggaaagtcatctcaacgcgcggccgtcggtggccgggccggggcacagaacgagcggccggcagggaggggagcacagggcatagccgcggggctccagatgcagctccgcgcacgggtcccgtcggggtcctgcccaagttcctgtgacgcggagcgcggctgtccgagagcggagctgcctggcccgggcggcggccgggctccccgaggccggccgtggagtagcaccgaagagccggggcccgctacgcgcgcggcgctctgagcgtgcccggcaagcgggcaaagcggcggctccggggccgggcggtgcaggcagcggccactgcggcgctcccaactcggcgcggggggcgggaccgaggaggggcagcgccaggaaggaggagggggcgacccgggccgagagacgggcgccacactccagggtagaagggacccttcgctcaggacaagcgattgtgtcggggtccggggggctgcggcgctggcgcgcgctcgggtcccgcagcagccacccacgcctctccgcaggtgcccaagcccgcgctctcccctagcggtgccctttgcgttccttcccgctcctctcccggaccccctcccccttggccctcagcggcgtccctcttcctcccgccctctcccccgagtctctcggtcactcgctggtgcccttgggcgcgcggtgcgttgaaggcgtgagtcccgggtcttcgggatcccggctttggccgccagagagcagcaagcgcctgggatctgcggactgcggaccggacggcgcagtgccgctgcgggttgcctcctgggactgcccgcatggatctgccgcacctcctttttctcacgccactggccagggcagggtttcagacgcctctgtccagtgcgatggcgtgaagagagcccaggaagggtcggaagcctgtgctgggcagaggctgggtacgatgggctcaggagcagcaggctgtggctacagccctcggaccctgcccaag

SEQ ID NO: 87570 - DNA, 30 bp, Homo sapiens
  chr20:42346104-42346134
  hypo
accacacctaactcacgccctgagcttttg

SEQ ID NO: 87571 - DNA, 31 bp, Homo sapiens
  chr20:42402544-42402575
  hypo
aattccagtcctggccgggcccatttgtcca

SEQ ID NO: 87572 - DNA, 1452 bp, Homo sapiens
  chr20:42543082-42544534
  hyper
ccttcctcttccccccgcacccacgccgcggggcggggactagcgccgcctcaaatatttagggcaagggagtgtcccacttctggggaggggtgccgttcgggcttctctcctcaccgtgggtggcgaaaggcgggacggaaaagcgccgtctggacaggcgcgcccccctcagggatgcagggccgggcgggggacccggcggcggcccagcccggaggaaggacctccacgccccggcccgggcccccgggcccccggccctaggcagcgcccgaggccggaacaatagcgcgcgcgggcggggcgggggcgggggcggggcgctcctctgggcaccgcccccggcccgccccccgcgctcgcagtcccgctcgcacactggctcccacccgccgcccgcccaggcactgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgc

SEQ ID NO: 87573 - DNA, 309 bp, Homo sapiens
  chr20:42544727-42545036
  hyper
cgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggccccaggggagcggcttctggcaaag

SEQ ID NO: 87574 - DNA, 170 bp, Homo sapiens; identical to SEQ ID NO: 13811
  chr20:42587835-42588005
  hyper

SEQ ID NO: 87575 - DNA, 226 bp, Homo sapiens
  chr20:42721431-42721657
  hypo
gagcatgtcttcccccggtctcacatagttccatctcacacatgcactgatcagcaatctgccaagtaagggagacactctgcaaacacctggggtgctgtgtgtaattctcttctctctgggactctgtcctgagaaatctgcctaccttggttttcccaggctctcagccagtgtcctcaactcacggattctgccaagttccctgtctcggcactgcgacctg

SEQ ID NO: 87576 - DNA, 92 bp, Homo sapiens
  chr20:42777351-42777443
  hypo
cccctgattcaacaccgggcagactgccacctcaacactctccttcctccaattaaaaaaatcaacaatcggccgggcgtggtggctcacgc

SEQ ID NO: 87577 - DNA, 31 bp, Homo sapiens
  chr20:42777683-42777714
  hypo
caacagagcaagactccgtctcaaaaaaaaa

SEQ ID NO: 87578 - DNA, 17 bp, Homo sapiens
  chr20:42823271-42823288
  hypo
attttatttttgagacg

SEQ ID NO: 87579 - DNA, 194 bp, Homo sapiens
  chr20:42840769-42840963
  hypo
ggctcagtaactgaccggttgaaagaaaactgttcattgtaacctaatgatgctagttagatagcattagattatgttagagatcagataacttgttctagctgcctttgtcctgtctcacagtgctagtaagtcaggatttaaactgcccttctcaacatctcttggacaagaaaaagcgggaaatatgatgt

SEQ ID NO: 87580 - DNA, 30 bp, Homo sapiens; identical to SEQ ID NO: 46169
  chr20:42853157-42853187
  hypo

SEQ ID NO: 87581 - DNA, 276 bp, Homo sapiens
  chr20:42876029-42876305
  hyper
cgctggagagcgatgcggccaagccagcggaggcccccgacgctcccgaggcggccagccccgcccattggcccagggagagcctggttctgtaccactggacccagtccttcagctcgcagaaggtagagccgggccgggagccgcctgcgccggtggccaggaagcttggggaggggagccccagggcttgagggatctgagggcggcgaaagactggaggggggaacctggggtttgggggtcccggaggtcgggggacgcaagggttccttc

SEQ ID NO: 87582 - DNA, 122 bp, Homo sapiens
  chr20:42876545-42876667
  hyper
cttggggtccagcctcggtagccccctctcagtcgctccctgcacgctgccgtcccggacactgcaggcccccaggtcacagctcctctgcccctctgtctgcgggccgccttctggctagg

SEQ ID NO: 87583 - DNA, 30 bp, Homo sapiens
  chr20:42931309-42931339
  hypo
atattacaagacatacggggaaaaacagga

SEQ ID NO: 87584 - DNA, 46 bp, Homo sapiens
  chr20:42955385-42955431
  hyper
gggccggtggcaaggcgcgggggcgcgggggcgggatggggggagg

SEQ ID NO: 87585 - DNA, 30 bp, Homo sapiens
  chr20:42979880-42979910
  hypo
aaaaacctggcacctcggttttgtaactct

SEQ ID NO: 87586 - DNA, 89 bp, Homo sapiens
  chr20:43017310-43017399
  hyper
gaacaccagttcctgcgttggccacgaggaggagcccaggaagcgcaaagcgcagcactgcggagagtcttggccgcctcctccgggac

SEQ ID NO: 87587 - DNA, 30 bp, Homo sapiens
  chr20:43048609-43048639
  hypo
ctcatctcatgttaacgacagccaggagag

SEQ ID NO: 87588 - DNA, 38 bp, Homo sapiens
  chr20:43052738-43052776
  hypo
accgccagtatgactcgcgtggccgctttggagagctg

SEQ ID NO: 87589 - DNA, 169 bp, Homo sapiens
  chr20:43065628-43065797
  hypo
accagcatcatttgccgtaaataagaggtgactgcaaaattagtgaaaagaaaacaatgtttttcagctgcagccaggtggaatcgccccagggaaagctctgctcttgttttcgtattaaaaaggaaaactgacaaatattacagagatgttacgggcatacacgtac

SEQ ID NO: 87590 - DNA, 113 bp, Homo sapiens; identical to SEQ ID NO: 46171
  chr20:43276908-43277021
  hypo

SEQ ID NO: 87591 - DNA, 213 bp, Homo sapiens
  chr20:43295109-43295322
  hypo
atacatatatgaggacgacaatgatgatgatgataatgagaacagctagccagcactgagtgcttactgtgtactgggctccgtgctgggtgctgtatgagcacctgctgttggtctcatgcacacctatttatgttggttttgagtaacttgtgcaggtatacctttgatttaaaattttggtttctatttagactacgataggaatttttg

SEQ ID NO: 87592 - DNA, 174 bp, Homo sapiens
  chr20:43379820-43379994
  hypo
tggttttctgagtaacggttgaaatgtgcaactttcaacactggaatcttcgctgcaattagtgaggtcagatgctcacactacgagaagcatggggaacaaaggtggaccaaatgggaccgtgtacagtccagtgttgacaagggggtcaatctcttgcgctaaacgatctca

SEQ ID NO: 87593 - DNA, 32 bp, Homo sapiens
  chr20:43382837-43382869
  hypo
tgggattccacccaccgcggtcccaggaaact

SEQ ID NO: 87594 - DNA, 122 bp, Homo sapiens
  chr20:43385505-43385627
  hypo
acacacacacgtgagcgcgtcaatgcccctcacctggaggactttgccctggggactctcaggaaacagcagcacctggttatacagtgggtccagcgacttgcgagcgactttggtcttct

SEQ ID NO: 87595 - DNA, 57 bp, Homo sapiens
  chr20:43416117-43416174
  hypo
gttcaacaaaatttacgcagcctggaggtggcagggctgggacgggaacaccggccg

SEQ ID NO: 87596 - DNA, 76 bp, Homo sapiens
  chr20:43438010-43438086
  hyper
cagctccccacccctcgctctggctgaggttgtgcgcaggcctgggaggaggaggttcaagccgctggctggtggc

SEQ ID NO: 87597 - DNA, 885 bp, Homo sapiens; identical to SEQ ID NO: 38113
  chr20:43438334-43439219
  hyper

SEQ ID NO: 87598 - DNA, 312 bp, Homo sapiens
  chr20:43439247-43439559
  hyper
cgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcccacacag

SEQ ID NO: 87599 - DNA, 126 bp, Homo sapiens
  chr20:43726504-43726630
  hyper
tggcagaagaagttgcgcgtactgggcgccagcaggaggcgcgacgacacctcgaagctgaaccaggcgatgcagaagtactcgaggcgtcgcagcaccgggtcgtcgcgcacgccttccgggctg

SEQ ID NO: 87600 - DNA, 104 bp, Homo sapiens
  chr20:43726764-43726868
  hyper
cgagtagcccgggttctccatggtcagccagaggcggcggcgcaggcggccacagcgcgccgcgccatagcgcgccagttctcgctgcacgtcggagatctcgt

SEQ ID NO: 87601 - DNA, 15 bp, Homo sapiens
  chr20:43729562-43729577
  hyper
tgtggtggcacctcc

SEQ ID NO: 87602 - DNA, 372 bp, Homo sapiens
  chr20:43922168-43922540
  hyper
cgtgccggtctagcacgtgccccttccctcaccacccgctatccccctgacgccgcagtccgcctaatggtccgggcgaggccaactcagctcaatgccggaagcccgccagcgcctccgccccgacagcccaagccggacgggcccaggttctgcctggccccggcgcaccgatggcgcgcaaggggcaccgtccgtggtgccgcgccccagcccgggtctgggccgtccgtggccctcacttctggttggccagctggttctccagatcctccaggcgcgccgtcagctgggccagtgagcggttaaggaggccgttggggttcgccgaggtcccttcactttccctccagcccgcgccaccagccccaa

SEQ ID NO: 87603 - DNA, 171 bp, Homo sapiens
  chr20:43926590-43926761
  hypo
ggtgcgtcatggtgccgaagtccggggcataggacacgtgcagttccgctggctccgaggcgatctcgcgcagctccgcctccaccgccttgcccacgcccacggcgtacatgacgatgcctgcaaggccggggtctcagagggtgccccaggcctcgggaaagctgcctc

SEQ ID NO: 87604 - DNA, 21 bp, Homo sapiens
  chr20:43952338-43952359
  hypo
caggatcgtctcaatctcctg

SEQ ID NO: 87605 - DNA, 36 bp, Homo sapiens
  chr20:44006173-44006209
  hypo
ctcaccgttctcagacggttccgctcaattactttg

SEQ ID NO: 87606 - DNA, 32 bp, Homo sapiens
  chr20:44420207-44420239
  hypo
ttacaggcgtgagccaccgcccctggccgagc

SEQ ID NO: 87607 - DNA, 21 bp, Homo sapiens
  chr20:44421911-44421932
  hypo
acactttgggccgggcgcggt

SEQ ID NO: 87608 - DNA, 389 bp, Homo sapiens
  chr20:44452665-44453054
  hyper
cgtctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgccgctgcctgcgggca

SEQ ID NO: 87609 - DNA, 135 bp, Homo sapiens
  chr20:44462871-44463006
  hyper
gcggcacgccttggccggcgacggccccggggaggcggcggccagtccagaggccgagcagtttccggagagctcagagctggaggacgacgacgccgagggcctgtcctcccgactcagcggcaccctcagctt

SEQ ID NO: 87610 - DNA, 40 bp, Homo sapiens; identical to SEQ ID NO: 46174
  chr20:44477901-44477941
  hypo

SEQ ID NO: 87611 - DNA, 23 bp, Homo sapiens
  chr20:44509241-44509264
  hypo
acccgcggtggctcacgcctgta

SEQ ID NO: 87612 - DNA, 336 bp, Homo sapiens
  chr20:44518882-44519218
  hyper
acctacagccatactcgagctggacaaggcgcacgctctttgtggaagcaaacacgtccaccaccgcgtagaggggctgcgcagctggcagtccccgggcgctcgggcccatgtcctcgccgttgatgatgatgtgcatgtcggccgtgccatcggggcgcgggcaaaagaggacacccaggcggctacggcgcgcggtcggaggcagcacgttcagctcatagagctggtccaagagatggctgtagagccctggccggctgcggcccaccaggcggtcccggggaatgcgaaactgctcaatgcgcagatatggttccacgaggagggttggag

SEQ ID NO: 87613 - DNA, 48 bp, Homo sapiens
  chr20:44540105-44540153
  hyper
ggggtggggtggggtcgcaggagttatctgagccgcttaaacccattc

SEQ ID NO: 87614 - DNA, 383 bp, Homo sapiens
  chr20:44540444-44540827
  hyper
acgttgccacggcaacgactgcacgcgcattcttggagggtggcttgcggtctcataggcctcgcgcccggggaggagaggaggtggccgaccagaccgtgggctcccgggtctcccggctccctcaggtcctaaatctctcccattagagattctgcctggagcccccatgttagcgttctccttcatcggctctcctccccacgccggcttcagtgcaccacgcggctcggcgagggactgggaacgggatagggacgcgccccaactcactcagcggtggagctggggggcggcgcggtcacgtgggatggcgggcagctcaggggatccgggcgacggggtctggcgggcagggttgttccagccgcctttataaagcc

SEQ ID NO: 87615 - DNA, 30 bp, Homo sapiens; identical to SEQ ID NO: 46175
  chr20:44562147-44562177
  hypo

SEQ ID NO: 87616 - DNA, 46 bp, Homo sapiens
  chr20:44569195-44569241
  hypo
gaaagcggcagctctcggaagagcagccaagcggcaatggtgtgaa

SEQ ID NO: 87617 - DNA, 23 bp, Homo sapiens
  chr20:44601506-44601529
  hypo
taatagagctgaggccgggcgct

SEQ ID NO: 87618 - DNA, 240 bp, Homo sapiens
  chr20:44601829-44602069
  hypo
tcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaa

SEQ ID NO: 87619 - DNA, 608 bp, Homo sapiens
  chr20:44639138-44639746
  hyper
aagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacc

SEQ ID NO: 87620 - DNA, 8 bp, Homo sapiens
  chr20:44639846-44639854
  hyper
cgctccta

SEQ ID NO: 87621 - DNA, 4 bp, Homo sapiens
  chr20:44640284-44640288
  hyper
actc

SEQ ID NO: 87622 - DNA, 55 bp, Homo sapiens
  chr20:44640312-44640367
  hyper
cgacggctaccgctggtgcgccaccaccgccaactacgaccgggacaagctcttc

SEQ ID NO: 87623 - DNA, 276 bp, Homo sapiens
  chr20:44640624-44640900
  hyper
cccaggcaccgcccacgggtctagcctcttctcaggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgct

SEQ ID NO: 87624 - DNA, 128 bp, Homo sapiens
  chr20:44642404-44642532
  hyper
cggctctccaagaagcttttcttcttctctggttagttacctactttccctcccccgcccggtcaatccccatcagtcaaggaggctcaagagaccatcgataacccacgaaacgtcttgtgcgtttt

SEQ ID NO: 87625 - DNA, 340 bp, Homo sapiens
  chr20:44650172-44650512
  hyper
cctcctcaggcccttcgggtggcactggggagcccagggcctcccagcgaagtggccagattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggg

SEQ ID NO: 87626 - DNA, 122 bp, Homo sapiens
  chr20:44657718-44657840
  hyper
ctccccccaaaaccccgccagtggctcacgcctcctgcatacgggatgaggtgagcagcgccgctgctgagagggggcgcgcgcgggtgtgagcgtgtgtccgtgtgcgagtgtgtgtgcgc

SEQ ID NO: 87627 - DNA, 358 bp, Homo sapiens
  chr20:44657944-44658302
  hyper
cggcgcagccatccccggaccaggggccgcgccgccaccatgctaaacaacctgacggactgcgaggacggcgatgggggagccaacccgggtaagctgtggtccgggggcggcgggggagggggcagcgaggagaggaggcagctctggggttagaggcggagcgggggccacctccttcagagaggaggctgggactgacccgggcggtgggcgccagttgcagcctggagctcagctccattggaatgctccgggcgctgtccaaggtgctggaatgcgccgcgcccgggggcagagctgcgggccgggggattatcgctgcccacggcttcgggctgacttgggttagctaaac

SEQ ID NO: 87628 - DNA, 75 bp, Homo sapiens
  chr20:44658361-44658436
  hyper
cgggaggagggctcctttccccgacaggggaccccggcgtcctggcgcagagcaggcacccgtggagccgggggg

SEQ ID NO: 87629 - DNA, 171 bp, Homo sapiens; identical to SEQ ID NO: 38131
  chr20:44659126-44659297
  hyper

SEQ ID NO: 87630 - DNA, 30 bp, Homo sapiens
  chr20:44659623-44659653
  hyper
ttgagtctgcggcagcgccaggcatcccga

SEQ ID NO: 87631 - DNA, 30 bp, Homo sapiens; identical to SEQ ID NO: 38132
  chr20:44660307-44660337
  hyper

SEQ ID NO: 87632 - DNA, 356 bp, Homo sapiens
  chr20:44660605-44660961
  hyper
cgttcagggaggggacgaaatcagccctggctgacaagtcccgggagcctggcgtcccgcccaggcagctactggaaaggcgggacccagaactagcctacctagccgccctctcccctgccctcatctcctggcccggatccggcctggagtctggctccgcgctgcgcgccgcgttacataagcggctgcgggcgcgcggccggctaggctcggcgctgcgctctcggcctgcgcggtcgccatggagaccggcgcggggccacctagttgcagggtctcgggccaggaagcccctattcctgtcccctgagcgccacccgcccccgcgaaggaggaggcgcttgggagggggt

SEQ ID NO: 87633 - DNA, 30 bp, Homo sapiens
  chr20:44681660-44681690
  hypo
cctgggaaccctgagcgcttctctgagggc

SEQ ID NO: 87634 - DNA, 177 bp, Homo sapiens
  chr20:44685860-44686037
  hyper
atcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctc

SEQ ID NO: 87635 - DNA, 193 bp, Homo sapiens; identical to SEQ ID NO: 38136
  chr20:44686422-44686615
  hyper

SEQ ID NO: 87636 - DNA, 179 bp, Homo sapiens
  chr20:44686627-44686806
  hyper
cgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttat

SEQ ID NO: 87637 - DNA, 129 bp, Homo sapiens; identical to SEQ ID NO: 38138
  chr20:44687107-44687236
  hyper

SEQ ID NO: 87638 - DNA, 42 bp, Homo sapiens
  chr20:44720305-44720347
  hypo
attgagaggtgacagcgtgctggcagccctcacagcccttgc

SEQ ID NO: 87639 - DNA, 18 bp, Homo sapiens
  chr20:44723384-44723402
  hypo
gcccggcccatgaagacc

SEQ ID NO: 87640 - DNA, 40 bp, Homo sapiens
  chr20:44747259-44747299
  hyper
cactggctgcccaagcgtgcctagacggcctggacgggtt

SEQ ID NO: 87641 - DNA, 47 bp, Homo sapiens; identical to SEQ ID NO: 46179
  chr20:44756555-44756602
  hypo

SEQ ID NO: 87642 - DNA, 145 bp, Homo sapiens
  chr20:44802981-44803126
  hyper
aggaatggaagagtccgctcctagcaagtcccccctccgtccagccgccaagggagggttgggggagggcaggaaagggggtccgcgggggaaacgcgttgtcctggggccccggcgtgtgctgggcgggtgagcagccgcgccc

SEQ ID NO: 87643 - DNA, 638 bp, Homo sapiens; identical to SEQ ID NO: 38141
  chr20:44803172-44803810
  hyper

SEQ ID NO: 87644 - DNA, 85 bp, Homo sapiens
  chr20:44845479-44845564
  hypo
gcgggttgtcattgacgtcggtgactacgatggtgacggtagtggagcccgagaggccacccagctgacccgccatgtctgtggc

SEQ ID NO: 87645 - DNA, 60 bp, Homo sapiens
  chr20:44879731-44879791
  hyper
ggttccacacccagccgcgtttgacgcggccggctcccagcgcgccgtcctgccgagctc

SEQ ID NO: 87646 - DNA, 127 bp, Homo sapiens; identical to SEQ ID NO: 13829
  chr20:44880040-44880167
  hyper

SEQ ID NO: 87647 - DNA, 26 bp, Homo sapiens
  chr20:44880275-44880301
  hyper
cgggttggggccggcagatcctgcca

SEQ ID NO: 87648 - DNA, 145 bp, Homo sapiens
  chr20:44893551-44893696
  hypo
cacacataccgtgtacacatgcagactccttggctagcactgctcacctgcccaggggcaacctgttagaaccctccacctcaggtgcccctggcctgcacctgtctccctgccctgcccccaccctgcccgtgtgccggtgcca

SEQ ID NO: 87649 - DNA, 59 bp, Homo sapiens
  chr20:44936006-44936065
  hyper
ccacccagggctgcccggcaccccgcgcgcccacgcagtccactcttcacagtaaacgc

SEQ ID NO: 87650 - DNA, 157 bp, Homo sapiens; identical to SEQ ID NO: 13830
  chr20:44936314-44936471
  hyper

SEQ ID NO: 87651 - DNA, 684 bp, Homo sapiens
  chr20:44936608-44937292
  hyper
cgaggttgtggggacgggtgggagctgcgggcttcgggccgagaggcggctcggctccgcgccggggaaagtttggacgtgggaaactccctccccgccctcccggccgagaggagggggcgcgcagggccgggcgcaggcaccccggctcctcctgcggctggaggctcgccccccgcgccgcctgcccggccgctcccgccggccagggggctccctccctgccgggcagcctcccctcggcggcgatccggccgctcctcccgcggcaccccgcgctcttacctcggggagcggcccggggctccccctagtcctgccgcctcgggacgctgcgtggggcgggagccccggcgcgggcagcgggcgagtccggagccccgcggccgcccgcaggagccggagggagagcgggagcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaaccccagcc

SEQ ID NO: 87652 - DNA, 101 bp, Homo sapiens
  chr20:44937542-44937643
  hyper
gccccctgactactgcgggaggccgccttcagaggagcaggggcgcaggccagggtaggagcaggcttctcgaacagtggccgccccggcttgctgcccag

SEQ ID NO: 87653 - DNA, 281 bp, Homo sapiens
  chr20:44941380-44941661
  hyper
cgctctgcacctctgcgagcccgctttctccgccggggccgacgggaccgcagggagggggaggggactacttggggaggggactccatgggaagggaacttcgaggggacggggaggccgcccttggctgggggcgccaggacggggaggggcgagcctgcgggagccacaggcgccgaggccgtgcgcccttaagcacctccacctcatggcgttaatcctcgcagaccccgcagccagactgcctgggttcaaatcccatcaccgccacttgccagct

SEQ ID NO: 87654 - DNA, 47 bp, Homo sapiens
  chr20:44993202-44993249
  hyper
ctttctgaggtacagcgtagttttgtcctccgcgaagtccctcaggc

SEQ ID NO: 87655 - DNA, 30 bp, Homo sapiens
  chr20:45096840-45096870
  hypo
tagagtggggctccccgataggtggtgtgt

SEQ ID NO: 87656 - DNA, 205 bp, Homo sapiens; identical to SEQ ID NO: 38150
  chr20:45141834-45142039
  hyper

SEQ ID NO: 87657 - DNA, 77 bp, Homo sapiens; identical to SEQ ID NO: 38151
  chr20:45142151-45142228
  hyper

SEQ ID NO: 87658 - DNA, 168 bp, Homo sapiens
  chr20:45279814-45279982
  hyper
gcaagggagggaaggcgagggggtctggtggagcctgtctacactgggacctcagcggtctcccaacttggaggcttgggagaagaggatcccgcctgtggttgaccgggggcgcacaggcggaggaggcgttaccttgggcgggagggcgaagaccaccggcagcag

SEQ ID NO: 87659 - DNA, 348 bp, Homo sapiens
  chr20:45280039-45280387
  hyper
cgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtggccttgcctcttggcttcccagcaatgtggcctggggcagctggcttatcctctcctcgcctctgtttactcgcctgtgagatggc

SEQ ID NO: 87660 - DNA, 37 bp, Homo sapiens
  chr20:45316162-45316199
  hypo
aaacaaaacaaaggccgggtgtggtggctcatgcctg

SEQ ID NO: 87661 - DNA, 416 bp, Homo sapiens; identical to SEQ ID NO: 46181
  chr20:45337605-45338021
  hypo

SEQ ID NO: 87662 - DNA, 587 bp, Homo sapiens
  chr20:45338197-45338784
  hyper
cggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggtaagtcccgatcgggcgctgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcct

SEQ ID NO: 87663 - DNA, 1458 bp, Homo sapiens
  chr20:45523171-45524629
  hyper
gaggatgtgctgccccggggagggaggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcgaggttcctgcttccccgaagccgaggctgagagttgacagcgtgcaccctgccgcggtctgaattctttttaaaaagcaagaccgatgctgcgtttttatggatac

SEQ ID NO: 87664 - DNA, 29 bp, Homo sapiens
  chr20:45833539-45833568
  hypo
ctgattatcgccactcgactgtatagttt

SEQ ID NO: 87665 - DNA, 30 bp, Homo sapiens; identical to SEQ ID NO: 46182
  chr20:45834171-45834201
  hypo

SEQ ID NO: 87666 - DNA, 30 bp, Homo sapiens
  chr20:45871153-45871183
  hypo
atggggcacagtccccgcctcttccaggtg

SEQ ID NO: 87667 - DNA, 30 bp, Homo sapiens
  chr20:4589710-4589740
  hypo
tgggccccctcgggccgagggctgtgcaca

SEQ ID NO: 87668 - DNA, 37 bp, Homo sapiens
  chr20:45941815-45941852
  hypo
ttacagtcacatggccggacacagtgttcacacctgt

SEQ ID NO: 87669 - DNA, 87 bp, Homo sapiens
  chr20:45949101-45949188
  hypo
cattcctttggggagcgaagagttcagacccaacatgtcacccaaattaccctggccagccaccacgtaaagatgctgcggctgtgc

SEQ ID NO: 87670 - DNA, 29 bp, Homo sapiens
  chr20:45951417-45951446
  hypo
gctgggattacaggcgtgagccaccacac

SEQ ID NO: 87671 - DNA, 47 bp, Homo sapiens
  chr20:45951653-45951700
  hypo
cttggcattggccaacgtcaacacagcattgtcgttcagtgtgtggg

SEQ ID NO: 87672 - DNA, 146 bp, Homo sapiens; identical to SEQ ID NO: 46185
  chr20:46013515-46013661
  hypo

SEQ ID NO: 87673 - DNA, 25 bp, Homo sapiens
  chr20:46034351-46034376
  hypo
agtgagactccgtctcaaaacaaaa

SEQ ID NO: 87674 - DNA, 30 bp, Homo sapiens; identical to SEQ ID NO: 46186
  chr20:46175625-46175655
  hypo

SEQ ID NO: 87675 - DNA, 30 bp, Homo sapiens; identical to SEQ ID NO: 46187
  chr20:46315525-46315555
  hypo

SEQ ID NO: 87676 - DNA, 30 bp, Homo sapiens
  chr20:46354550-46354580
  hypo
tgacagaggaagccccgctcccggcctcgg

SEQ ID NO: 87677 - DNA, 30 bp, Homo sapiens
  chr20:46365350-46365380
  hypo
aatcaacttgggtaccgcagtggtgtgcag

SEQ ID NO: 87678 - DNA, 36 bp, Homo sapiens; identical to SEQ ID NO: 46188
  chr20:46365599-46365635
  hypo

SEQ ID NO: 87679 - DNA, 188 bp, Homo sapiens
  chr20:46386594-46386782
  hypo
cctcttgcatctgcccgcaccgtggggtacagaggtgagggagatgaagttccagctccccagcagcgggggattcaatcaggggtttaaacgagagcctggagctggatgttttgggctggacaactggcatgtgtgagtggcagatcttccactcactggctcagttttcccgtgagcaagcccgt

SEQ ID NO: 87680 - DNA, 25 bp, Homo sapiens
  chr20:46390872-46390897
  hypo
ttatcagcagcgtgaaaacagacta

SEQ ID NO: 87681 - DNA, 293 bp, Homo sapiens
  chr20:46413326-46413619
  hyper
accggcagcttctggcgcgcaggagccagatcctgttcagccgcgtttccctggaacagaacgcggtgcccggcacgagggggtgctccagaaatgcttgtagaacgaatgaacgaactactataaggaatgtttggaaaagtgcactcctagaattcaccgctagacttttgaaaccccgaggagccggggaggggagcatccctccgccaggcgatggaaactcgttctgccctggcctgggaggaagtctgccttttcgatcctgtttgtcctttcggtgtctgcgagtt

SEQ ID NO: 87682 - DNA, 128 bp, Homo sapiens
  chr20:46414099-46414227
  hyper
cccggcaacctcacccggagcggggcgccgccgccgcctctgccgcagcccggccgggccgctgggcgcaggggactccgcgccgccgctgccgctgccgccgccgccgccgccgctgccgctgctgc

SEQ ID NO: 87683 - DNA, 279 bp, Homo sapiens; identical to SEQ ID NO: 38157
  chr20:46414635-46414914
  hyper

SEQ ID NO: 87684 - DNA, 383 bp, Homo sapiens
  chr20:46415137-46415520
  hyper
tgctttcacaggactcgccccggtctgcaaacactcgactgcctttgccgaaagcctcgcgctcgcctccagccacacacatttgccattggagaggccggcgccggccgcgacccgcagctcaatcgcagggcaaaccgagctgcctgtgcgcgcccgagaactccccgagaaattaacttcggctcaagtgaaaatagcagctgttgtccagaaatggcccgggagtagcatagaaaggagaaaccggcttcctccgaaaggggaggaattggactcaagggggtgctgtctaccgtggtttccgctgtccctcgcgccacagaagaggccggagggggaccggcctgacgcgggtgggcaaagagcgggcagagaactca

SEQ ID NO: 87685 - DNA, 30 bp, Homo sapiens
  chr20:46430501-46430531
  hypo
aaacgaaacaagaagcgtcgaaaacacatc

SEQ ID NO: 87686 - DNA, 30 bp, Homo sapiens
  chr20:46438115-46438145
  hypo
agctgtgagtgtaaacgggttttttttttt

SEQ ID NO: 87687 - DNA, 30 bp, Homo sapiens
  chr20:46438350-46438380
  hypo
cagagaaataaggagcggccagcgggggtg

SEQ ID NO: 87688 - DNA, 30 bp, Homo sapiens
  chr20:46454708-46454738
  hypo
tccctaaccagaaaccgaaataccaaaatc

SEQ ID NO: 87689 - DNA, 30 bp, Homo sapiens
  chr20:4650709-4650739
  hypo
tgtaggcatcagtcccgtgactctcatgtc

SEQ ID NO: 87690 - DNA, 24 bp, Homo sapiens
  chr20:4657791-4657815
  hypo
gcgaaactccgtctaaaaaaaaaa

SEQ ID NO: 87691 - DNA, 30 bp, Homo sapiens
  chr20:46580194-46580224
  hypo
tgggaacccgggaaccgtgctctgcagggc

SEQ ID NO: 87692 - DNA, 30 bp, Homo sapiens; identical to SEQ ID NO: 46189
  chr20:46582135-46582165
  hypo

SEQ ID NO: 87693 - DNA, 70 bp, Homo sapiens
  chr20:46687876-46687946
  hypo
caagagccagccccccggcatgggcttctgaaggaggccacccccggctccacggcgctgggtcccatca

SEQ ID NO: 87694 - DNA, 196 bp, Homo sapiens
  chr20:46729505-46729701
  hypo
gaggttttcttaaagcgagggagtggaggcatctggttgttctggggtggcaggtgcactttctggtgtctagtgccccgtggtttggtgcaactcctagctgtgtgtttcctgatctatgcgctggccctttggaagagtctctgtgccacctactaccctttaatgaatttctgttttgcgtaagccagagtgg

SEQ ID NO: 87695 - DNA, 198 bp, Homo sapiens
  chr20:46731680-46731878
  hypo
aggccatggcatatgcgatctctcaggctgtgccagatggtggggctttggcggagctccctctgtatctgcaagcccgctgacccattcagaggctccaaactgcaagagagaaatgataatggtgctttgaaatgactggagctgggagatggcaaggagcctggcaaagaaggaacacaccgttgtcgctggtac

SEQ ID NO: 87696 - DNA, 30 bp, Homo sapiens; identical to SEQ ID NO: 46086
  chr20:4677123-4677153
  hypo

SEQ ID NO: 87697 - DNA, 30 bp, Homo sapiens
  chr20:46798520-46798550
  hypo
tttaccctgtgcatccgttgcatgtgcatc

SEQ ID NO: 87698 - DNA, 220 bp, Homo sapiens
  chr20:46823363-46823583
  hypo
gtgcaccatcaccgccgtggggcccacaggtaatgggagatgcccccaggtcctggtttgtgcttcgccagagccctcctagagctgcaggcgatgatgggagcttttcaaacaccagcagggcctagatgagctgctccagggacaggagtgttgcgggcgaatgagctggacgagggccagccctgcagggcgcgcagacttgcggctctcttcgcag

SEQ ID NO: 87699 - DNA, 182 bp, Homo sapiens
  chr20:46838294-46838476
  hypo
gaaatgacagcaattcgaatcaaatgttatttattatatgataaaatgttttctatatgtacatctgtgagcatgaccacgctgaaatgaagccgtggggtgttcacacctaagcacaagaggacagtgaacatgggggtgcaaaggcagactgacacgcttggtgccgtaacctcacaaca

SEQ ID NO: 87700 - DNA, 76 bp, Homo sapiens; identical to SEQ ID NO: 46087
  chr20:4690696-4690772
  hypo

SEQ ID NO: 87701 - DNA, 30 bp, Homo sapiens
  chr20:46955145-46955175
  hypo
ttcccgtccaccctgcggagctctcctcag

SEQ ID NO: 87702 - DNA, 61 bp, Homo sapiens
  chr20:46972040-46972101
  hypo
agacagggtctccggcgcagcgcctcagctccgcccatactcgctccgccctggtgggctc

SEQ ID NO: 87703 - DNA, 30 bp, Homo sapiens
  chr20:47001190-47001220
  hypo
gtcgaggatcagccccgggagccgcccaac

SEQ ID NO: 87704 - DNA, 36 bp, Homo sapiens
  chr20:47128746-47128782
  hypo
ctagatcagcagcaccggctcctccctgggtctcca

SEQ ID NO: 87705 - DNA, 30 bp, Homo sapiens
  chr20:47168941-47168971
  hypo
attttgctggagtgacgttccgtgtcatcc

SEQ ID NO: 87706 - DNA, 36 bp, Homo sapiens
  chr20:47201897-47201933
  hypo
aggccatgtgtcagccgttcacgtgtgtggtttcat

SEQ ID NO: 87707 - DNA, 30 bp, Homo sapiens
  chr20:4720642-4720672
  hypo
gattcctccttcttacgactcccacaccca

SEQ ID NO: 87708 - DNA, 30 bp, Homo sapiens
  chr20:47241898-47241928
  hypo
ccgtctctcctttcccgacagagccaagtc

SEQ ID NO: 87709 - DNA, 112 bp, Homo sapiens
  chr20:47247201-47247313
  hypo
gtcctgactcctgagcgccccaccctgcccaagctccctgcagcaggagggcacgtggacatacctggtctatctttaccgccgtggtgctggcatccgtgggcaggttaga

SEQ ID NO: 87710 - DNA, 258 bp, Homo sapiens
  chr20:47252924-47253182
  hypo
agggctccctcgacccggcctgggcgggcaccagtgggtgggccagcggggccgccctcccgccccactcactcaccactgtggctggcgagagcagggactggcagtgcagcaggacgcccgtggccgccacctgctccagccacttgcggctggcgtcgcggctgctctcctcgtactcgccattgttgttgtagcggtagcccagggccgccagcagctgcttggagaaggtgcacacggcggccaccagggcct

SEQ ID NO: 87711 - DNA, 30 bp, Homo sapiens
  chr20:47258562-47258592
  hypo
cccatgggctaaaatcgctgtcctgatgat

SEQ ID NO: 87712 - DNA, 20 bp, Homo sapiens
  chr20:47259758-47259778
  hypo
agcaatttgggaggccgggg

SEQ ID NO: 87713 - DNA, 36 bp, Homo sapiens; identical to SEQ ID NO: 46194
  chr20:47260725-47260761
  hypo

SEQ ID NO: 87714 - DNA, 30 bp, Homo sapiens
  chr20:47264965-47264995
  hypo
ctgctgaacatcctccgatgcccaggacag

SEQ ID NO: 87715 - DNA, 30 bp, Homo sapiens
  chr20:47273573-47273603
  hypo
tcactctttggccttcgtggccaccaggag

SEQ ID NO: 87716 - DNA, 182 bp, Homo sapiens; identical to SEQ ID NO: 46195
  chr20:47274120-47274302
  hypo

SEQ ID NO: 87717 - DNA, 30 bp, Homo sapiens; identical to SEQ ID NO: 46196
  chr20:47274646-47274676
  hypo

SEQ ID NO: 87718 - DNA, 342 bp, Homo sapiens
  chr20:47296022-47296364
  hypo
agatggcttccaggacggggcagggcagggtaatgggggcaggggtgagttgtgggcagtggagaaggcaaacaagccaaggggcacaggcctgctctgaggcgaacccagggtggaggtgaacgaggccagctgagtcagagtcacaggggcggagggcccctaccttggacatgatgtcctccagctcacttcgggccttgtaggtgccatcgtcgtagcggaagcgatacatcacctgctcattcttgaactggtgcttgtcggaaactggagagacaggaggacctgtgacgctgggcacgccccctcagcccctcccagccacgccccccagcattg

SEQ ID NO: 87719 - DNA, 30 bp, Homo sapiens
  chr20:47358665-47358695
  hypo
gtgaggctggaaggacgggagccctgctga

SEQ ID NO: 87720 - DNA, 30 bp, Homo sapiens
  chr20:47359750-47359780
  hypo
gaacagggatttgaacgttggctgttggct

SEQ ID NO: 87721 - DNA, 86 bp, Homo sapiens
  chr20:47381385-47381471
  hypo
aggaagaccagaagacgctatgctgctggctgggagatggacgaggccacaagccaaggaatgcaggggcctctggaagctggaaa

SEQ ID NO: 87722 - DNA, 184 bp, Homo sapiens; identical to SEQ ID NO: 16602
  chr20:47428537-47428721
  hypo

SEQ ID NO: 87723 - DNA, 259 bp, Homo sapiens
  chr20:47443678-47443937
  hyper
ggttctgtcaatccccgcccctcctctgagcttcaggttttatcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcg

SEQ ID NO: 87724 - DNA, 297 bp, Homo sapiens; identical to SEQ ID NO: 4823
  chr20:47443944-47444241
  hyper

SEQ ID NO: 87725 - DNA, 186 bp, Homo sapiens; identical to SEQ ID NO: 4824
  chr20:47444242-47444428
  hyper

SEQ ID NO: 87726 - DNA, 129 bp, Homo sapiens; identical to SEQ ID NO: 4825
  chr20:47444452-47444581
  hyper

SEQ ID NO: 87727 - DNA, 184 bp, Homo sapiens; identical to SEQ ID NO: 4826
  chr20:47444609-47444793
  hyper

SEQ ID NO: 87728 - DNA, 295 bp, Homo sapiens; identical to SEQ ID NO: 4827
  chr20:47444920-47445215
  hyper

SEQ ID NO: 87729 - DNA, 91 bp, Homo sapiens
  chr20:4749380-4749471
  hypo
cagggtagggagtgccgtggtgaagagtctgatgatgtccatcaggagtttcagagttagcctcacagttcagtatctttttttttttttt

SEQ ID NO: 87730 - DNA, 30 bp, Homo sapiens
  chr20:47830069-47830099
  hypo
gcttttaatgtggggcgattataatcaatg

SEQ ID NO: 87731 - DNA, 204 bp, Homo sapiens
  chr20:47837002-47837206
  hypo
tctgcgatacagtcacgttagagacctcccttgcttaaaactctccagcctgctggtagagacccccgggcctgtccaccttgcaaagactcctcaggcagcgtctgggtcccgtacactgtcgccatttccccgatgtcccctgtgggcgcgggcggccacccaggcctgctggctgcggccccctctcggacaggccttggc

SEQ ID NO: 87732 - DNA, 253 bp, Homo sapiens; identical to SEQ ID NO: 46200
  chr20:47905350-47905603
  hypo

SEQ ID NO: 87733 - DNA, 163 bp, Homo sapiens; identical to SEQ ID NO: 38166
  chr20:47934824-47934987
  hyper

SEQ ID NO: 87734 - DNA, 1084 bp, Homo sapiens
  chr20:47934988-47936072
  hyper
ccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattc

SEQ ID NO: 87735 - DNA, 30 bp, Homo sapiens
  chr20:47949637-47949667
  hypo
agcaagggggtaactcgggagaccaatgag

SEQ ID NO: 87736 - DNA, 34 bp, Homo sapiens
  chr20:48001223-48001257
  hyper
gaagcctgcagggggcgctcgtgggcacaaaggg

SEQ ID NO: 87737 - DNA, 969 bp, Homo sapiens
  chr20:4802998-4803967
  hyper
cagcctttgctctcccgaaaaacacgttctaggcgccgggattccagatacctgggaaatagagtgcacgcagctgttgagaggcctcgcgcttggcttctcctatcactgaggcgcagaggtgctgtggacagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcctcgctcccagtgccccgcgccccgcgccccgcgccttgccttcacc

SEQ ID NO: 87738 - DNA, 170 bp, Homo sapiens
  chr20:48099124-48099294
  hyper
gggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctccaccaggctcccagccggccttgaccttcccc

SEQ ID NO: 87739 - DNA, 251 bp, Homo sapiens
  chr20:48099322-48099573
  hyper
cggatggtcgctgtccctcccgccggtgctgaagtccgccgcaccccatggatggagggaggggccgcccctcggggcggggagagggccccaagagatgcccctggagcccgggaggccccaccctgggcttctgcggcccaggcgcgacccagccgcccggggcgctgtccgccccttagagtgctgaaactctcttcattatgggtctcccgatcgagtcccgaacctggccccgccatggggagaga

SEQ ID NO: 87740 - DNA, 30 bp, Homo sapiens
  chr20:48099861-48099891
  hyper
ctgagattgctccagcgacaaggtgagccg

SEQ ID NO: 87741 - DNA, 335 bp, Homo sapiens
  chr20:48100170-48100505
  hyper
gggggaggtgggaggcggggaaatgagctaaattttctggccttttcaaaaggtgccatcctcctaccgcgcactagtgatttcggggggttcccctgagcaccccctgcatgtagggctcacgccttagccccagaatggggattgcgcgtcccctcaggcctcagcccttgcctgcctcccaccccgctcccctccagcctggagctgcggagcccgagcagaccaacaggccgagctgcggcaggcaaaccccctgtccgtgtccccatgcacccccacggaaggccgtacgccccaacactcacccccagggcggccgcctcctggggcca

SEQ ID NO: 87742 - DNA, 53 bp, Homo sapiens; identical to SEQ ID NO: 38171
  chr20:48184239-48184292
  hyper

SEQ ID NO: 87743 - DNA, 351 bp, Homo sapiens
  chr20:48184328-48184679
  hyper
cgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggc

SEQ ID NO: 87744 - DNA, 86 bp, Homo sapiens
  chr20:48252895-48252981
  hypo
tgtttttatacaaggcgtcgtatgtgatgtttgcaaagtagttcaggttgttgaggccatccagcccttgccgttcttttgacttc

SEQ ID NO: 87745 - DNA, 30 bp, Homo sapiens
  chr20:48403614-48403644
  hypo
tttgattttcccagccgttgatgagtaata

SEQ ID NO: 87746 - DNA, 30 bp, Homo sapiens; identical to SEQ ID NO: 16604
  chr20:48477511-48477541
  hypo

SEQ ID NO: 87747 - DNA, 30 bp, Homo sapiens
  chr20:48517671-48517701
  hypo
tgcccaccccttcctcgcttggccccctca

SEQ ID NO: 87748 - DNA, 54 bp, Homo sapiens
  chr20:48524764-48524818
  hypo
gcgccgtgcagagcccgcaggctagaggagctgagcgagcgcaaggagctctcc

SEQ ID NO: 87749 - DNA, 88 bp, Homo sapiens; identical to SEQ ID NO: 46203
  chr20:48673896-48673984
  hypo

SEQ ID NO: 87750 - DNA, 78 bp, Homo sapiens
  chr20:48695412-48695490
  hypo
ctttagatttaaccacgaatttgttctggggttttccagcagcattttattatttatttattttttgagacggagtct

SEQ ID NO: 87751 - DNA, 82 bp, Homo sapiens
  chr20:48720255-48720337
  hypo
tttaaaagctataaagcttaattagaagccaggcagtcaggagaggccctctcagagaccccggtcccggtcccaaacacct

SEQ ID NO: 87752 - DNA, 21 bp, Homo sapiens
  chr20:48720805-48720826
  hypo
agactccgtctcaaaaaaaaa

SEQ ID NO: 87753 - DNA, 154 bp, Homo sapiens; identical to SEQ ID NO: 46205
  chr20:48767027-48767181
  hypo

SEQ ID NO: 87754 - DNA, 30 bp, Homo sapiens
  chr20:48768053-48768083
  hypo
accagagaggtgaggcggatcccccacagc

SEQ ID NO: 87755 - DNA, 25 bp, Homo sapiens
  chr20:48771341-48771366
  hypo
ttccatacaggcagccgggcgcggt

SEQ ID NO: 87756 - DNA, 281 bp, Homo sapiens
  chr20:48788892-48789173
  hyper
tctgtcgggcgggggcgggggctctttgccttccgatccaagctccgccctctgcagctctgctctgtgtatcccagagctgaccctgcggcgcctttcccaggctcgcgtccggtgagttcctattggccaacgggaggccccggtcggggagcgccccgggacaggcccctgtgcctcccgctttgcggagtgacgcaggccctgggctacagcaaccttaccagcccctccagcttagaggtggcagtggctctctgcggctgcgatttctttctcgg

SEQ ID NO: 87757 - DNA, 246 bp, Homo sapiens
  chr20:48863456-48863702
  hypo
agggggacctgtgggcggcctctgcctctccccgcgcagcgtcaggacacaggcccacattccctcctggcttctccctgaagggagagagaataatagttggttcaaatgtcaggcctgctccgtgctggtggggagactggttgagcaggtccgcaggagggacggagggaggaaattattaataattgcaaagcaaccagccacactacaggccttgagttgtgtctgcgtttgtctttggag

SEQ ID NO: 87758 - DNA, 30 bp, Homo sapiens
  chr20:48971286-48971316
  hypo
gccaagcaaaccccacggagcaccttcctg

SEQ ID NO: 87759 - DNA, 155 bp, Homo sapiens
  chr20:49047009-49047164
  hypo
gccaggaatgctgctcggtaccctacagcgcacaacacggcccttgccagaaagaatcaacagggctgtgggcgaggagccctggtctcacgagaggttgcccacccctcacctggtgccccaggaggtgggaggcttcgcgggctccaggtctt

SEQ ID NO: 87760 - DNA, 251 bp, Homo sapiens
  chr20:49194287-49194538
  hypo
catccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcc

SEQ ID NO: 87761 - DNA, 146 bp, Homo sapiens
  chr20:49200439-49200585
  hypo
tcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccct

SEQ ID NO: 87762 - DNA, 42 bp, Homo sapiens
  chr20:49203345-49203387
  hypo
ttgacgcagaagtgccgagcagctgaccggcagcgaggcctg

SEQ ID NO: 87763 - DNA, 30 bp, Homo sapiens
  chr20:49203615-49203645
  hypo
ggctgggtcaatggccggagtctcaggtag

SEQ ID NO: 87764 - DNA, 270 bp, Homo sapiens; identical to SEQ ID NO: 46211
  chr20:49204179-49204449
  hypo

SEQ ID NO: 87765 - DNA, 30 bp, Homo sapiens
  chr20:49210458-49210488
  hypo
ggttcattctttacccgtcaggctctggtg

SEQ ID NO: 87766 - DNA, 328 bp, Homo sapiens
  chr20:49218480-49218808
  hypo
ggcccacccaggtcacgcagaggtgaggccaggatgtcggcccaggctgcgtggccccagagcccccgactcccagtcatcatgccatcagcaaagcagggccaccgcccggggcggggtggccataccttcagccggtcccggaagccgaggacctggtactccagctcccggagctggggctgggtggagtccgtgggcctcagcaactccaggacctcctgcagaggcccctcgagggccacgccaggcccgtcctctctgtccccggttgccccttcctcgtggccgttctggctactcgaggctgtgccgctgtggaacaggg

SEQ ID NO: 87767 - DNA, 32 bp, Homo sapiens
  chr20:49250792-49250824
  hypo
atagccgtgagccaccgcgcctgaccaggaca

SEQ ID NO: 87768 - DNA, 406 bp, Homo sapiens
  chr20:49261761-49262167
  hypo
gagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagcctaagggcactgggaaccctgtgggcatgcgcagttcaagcccatccccgctccctccagctg

SEQ ID NO: 87769 - DNA, 152 bp, Homo sapiens
  chr20:49286742-49286894
  hypo
gagccaagtcaaccaggcaggcggaggcccagagcatgagttttacctactgccggtttcggccaaaatgccagaaagccaagcagcaatcttgggcatcggacttggctagaaatccctctcctcctgggaagtctcgtcatcaacaccca

SEQ ID NO: 87770 - DNA, 20 bp, Homo sapiens
  chr20:49323846-49323866
  hypo
gggcaaggtggctcacgcct

SEQ ID NO: 87771 - DNA, 19 bp, Homo sapiens
  chr20:49324106-49324125
  hypo
agagcgagactccaccaaa

SEQ ID NO: 87772 - DNA, 56 bp, Homo sapiens; identical to SEQ ID NO: 46218
  chr20:49345671-49345727
  hypo

SEQ ID NO: 87773 - DNA, 339 bp, Homo sapiens
  chr20:49346420-49346759
  hypo
aatcctcccacaaaacgtctggttacctgaatcctccagagggaaaaaaatgagcttctcgcctttgaacccaagtggggcaaagagcctgcagaagggacaccctcagtggcagcacccagcaaagacccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcaggga

SEQ ID NO: 87774 - DNA, 26 bp, Homo sapiens
  chr20:49350870-49350896
  hypo
aactaggtagtgtgccggtccttttt

SEQ ID NO: 87775 - DNA, 95 bp, Homo sapiens
  chr20:49358027-49358122
  hypo
ggtttaccatcaggtcgcagcatctaaatctggcagacttacttagtgtactataatgcatgcactcttttttttgtggagtggggacggagtct

SEQ ID NO: 87776 - DNA, 34 bp, Homo sapiens
  chr20:49358362-49358396
  hypo
gtgagccaccgcgcccggccgcactctgtctttt

SEQ ID NO: 87777 - DNA, 17 bp, Homo sapiens
  chr20:49364856-49364873
  hypo
gacgacagagcgagact

SEQ ID NO: 87778 - DNA, 160 bp, Homo sapiens
  chr20:49377911-49378071
  hypo
cgctcctggccgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgctaggttatctac

SEQ ID NO: 87779 - DNA, 204 bp, Homo sapiens
  chr20:49380667-49380871
  hypo
gtcttgaactcctgcgctcaagcttcccaaaaggctaggattacaggcttaagccacggtgcctgcccatgtggtttttagaccagcaggttctgtagagcaaaatgttcatgattttgaaggatgacaaacctgacagaggaggcaacgccaccttgacattcctcagtcgtagtgccacagtggtctcgtatttcaaacctg

SEQ ID NO: 87780 - DNA, 90 bp, Homo sapiens
  chr20:49381176-49381266
  hypo
aggatggataaaatatttaacagtggtcatacataattcattcctgagtcgacacccatttccaggccagcagttcgctctcaattaggg

SEQ ID NO: 87781 - DNA, 30 bp, Homo sapiens
  chr20:49411040-49411070
  hyper
agttttagaaactaccgatgcccaagcccc

SEQ ID NO: 87782 - DNA, 129 bp, Homo sapiens; identical to SEQ ID NO: 38174
  chr20:49435030-49435159
  hyper

SEQ ID NO: 87783 - DNA, 30 bp, Homo sapiens; identical to SEQ ID NO: 46224
  chr20:49502935-49502965
  hypo

SEQ ID NO: 87784 - DNA, 75 bp, Homo sapiens
  chr20:49548179-49548254
  hyper
tgaggggggagctctcgcgagaaccaggcggatttgccattgacccactaggaggcgccgcggataatggccgca

SEQ ID NO: 87785 - DNA, 116 bp, Homo sapiens
  chr20:49548468-49548584
  hyper
tccacggctgagaagcggcgggaaggcgccgggacacctggccggtcgcccctgacgcctcctgccttaaatgaggtgtgagggcctcgtgcttcacacagcgacttgagatgaga

SEQ ID NO: 87786 - DNA, 32 bp, Homo sapiens
  chr20:49572072-49572104
  hypo
ttcaaaagaaaatcacgtaatgacctatgtat

SEQ ID NO: 87787 - DNA, 43 bp, Homo sapiens
  chr20:49572791-49572834
  hypo
gataaataatacctacgacataacattccgttttctcttggtc

SEQ ID NO: 87788 - DNA, 109 bp, Homo sapiens
  chr20:49575733-49575842
  hyper
atgagcaacctggcccgccaagtgctgcatggcgaggcactggctggccaggccaaggccttttcggccgccgcctcgctgcgccgcctcaattcggcagtggaatgcg

SEQ ID NO: 87789 - DNA, 42 bp, Homo sapiens
  chr20:49576086-49576128
  hyper
gaccaactgcgcggacggcggggtgctcggtgtcgttaccgg

SEQ ID NO: 87790 - DNA, 186 bp, Homo sapiens
  chr20:49598367-49598553
  hypo
atacatcccaaccaccgcaaccatagcaattgttgtgaactgcgagccagttctaacagctgcataaatattaactcatttaattcacaagatcagcttatgaggtgagtactattattatccctgctttacagatgaagaaactgaggcagaggttactgggcttggcctcggtccctgctgtgg

SEQ ID NO: 87791 - DNA, 183 bp, Homo sapiens
  chr20:49638951-49639134
  hyper
actcaatcaggcccacggtgggggtgaaggggggctccatactgtgcctaaggatacagtgaatgagcaagtgacacacactcccccaccccaatccctaactctccttcctcccaggatcgggggagaaacctcggcccacagccgggatgcgcccccgccggggtcaccgcggcggcgaac

SEQ ID NO: 87792 - DNA, 50 bp, Homo sapiens; identical to SEQ ID NO: 38178
  chr20:49639135-49639185
  hyper

SEQ ID NO: 87793 - DNA, 640 bp, Homo sapiens
  chr20:49639217-49639857
  hyper
cgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctctgcctcccggagccgccgccaaacttcggtcccggggcccggctcagctcccgccctcggagccacggccgccccgtctctgcctcccggtccccgccgggctccgagtgcgccgggagcgcggcgcagcagccgccgagggagggagcgaggcaggaggcgggacggagggaggggactgagcgcggggcggggagaaggggcgggcagccgaaagcgcagcgcctggcctcgcctcgcttcgggacagtggcagcggcgccaccgtcacggggcgtccaggcgcccaatcgggaccccgcaccttggatccgggggccctgg

SEQ ID NO: 87794 - DNA, 115 bp, Homo sapiens; identical to SEQ ID NO: 38181
  chr20:49639882-49639997
  hyper

SEQ ID NO: 87795 - DNA, 157 bp, Homo sapiens
  chr20:49640094-49640251
  hyper
cgcggtgcaagtgctccggtggtcccgggtccgcgcccctagcagcaccgccccagggtctacatgtgctagatattaaaaccccactctccgctgccccggggccgcgctccacgcgcttacacatcctgggaaccacatgcgccatgtctcctgc

SEQ ID NO: 87796 - DNA, 172 bp, Homo sapiens
  chr20:49708478-49708650
  hyper
gatctccacccctaccgcccttcatggtttcgggagaaagctgctgggtagaaggtgctggtatcttccttgcctgtgattagaagcctctctcattggagcttttgcttccgctcgttttcccctttgcctcctttcagctgccccttcccgaagccgaatatcacctgat

SEQ ID NO: 87797 - DNA, 51 bp, Homo sapiens
  chr20:49742709-49742760
  hypo
gttcctggctgcatgcgtgccatctccgttgattgtcgttgtctttcttgt

SEQ ID NO: 87798 - DNA, 30 bp, Homo sapiens
  chr20:49778368-49778398
  hypo
tttccttggctctcccgcactagcccacaa

SEQ ID NO: 87799 - DNA, 94 bp, Homo sapiens
  chr20:4981307-4981401
  hyper
ccccagcctgcaggccgacatcctatcagccacccatccaagggggggcatctaggaccaaacgaaggagaaaatcctgcgccttaaagtagtc

SEQ ID NO: 87800 - DNA, 132 bp, Homo sapiens
  chr20:49836904-49837036
  hyper
gcgccatgctccatccgtcctgcaggtggcgcgcctgagcccgtgcacggcagcctctccggaaggtgaagcacgctgccgcactgggggcctgcctggggctctgaaagcccattacgctgttctccttgg

SEQ ID NO: 87801 - DNA, 30 bp, Homo sapiens
  chr20:49948303-49948333
  hypo
gtacaccctggcactcggctgtgctctgtg

SEQ ID NO: 87802 - DNA, 30 bp, Homo sapiens
  chr20:49999712-49999742
  hypo
gattgggcttgtaaacggcagctggctggc

SEQ ID NO: 87803 - DNA, 97 bp, Homo sapiens
  chr20:50052184-50052281
  hypo
catgaaagagggaaacgtgagggggattgagagacactcaggtgcgtcacgtgcttacgggctggctcttgtccttatccaccgtggcttccatctc

SEQ ID NO: 87804 - DNA, 31 bp, Homo sapiens
  chr20:50116003-50116034
  hypo
aaacgcggccgggcacggtggctcatgccta

SEQ ID NO: 87805 - DNA, 376 bp, Homo sapiens
  chr20:50157663-50158039
  hyper
ggccagagaggacaccgatggaagcgaaaacttcattatctgcctaacacagtgtttgtgggaaacatcaggccaccaagcctccttgacaggcttcctccacgagccagtcagcacaagcccttcctacacactagatggaggcaagcccagagtgcgtctggaagctactaacaggcctgccactgagccttcaacaagcattggctgggctgggctgggctgtcaaaatcaggaagcctggttgggttttttgttttttccaagacaacctgctaaccagaaatacacagtgaggttgggcgtgtggccgcttccccctcctcctcctcctccctctaacgaatgctcctgttaaacacgtgaagtgacagat

SEQ ID NO: 87806 - DNA, 65 bp, Homo sapiens; identical to SEQ ID NO: 38186
  chr20:50158354-50158419
  hyper

SEQ ID NO: 87807 - DNA, 182 bp, Homo sapiens
  chr20:50178954-50179136
  hyper
cctgtgcgccgagggcgagcggggtccccaggcctcccgcaccgacctctgccgggagctgaaagtgctgcccgggacgggagcagcaggaaagggccgggaggagcgagcggaaaaggctggaagggatcgagagtcagttaccttggtccacagaccccatgatgcggaggggatggcag

SEQ ID NO: 87808 - DNA, 30 bp, Homo sapiens
  chr20:50184172-50184202
  hypo
gtgctcaaaagcacacgtggctggtggcta

SEQ ID NO: 87809 - DNA, 20 bp, Homo sapiens
  chr20:5025098-5025118
  hypo
tttgagacagagttgcgctc

SEQ ID NO: 87810 - DNA, 30 bp, Homo sapiens
  chr20:50378432-50378462
  hypo
tctggaggctccaaccgagtccgtttcctt

SEQ ID NO: 87811 - DNA, 25 bp, Homo sapiens
  chr20:50383398-50383423
  hypo
taataataaacgcaaaacagagaag

SEQ ID NO: 87812 - DNA, 155 bp, Homo sapiens
  chr20:50384245-50384400
  hyper
cctcccaccctcctgcgactgctggttcgggtccaccccgggcggagggggaaggggccaccggagcgcaggtggtctcggcgcagcctcctggggctgggacccaggggcgctgatggggtaccccgaggcgtaggccgcgcccccctaaaagc

SEQ ID NO: 87813 - DNA, 279 bp, Homo sapiens
  chr20:50384649-50384928
  hyper
catcaggctaggtgccgcccggggctgaagcgcagggaccccctccccacctccccgcctccccagccctgccccaggctcatggcgccgggcgcggcgcgcggccaacctgtcaggcccggccaggctggcccgagcgccgggctccgggaggcgcggacaaaggaaaacacgggcccaggcccactcacccggcgcggggcctgctgtccatccgcttcttctggcgcaccggctgcagcgggatgttgtccgtcatgtcggcggcgccgcccgcct

SEQ ID NO: 87814 - DNA, 59 bp, Homo sapiens
  chr20:50385171-50385230
  hyper
gcctgccacggggggcggccgggccgtgtccgcgccgccgcgaccgctgcagtgtcccc

SEQ ID NO: 87815 - DNA, 767 bp, Homo sapiens
  chr20:50417309-50418076
  hyper
aggcgcctgggacctcgggtgcgcgctgcgctgaccacccggcgccccgaaaacgcccagccatcccctccgtcaagccgatccttttaatttgccctggaaaaatgttaaacggggaattctattgacgtattataaacttgggaaatgtattacattcagtctccgacaaaaaggcggggatacggaagccaaaaagtggcgaccgtcttctcgggaaaccccgggtatcagagatggtctctgagagtcctccggggttgccgcgcacacccgtctgctgcagggaaattagaaagcaggcggggagcggagcgacgaacaaggccggagaggaggctacaaatcccccctccccccacgcgcacgctaaaaacttatcaggcgacaatttggcgggccgggatggagacgagatagtggaaaaccgcctcgctcctaaaacctccgcggtgaagtgatgaagtgggaacagagttggccccgccgttcctggcgcggctggggtcccgaactcccctcgatctgggaaacgctggccgcggaagcgtgggccaggtcagccgcgggagttcgctctggccccccacctctcccctttcacacccaagcgcaaatgtggaaagccgagcgctccagaaaagccacgcaaaacgggaggccggtgcaccccagtggggctgccgcgcgcccgccaccccggccactgggggctcgcaccctcgggcttgccgcggttatttttaggaagtcggaaatcaaagatg

SEQ ID NO: 87816 - DNA, 156 bp, Homo sapiens
  chr20:50419232-50419388
  hypo
cagctaattagcatccgggctcagattggctggggcggggacgaaatcagagggggacccatccttgctccagctatctcagtccttggagaggaaaagaaaatggggagaaatgcgtactcattaaaaagtaggagcttacgtagaagttttgga

SEQ ID NO: 87817 - DNA, 19 bp, Homo sapiens
  chr20:50470085-50470104
  hypo
tttgagacagggtctcgct

SEQ ID NO: 87818 - DNA, 30 bp, Homo sapiens
  chr20:50583692-50583722
  hypo
atggttttcttagagcgtttatgcatgcct

SEQ ID NO: 87819 - DNA, 27 bp, Homo sapiens
  chr20:50602104-50602131
  hypo
tttgagatggagtctcgctctgtcgcc

SEQ ID NO: 87820 - DNA, 841 bp, Homo sapiens
  chr20:50720360-50721201
  hyper
tatggtagctccactcgagcaagctttattttaacatataagctattcgtttagtggaggcttcattaaactactcccctccaccaccacctcgggaagttgtggtcaaaacccaccagaccgactgtggtggaagttgatgcggaagctggagagcccgcggctctggaggggtgagccgccccggagaggggacccatcctcctttccgcgcccggaaagagcgggggagaagaggaagtccagttacaactcctttcctcagccccttaaaggaaaggtatcagctaaccacggggagctggcagcctaagagaaagtaggaacctacaatctcttaatctaagcacaagataagcaaaaagggaagcgccttagaaatgcagattccccaaccccacccctgagattccagtggaggcgggggatggggggatccctaacttgcaggaagaatttggcgagcgagaaaaggtcccctcccgcaggctcttctgaagcggaggatcccgggacgagaaatgctgcccggggggcttaaggtagccgacgatctccttgctacatcctgtgtccacgtggcagccgaggagggggtgtgggggccgcctgttaagtgcgacagcatcactgctctatccccaccacggctcccacttcgctcagataaaatgcagagctcttaccaaggctcacggccgtcccccgccccccaccgtctgcccccatcacctctcgggcctccggtgacctctcgggctacagcagcgctgacgccctgggtccctgcgcttctgttccctcggcctggaatgctcttcccccgggtacctgcacagct

SEQ ID NO: 87821 - DNA, 437 bp, Homo sapiens; identical to SEQ ID NO: 1486
  chr20:50721234-50721671
  hyper

SEQ ID NO: 87822 - DNA, 33 bp, Homo sapiens
  chr20:50721988-50722021
  hyper
gggcagcccgcgccacctgggagctcgttagaa

SEQ ID NO: 87823 - DNA, 120 bp, Homo sapiens
  chr20:50722081-50722201
  hyper
ccccaggtgattcgcatgcacattaaagtttgagaaaccgtgtctgcattttaacgagatccccaggtgattcgtttgcccattaaaatttcagaagcgcagctctcctccaactttaat

SEQ ID NO: 87824 - DNA, 41 bp, Homo sapiens
  chr20:50722261-50722302
  hyper
tggggcctgagctcctgtatttctaacgagctcccaggtgg

SEQ ID NO: 87825 - DNA, 126 bp, Homo sapiens
  chr20:50722695-50722821
  hyper
ccgcccagcaggtgacggaggcgtggtcctcggggggttgagctaattagcgttcatgctcagactggctgggacctcgatgagacccgagggagacccctccttgcgccgcgtaattgacatcca

SEQ ID NO: 87826 - DNA, 30 bp, Homo sapiens
  chr20:50723185-50723215
  hypo
tttcaggttgtgaatcgacttgggaatatt

SEQ ID NO: 87827 - DNA, 216 bp, Homo sapiens
  chr20:51589786-51590002
  hyper
ggctcggggctggggcgccagaagtgggactggagcgaagtagaggatgccgaggagaaaacagcaggcacccaagcgggcggcaggtaagagaaacggctccgcttcggggctgccctgtgcgccgagctcctcgcccgccctccttgcccctgggtgcccgggggcaccacccacttaagctttcgggggagtttgcgccgggtgcccttctaa

SEQ ID NO: 87828 - DNA, 30 bp, Homo sapiens
  chr20:51796493-51796523
  hypo
gatgttcagaataaccgtaatggaaacacc

SEQ ID NO: 87829 - DNA, 37 bp, Homo sapiens
  chr20:5203282-5203319
  hypo
tacaggcgtgagccactgcacccggccatatttttct

SEQ ID NO: 87830 - DNA, 30 bp, Homo sapiens
  chr20:52130263-52130293
  hypo
gactgttcccacatccgaggtccccagccc

SEQ ID NO: 87831 - DNA, 120 bp, Homo sapiens
  chr20:52275843-52275963
  hypo
cgtatgtgtaattatgtatctacttttattcttgatgttgtttataagtacattccctcttgtttttcttactcattcttaccaatggacttaaacttaattttattggactttacaaag

SEQ ID NO: 87832 - DNA, 38 bp, Homo sapiens
  chr20:52285632-52285670
  hypo
ctgagattacaggcatgtgccaccgtgcccagcctttg

SEQ ID NO: 87833 - DNA, 42 bp, Homo sapiens
  chr20:52311463-52311505
  hypo
taaagtagaagctgtcggccgggcacgatggctcacgcctgt

SEQ ID NO: 87834 - DNA, 132 bp, Homo sapiens
  chr20:52341618-52341750
  hypo
tttcatctcctcttccggatctcctctccgaccctgccctccggcctccgtggtggccttccctggacggtattcacacgttcccctactctatagtttccagttgggtttagccaacgggagacacctgga

SEQ ID NO: 87835 - DNA, 209 bp, Homo sapiens
  chr20:52385841-52386050
  hypo
ttggaagtagcttgacgtggactacagttaatgccttgtttaatgtggctcctccgtggtagacagggctgacaatcaactgcatatgcccgcatcagactcctaagtagatttctatattttacagaatttttttcttatttgaactagttttttggttttctaatatctcatataggataattttggtacaacgatggttcttgtaa

SEQ ID NO: 87836 - DNA, 30 bp, Homo sapiens
  chr20:52403888-52403918
  hypo
agcacacttagaaaccgtagaaatgtttat

SEQ ID NO: 87837 - DNA, 30 bp, Homo sapiens; identical to SEQ ID NO: 46227
  chr20:52484713-52484743
  hypo

SEQ ID NO: 87838 - DNA, 30 bp, Homo sapiens
  chr20:5261671-5261701
  hypo
ctggagatgaagtgccgtgtgcttccgaca

SEQ ID NO: 87839 - DNA, 29 bp, Homo sapiens
  chr20:52693116-52693145
  hypo
agagagattaattttcgtcaccactattg

SEQ ID NO: 87840 - DNA, 89 bp, Homo sapiens
  chr20:52693385-52693474
  hypo
cacccttcttttattgcgaaaattgtgtcttatttatatttgtaacctaagtgcctacctgaatgccagcccaacgtcaatgttgcctc

SEQ ID NO: 87841 - DNA, 30 bp, Homo sapiens; identical to SEQ ID NO: 46230
  chr20:52773951-52773981
  hypo

SEQ ID NO: 87842 - DNA, 548 bp, Homo sapiens
  chr20:52789401-52789949
  hyper
ctcatcaggtctggccgcatgcccaggtccctcggattggactcacaggatcagcagcccgtagccttctttgcggtagtcgcgataggccttccacggtttgatctccagccgctgcgggtacgcgctctcggtgcggtacagcgcttccagcaggcatggcgagcccaggtgcaccgactcaaaggaacccaacttcatgcggaaaatcttgccatacttcttgtggtactccacctgcagccggccgggcacagcgcggtgtcagcgcgcatcctccgccgtgcccgaagcgctttccctcctcccgcctccttcctcctaggggaccggggaccctccctgcccagacgccgaagcgcaccatgcgcccgaggcgcgcatgtcggggagggtttggagcgccactgggagggcggaagagggaggagagagtcaggggcgcgaaaaggggtttaccagggtgtcgtgctgtttcttgagaccccctttccagagaatctgcagcaggctgcccagcagtggccagctggtggggcccggcaggg

SEQ ID NO: 87843 - DNA, 129 bp, Homo sapiens
  chr20:52790081-52790210
  hyper
cggcaagcgagcggctcttgctgatgggggagctcatggcagcgggggacaccggagcgcgggaaggcaggaggatggggtggggcgaggttggtacgaggtgctagtgggagtcggggcttaacgatt

SEQ ID NO: 87844 - DNA, 89 bp, Homo sapiens
  chr20:52790612-52790701
  hyper
cggctggccagactccgagggacgcgggacccaggggagggggggtggaaggaggatggagtcagcgaggtgagcgagggcgtccgggc

SEQ ID NO: 87845 - DNA, 30 bp, Homo sapiens
  chr20:52824090-52824120
  hypo
atccatgtaataaaccggcacacatacccc

SEQ ID NO: 87846 - DNA, 209 bp, Homo sapiens
  chr20:52867313-52867522
  hypo
ggccaggcggggggctgaccccccacctcgagagggaatcttttgatgaacttgccactcatcaagattacacaactagtaagaggtggagctaagagttgaactcagacaatatgaacctaaaaaccagtgttactaaatgagtcactccaatgaagaactttaactggaaatttggtgtcctacggagaggccgtagcatgcaaaga

SEQ ID NO: 87847 - DNA, 876 bp, Homo sapiens
  chr20:5296172-5297048
  hyper
cagcacacctggaaacgactccacatgtgggcgccgcgggatgctgggtagcaaggagatgacccagctgaacaatgcatttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactccccgcccgggagcgacccgttccagcagcccccttcccgccccatcaacgcggccgcactgtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 87848 - DNA, 194 bp, Homo sapiens; identical to SEQ ID NO: 4735
  chr20:5297225-5297419
  hyper

SEQ ID NO: 87849 - DNA, 84 bp, Homo sapiens
  chr20:5297672-5297756
  hyper
cgtggcaccgcacccgggtcgcgcgcgcaggaggggagagtcctgtcttccggaggtgcccagtgccagcgtccgcgcccacta

SEQ ID NO: 87850 - DNA, 79 bp, Homo sapiens; identical to SEQ ID NO: 46232
  chr20:53051998-53052077
  hypo

SEQ ID NO: 87851 - DNA, 329 bp, Homo sapiens; identical to SEQ ID NO: 38199
  chr20:53091752-53092081
  hyper

SEQ ID NO: 87852 - DNA, 92 bp, Homo sapiens; identical to SEQ ID NO: 38200
  chr20:53092141-53092233
  hyper

SEQ ID NO: 87853 - DNA, 100 bp, Homo sapiens; identical to SEQ ID NO: 13865
  chr20:53092234-53092334
  hyper

SEQ ID NO: 87854 - DNA, 198 bp, Homo sapiens; identical to SEQ ID NO: 38202
  chr20:53092335-53092533
  hyper

SEQ ID NO: 87855 - DNA, 182 bp, Homo sapiens; identical to SEQ ID NO: 38203
  chr20:53092686-53092868
  hyper

SEQ ID NO: 87856 - DNA, 337 bp, Homo sapiens; identical to SEQ ID NO: 38204
  chr20:53092912-53093249
  hyper

SEQ ID NO: 87857 - DNA, 159 bp, Homo sapiens
  chr20:53122859-53123018
  hypo
ctgccccttagacatcggggtgggattgtttagaacaatgtctgccatgtagtaaattttcaatacatgttggctgtaccatgattggcattattactgaaggcttactcaatacatgccattttatttctttaaattttattttaatgtattttattg

SEQ ID NO: 87858 - DNA, 24 bp, Homo sapiens
  chr20:53209356-53209380
  hypo
caccacgcccggccagataaattt

SEQ ID NO: 87859 - DNA, 30 bp, Homo sapiens
  chr20:53411711-53411741
  hypo
agaagtgtgggtctccgggactcaatcact

SEQ ID NO: 87860 - DNA, 40 bp, Homo sapiens
  chr20:53530458-53530498
  hypo
ttagtcttttaattacgttgcagaaatgattctttttttt

SEQ ID NO: 87861 - DNA, 23 bp, Homo sapiens
  chr20:53535735-53535758
  hypo
aaaaccaggaggggccgggcgcg

SEQ ID NO: 87862 - DNA, 30 bp, Homo sapiens
  chr20:53565997-53566027
  hypo
tagtgatacagacttcgctctatattttag

SEQ ID NO: 87863 - DNA, 90 bp, Homo sapiens
  chr20:53604671-53604761
  hypo
tctttttaaaacatgcgctgctatagtttgaatatcccctcaaaactcatattgaaacttagctgccattgtaagagtgtggagaggcag

SEQ ID NO: 87864 - DNA, 103 bp, Homo sapiens
  chr20:53801909-53802012
  hypo
tgtattttaaagtcattatcctggtaattgaaatcataggaatggatgatttagccatggtaaacatgcatattaaaaataaatgttccgccgggcacgttgg

SEQ ID NO: 87865 - DNA, 138 bp, Homo sapiens
  chr20:53866697-53866835
  hypo
acaaaaacaattccacgatccctgcatttacccaacagtatctaagcttctgataaattcttgttaaatgaatgtatgaaacaaaaacatatactgtgaatttatgaaaatgttaactagaattccatttgaaagttg

SEQ ID NO: 87866 - DNA, 33 bp, Homo sapiens
  chr20:53965510-53965543
  hypo
aggactgagggtgcccggggcaagtgccagccc

SEQ ID NO: 87867 - DNA, 26 bp, Homo sapiens
  chr20:54522665-54522691
  hypo
agaggagaactcgttgagttttatct

SEQ ID NO: 87868 - DNA, 716 bp, Homo sapiens
  chr20:54578078-54578794
  hyper
tcatcaagccaaacacggagcaccaggtcgctaaacagcagctacagcttccgtcagctcttcccctactctcatcaacctcaaagtctgtctttccccagctatttgcaattctctgaaaggacatgagcccgggaagggagaactggctcccaagcgctttcctacaggagctcagcgcagttgccaaattccttttcctcccctcctccgcaacttttctctaagtaccggagaagggcttgctgcctactccgaggcagcggcagtgccagcggtgcctggcacacgaacagtggaacctgcaggcgagatctgacccccggctctgcccccgccctccgcggccacctgcccgatctctgaagagtgtggaagcccggggctctcttgggagagaagcttctctacctgggagaaacaaatcaaacatttatcctgttccgcaaaggtacccagggagcagcctcagcggcacccgcagaggagtctgagcaagggcaccaagatctggccaagagataacgacgtccagggaccaggtgcccttcggctcccgccgacctgttgctcgaaacttgccctgagctctcgctgccgggctctgggctcccaagcctctcccccgccgccgcagcagcctcttttaggggcccggaagaaatgggagccggggctggtgagaggggtaggaagagggacggtagaagtttcag

SEQ ID NO: 87869 - DNA, 86 bp, Homo sapiens
  chr20:54579873-54579959
  hyper
gctagccaggtccctcgcaccgaaagcgcggattcgcaggatcaggtccagggcgccgggcgcagcgttcagggcggctggtccgg

SEQ ID NO: 87870 - DNA, 453 bp, Homo sapiens
  chr20:54580069-54580522
  hyper
cgcagcgtccggctgggttggcttatcgcgcaacccgcgggctccgagaaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 87871 - DNA, 70 bp, Homo sapiens
  chr20:54580621-54580691
  hyper
cgctccgggaagatgagcctcagaagccgcaggggcgcgccttccccccacaccgcgaatcctccccagg

SEQ ID NO: 87872 - DNA, 18 bp, Homo sapiens
  chr20:54585945-54585963
  hypo
tttgaggtgcagtctcgc

SEQ ID NO: 87873 - DNA, 170 bp, Homo sapiens
  chr20:54618242-54618412
  hypo
gaatgtgcaaatgcgcgtgtgtgcgctctctctcccttcctcaaaacatcttcatatttttgaacctctgtggatcacagtaactgaaaccaaggaaagtgaaaacctccgatgagattggactaccgtatcctcccataactgaaagcgtaaatcggctcatttagtta

SEQ ID NO: 87874 - DNA, 30 bp, Homo sapiens
  chr20:54880314-54880344
  hypo
tttccgctacccctgcgctttcccctaacg

SEQ ID NO: 87875 - DNA, 317 bp, Homo sapiens
  chr20:54918909-54919226
  hyper
tgtttagctctgcagcgcccaagcctgatgaatttacgacaagcttccaaaaaaggcaattgcggcttgcggagggtctagaggctcagttgcccgaggctgtcttgaggagctgcctttgggactccgcgaaacctcgaagtcttgggctgcgcctccccttgcgcggtcggagccttggcagagcctgcggcgccacctcgtgggcgaggccgcctggtgcaaggtcatccggtgccgggacccgctcctcgccccgccaggacccccgctcacctccaagctggacgcccgcggagccctgatcccctaacgcc

SEQ ID NO: 87876 - DNA, 83 bp, Homo sapiens
  chr20:54919287-54919370
  hyper
cgagcgcgcaactctcagcctcggagcgtgctggaaatgctgatgggaaccgtttgaatgaccgggcacgggtctgcaagaaa

SEQ ID NO: 87877 - DNA, 17 bp, Homo sapiens
  chr20:55112759-55112776
  hypo
tgcgtggctggagagaa

SEQ ID NO: 87878 - DNA, 413 bp, Homo sapiens; identical to SEQ ID NO: 1487
  chr20:55199898-55200311
  hyper

SEQ ID NO: 87879 - DNA, 742 bp, Homo sapiens; identical to SEQ ID NO: 38210
  chr20:55200615-55201357
  hyper

SEQ ID NO: 87880 - DNA, 2 bp, Homo sapiens
  chr20:55201450-55201452
  hyper
gg

SEQ ID NO: 87881 - DNA, 489 bp, Homo sapiens; identical to SEQ ID NO: 38212
  chr20:55201580-55202069
  hyper

SEQ ID NO: 87882 - DNA, 1080 bp, Homo sapiens
  chr20:55202358-55203438
  hyper
gggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagt

SEQ ID NO: 87883 - DNA, 164 bp, Homo sapiens
  chr20:55203505-55203669
  hyper
cgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccg

SEQ ID NO: 87884 - DNA, 23 bp, Homo sapiens
  chr20:55203806-55203829
  hyper
cgggaccgcgctgtgcccacgga

SEQ ID NO: 87885 - DNA, 984 bp, Homo sapiens
  chr20:55204104-55205088
  hyper
gtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccctcagacgtggcttttacgcacgaagtctctgtccaaaggggtcagatgaggctacctgctagcgacaccttggcggacactcctccaaggccggcttgtcacctgccccgctacctcctcggg

SEQ ID NO: 87886 - DNA, 476 bp, Homo sapiens
  chr20:55205304-55205780
  hyper
cgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtg

SEQ ID NO: 87887 - DNA, 137 bp, Homo sapiens; identical to SEQ ID NO: 38217
  chr20:55206293-55206430
  hyper

SEQ ID NO: 87888 - DNA, 77 bp, Homo sapiens
  chr20:55378966-55379043
  hypo
tttctccacactcatcgtcccaggtgttgatttgttgatttttataaaccaatcataaccagttcagcctttttttt

SEQ ID NO: 87889 - DNA, 136 bp, Homo sapiens
  chr20:55379403-55379539
  hypo
ctgggattacaggcgagagccaccgcgcccggccagttcagccttcttctccctccacacgccatccggggggtgctcagtggagacctgttgactcacagctctgtcaactcatgagccccgtgtgtttcccgtc

SEQ ID NO: 87890 - DNA, 135 bp, Homo sapiens
  chr20:55405254-55405389
  hyper
cacccccacaccttccggtttccaccccgggctcatttgtctgcagttaaatcctcagggacttttttctttcccccagggtgggcacattttattttaaacagaaaaaaatgacaaagtcgctcataaatcgag

SEQ ID NO: 87891 - DNA, 30 bp, Homo sapiens
  chr20:55405620-55405650
  hyper
ttaaaattacctggtcgatagaataccata

SEQ ID NO: 87892 - DNA, 882 bp, Homo sapiens
  chr20:55499420-55500302
  hyper
ttaaggagagtatcacgtttatactttaaaaagcccaactgctctgtttaaagtggatctttcataaacttgcagtcaggagcaacaatgacgtccttcagggagtcaaacactttggaaagaaacgcgaactgaaaatgctattggaggacgcaagaaaaccgaaaacgctcggtcgagtttttctgtcaagccacgtttgaaattaaggaattcgtgtaaattgccatctttcgcatccgaagcaagaaacgtacacagtttccctgctatacggagttgttgtgacataagaaaacagaatctttttaaacctcgagtttaattaattcttttttaaaaaagaatttagcagcagcatgttaaaagggaaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctagataatgaagcctggtcgcggttattggcagaagggcccgggcgcgctgtgagaacgctgcaggctcactttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggc

SEQ ID NO: 87893 - DNA, 230 bp, Homo sapiens; identical to SEQ ID NO: 38221
  chr20:55500440-55500670
  hyper

SEQ ID NO: 87894 - DNA, 50 bp, Homo sapiens; identical to SEQ ID NO: 13885
  chr20:55500671-55500721
  hyper

SEQ ID NO: 87895 - DNA, 63 bp, Homo sapiens; identical to SEQ ID NO: 38223
  chr20:55501052-55501115
  hyper

SEQ ID NO: 87896 - DNA, 87 bp, Homo sapiens
  chr20:55531782-55531869
  hypo
gatcaccacaccttccgcattcttggaagttttccagtaactgaattgccagcttttgagtttaaattacttaaaattaaataacat

SEQ ID NO: 87897 - DNA, 196 bp, Homo sapiens
  chr20:55532189-55532385
  hyper
acattttaaaaattcagctcctccatcacacaggccacacatcacaggggcagtagcctcgtgtggctggtggctcctgtgttggccagtacaggtcaggaacttctagaaagtgcttcccaagtggtagcagtgattgtcctactataactagcagaatgacaggaaatggagggtttctcgtcttgacctcaac

SEQ ID NO: 87898 - DNA, 30 bp, Homo sapiens
  chr20:55533555-55533585
  hypo
cacaaactccactcccgaaatcatcacagg

SEQ ID NO: 87899 - DNA, 105 bp, Homo sapiens
  chr20:55588889-55588994
  hyper
tcaaaagcaattttccgaaagtgcctgcctcgacaagcaagccaccggcccgcgcagtccggggctacagagcgctcaagacctttccctcgggtgctgagggaa

SEQ ID NO: 87900 - DNA, 430 bp, Homo sapiens
  chr20:55685373-55685803
  hypo
ctaagtcttcccaaacggcgtgtgcggggtgctgcgctgtcttccagatccgcttgtgcagggcgctgtgctgtcttctggttcggcgtgtgcggggcgctgtgctaagtcttccggctgggcgtgtgcggggcgctgtgctaagtcttccggctgggcgtgtgcggggcgctgtgctaagtcttccggctgggcgtgtgcggggcgctgtgctgtcttccggttcggcgtgtgcggggcgctgtgctaagtcttccggctgggcgtgtgcggggtgctgtgctaagtcttccggctgggcgtgtgcggggcgctgtgctgtcttccggttcggcgtgtgcggggcgttatgctaagtcttccggctgggcgtgtgcggggcgctgtgctgtcttccggttcggcgtgtgcggggcgctgtgctaagtct

SEQ ID NO: 87901 - DNA, 280 bp, Homo sapiens
  chr20:55693330-55693610
  hypo
accccacctaagcaccgcccacccccacctaagcaccacccaccccaccccaccccacctaagcaccgctcaccccactacacccgcagcactgcccgcctcacagagcagggccccacctgcctcagagtaagaaaccagcagctccaccacccctggaggctgccttggcgcagcactggaaacattcataagaacacagctgccttttccgagattcagaggttgctctggtgcctgtcacctgcccaggaatcctgctttccagcaaaggtgcctg

SEQ ID NO: 87902 - DNA, 30 bp, Homo sapiens
  chr20:55766158-55766188
  hypo
gtaaaggtgagtcatcgcagccgagtctga

SEQ ID NO: 87903 - DNA, 29 bp, Homo sapiens
  chr20:55772236-55772265
  hypo
tgagccaccgcacccggccctaatttttt

SEQ ID NO: 87904 - DNA, 65 bp, Homo sapiens
  chr20:55839603-55839668
  hyper
gccccaggctcgcgtcgccggggtcgtcgcggctccagtcggaaaccgggacccccagccgcccc

SEQ ID NO: 87905 - DNA, 87 bp, Homo sapiens; identical to SEQ ID NO: 38226
  chr20:55839692-55839779
  hyper

SEQ ID NO: 87906 - DNA, 942 bp, Homo sapiens
  chr20:55840865-55841807
  hyper
aggagaagccctggccgccgggcccgccgccctcctccaccgccatggcgttgtacaggtccagcatgaacatgggtgccgagttgtgcttgccctggaggtgcgggcgcgggcggtggggcaagcccaaaatggagaggatctcgcgctgcatctcccgccgctcctggctgcggaggcgccggtggatgaagctcgagtgcacctcgttgtccaggctgaagtcggccagggcggagcgcagcaggaacaggggtgcccagagcgccacgaagctgtgcggcgccgcagctcgcagtgagcgcacgtgcatcgcgccggctctacgcgctacccgggctccgggctccgggcccgcaccgccccaggtggcagagggggcaggcggccgtccgcgccgctcggtcacttgctgcagacgggccccgctgcgcccgcgccagacatggcccctccccggccggccgcgctctgcccggacccccgccccctgctcggtgctggccccgggcccctcgccccgcactcgcccgggcgcaccgcagggcttggaaagcagccccggcgaacgaaaaggcgagtgaggaggcgggcgcgggtgggaggagcagccagcaagcctaggagtccagagagccaacgccggggaggcagcgaggaggcaggcgggcgggcgagcgctccttcttcccgctcctctggcgctctcgccctcgggcggcggcaacccaccctcttccaacctccggcgcggatagcaggggccccggggcgctctcccagccttgtgcgccctggatcgcacaagaggccgcctcgggagcgccagagtggtacgcgctggggcctgggcggaggaggaggaggaggaggacgggcttcgaggggcccctcccgcgccggcggcctcccacctgccctcggccccgccctccccccagc

SEQ ID NO: 87907 - DNA, 378 bp, Homo sapiens
  chr20:55842055-55842433
  hyper
cggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgcacgtttgttttctttcctgtagtttctcttgctgtctggaattgctgtttgagttactccgtgccttctttattgccttcttacccccgctagacacccagagcactggggcccggatcagcgatcttctccgcacctctggtacc

SEQ ID NO: 87908 - DNA, 30 bp, Homo sapiens
  chr20:55876620-55876650
  hypo
tggacagctgtccctcgatctgcgatcact

SEQ ID NO: 87909 - DNA, 175 bp, Homo sapiens
  chr20:55925381-55925556
  hypo
agtaagagtagttcacgtatgatttcacttgaccctaattaggaacagccctggcatcattttccccaccatgcagcaggaaactgaggcccaaagagccccgaggtgggctcagggtaccccagtgggcaaacagggagaggccagggcgggaaacccgcggccgacctcgcct

SEQ ID NO: 87910 - DNA, 206 bp, Homo sapiens
  chr20:55958990-55959196
  hypo
gcttaaaatgtaaatcggctcccgaaaaagaactgacctgcattcttaatcttttattctttttccctcctgactgtggtgcagaggaggcagtatgggaggagacaaagctcaaagaaggcactgacaatccccagcatcctacgggcccgaatccacactgcggattccgtcagctcactggcggcagcactctctggtgtctt

SEQ ID NO: 87911 - DNA, 205 bp, Homo sapiens
  chr20:55959376-55959581
  hypo
ttgtctttcatttctcttcttcactacccgtcagcatgataggtttcttcctcctcttatgaatcccagtgtcaagatacagcctgatcgccccttaatacggtgccgccattactccagacccctctgcaagcattggtcattcatcagctttcacgaggtgaactggggacgaggcaggggcttggaccggcttcctggccag

SEQ ID NO: 87912 - DNA, 42 bp, Homo sapiens
  chr20:55965005-55965047
  hyper
gaagggaggaaaggacgcccaggcttccggaagactcggggg

SEQ ID NO: 87913 - DNA, 138 bp, Homo sapiens
  chr20:55969837-55969975
  hypo
caggcccacagcaggcgcctgggggcatggactgggcgggagcagctgcccagaggtgagggtgtgtgcctccagtgcctgcagctcttttctgcttacagtgggataaggccttcccacgtgcgtctgggctcgctc

SEQ ID NO: 87914 - DNA, 30 bp, Homo sapiens
  chr20:55970272-55970302
  hypo
gtctgggcctgggggcgggtggcagggcca

SEQ ID NO: 87915 - DNA, 30 bp, Homo sapiens
  chr20:55983462-55983492
  hypo
ggaggagctcccaggcgcacaggggccgcc

SEQ ID NO: 87916 - DNA, 35 bp, Homo sapiens; identical to SEQ ID NO: 46244
  chr20:55989687-55989722
  hypo

SEQ ID NO: 87917 - DNA, 30 bp, Homo sapiens
  chr20:56027674-56027704
  hypo
gggatgggcctgtgccgcactgttgagggc

SEQ ID NO: 87918 - DNA, 51 bp, Homo sapiens
  chr20:56031247-56031298
  hypo
atataatgcagatgacgagatgacagcagggtgtgacgctgatggtttctg

SEQ ID NO: 87919 - DNA, 35 bp, Homo sapiens
  chr20:56041897-56041932
  hypo
tccacatcctagtcccggcacgttttgagtgttca

SEQ ID NO: 87920 - DNA, 23 bp, Homo sapiens
  chr20:56053945-56053968
  hypo
gttatccaaattagccgggcacg

SEQ ID NO: 87921 - DNA, 30 bp, Homo sapiens; identical to SEQ ID NO: 46247
  chr20:56065208-56065238
  hypo

SEQ ID NO: 87922 - DNA, 30 bp, Homo sapiens
  chr20:56066624-56066654
  hypo
agagtggtgcattcacgtcagaagacggtt

SEQ ID NO: 87923 - DNA, 30 bp, Homo sapiens
  chr20:56075973-56076003
  hypo
agtgtcctttaggtgcggaatcagcgggga

SEQ ID NO: 87924 - DNA, 30 bp, Homo sapiens
  chr20:56155603-56155633
  hypo
gatcaaggtctagaacgccccatcatcacc

SEQ ID NO: 87925 - DNA, 63 bp, Homo sapiens
  chr20:56240406-56240469
  hypo
taaattttcctagctcgcccacggcgttagtccgcccgccccctgccccgggaatctgaggat

SEQ ID NO: 87926 - DNA, 30 bp, Homo sapiens
  chr20:56245200-56245230
  hypo
aggcaccagacatctcgcttcctgggcctt

SEQ ID NO: 87927 - DNA, 46 bp, Homo sapiens
  chr20:56265981-56266027
  hypo
gatgcctctacaccccgaggcctggggatcccgcttacaaggctac

SEQ ID NO: 87928 - DNA, 30 bp, Homo sapiens
  chr20:56267652-56267682
  hypo
gaggattcaattcctcgagggctgaggctg

SEQ ID NO: 87929 - DNA, 308 bp, Homo sapiens
  chr20:56271495-56271803
  hypo
tcaaatcctgctctgcggtgtgctgggcaatccctggcaggtgacttagctccacctcctccatgcgatggggttgccatgaggattagtgagacagggtgtgcaaagagctcagtgagcacctgccactgtcagtaggaattgctagggttcaaaaagccgcgacgtcaccggcaagaacccagaaaaacaaggagacaaagctgttgggtgttgggttcattccctaaatactgactgcctcccagattctcccctttcttgtctttgttcctgaaccccaccctcaactccgctctgagtctatt

SEQ ID NO: 87930 - DNA, 38 bp, Homo sapiens
  chr20:56272948-56272986
  hypo
gaataatgcaaagaacgaacaaccgcaaacatctaata

SEQ ID NO: 87931 - DNA, 30 bp, Homo sapiens
  chr20:56296686-56296716
  hypo
actccagaaagtttccggttaccgcccacc

SEQ ID NO: 87932 - DNA, 83 bp, Homo sapiens
  chr20:56385727-56385810
  hypo
cagcagcagctgagccgtaatgggcacgagcagcatggccatcgcatgatgcatcggttgggagcattcggctgctggtaata

SEQ ID NO: 87933 - DNA, 30 bp, Homo sapiens
  chr20:5658367-5658397
  hypo
acaaattctcttaaacgatatcacgctttt

SEQ ID NO: 87934 - DNA, 21 bp, Homo sapiens
  chr20:56725919-56725940
  hyper
cgcctccgagtcctgcgttgc

SEQ ID NO: 87935 - DNA, 43 bp, Homo sapiens
  chr20:56766160-56766203
  hypo
cccccaacacatgcacgtgccaagaaccagtctggtcagttag

SEQ ID NO: 87936 - DNA, 68 bp, Homo sapiens
  chr20:56770989-56771057
  hypo
gcctccacctcctctcgactcctctgaatccccctggagagacctgctgtggccgccctgtagcctaa

SEQ ID NO: 87937 - DNA, 264 bp, Homo sapiens
  chr20:56771442-56771706
  hypo
acatcctggctttcacgcctaaggcacgctctgcccatcacgggcatgtccaggacgctaagatggatcccttctgcaagatactgccttgcagtgcattcgaacacacgtccgtccccttccttcgctttctccttacaaggttctcccagcgtccctgcctcctccccatttccctatctcttgcatgggtgtctacttctccgaggacccagacacccagcatctctcccccacctggctctccagcgcatccccttgggt

SEQ ID NO: 87938 - DNA, 305 bp, Homo sapiens; identical to SEQ ID NO: 46253
  chr20:56771994-56772299
  hypo

SEQ ID NO: 87939 - DNA, 30 bp, Homo sapiens
  chr20:56780195-56780225
  hypo
ccaagcccatttctacggcctctgtgggat

SEQ ID NO: 87940 - DNA, 513 bp, Homo sapiens
  chr20:56780438-56780951
  hypo
tgaagacgcctcccacgtccccacgtctgcgtccgcacctgaagacgcctcccacgtccccgcaccccacgtctgcacccacacctgaagacacctcccacgtccccgcaccccacgtccccacgtctgcgcccgcacctgaagacgcctcccacgtccccgcaccccaagtccccacgtctgcgcccacacctgaagacgcctcccacgtcccgtctgcgtccgcacctgaagacgcctcccacgtccccactccccacatctgcgcccacacctgaagacgcctcccacgtctgcacccacacctgaagacacctcccacgtccccgcaccccacgtctgcgcccacacctgaagacgcctcccacgtcccgtctgcgccgcacctgaagacgcctcccacgtccccactccccacatctgcgcccacacctgaagacgcctcccacgtctgcacccacacctgaagacacctcccacgtccccgcaccccacgtccccacgtctgcgccc

SEQ ID NO: 87941 - DNA, 93 bp, Homo sapiens
  chr20:56781011-56781104
  hypo
gtccccgctccccacgtctgcacccacacctgaagacgcctcccacatccccgcaccccacatccccgcgtctgtgcccgcacctgaagacgc

SEQ ID NO: 87942 - DNA, 819 bp, Homo sapiens
  chr20:56803306-56804125
  hyper
ggttgaaggggatgccgaccatcaggtccagctcctctttgagctcccgcacggtcatgtcgccgcggcagtttgccactcggaacatctcccccgtctcctccagccgcacccgcaggacgaagacgtcaggggccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgaggcccctccctgcctgccgcccgagcctccagggagaccgatgggcgggcggccccccaaggtcccgcagtcctttcccgctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 87943 - DNA, 30 bp, Homo sapiens
  chr20:56821439-56821469
  hypo
ctgactaaaatctcacgagaggataagagg

SEQ ID NO: 87944 - DNA, 74 bp, Homo sapiens
  chr20:56839596-56839670
  hypo
acacttctgaccaggcgacagatgaaaacagtatttcagaaagatcatcctggcagtagcgttccaagtcaact

SEQ ID NO: 87945 - DNA, 30 bp, Homo sapiens
  chr20:56947808-56947838
  hypo
tatttttcataatgccgtcatttcaaaata

SEQ ID NO: 87946 - DNA, 30 bp, Homo sapiens
  chr20:57009545-57009575
  hypo
gacataagagaatgccggtaaattgcttta

SEQ ID NO: 87947 - DNA, 76 bp, Homo sapiens
  chr20:57041680-57041756
  hypo
ttgtgaaggacctagcgccagagggagaggcaataaacaagtcaccaacagagcttcagagcgggctgagagctgg

SEQ ID NO: 87948 - DNA, 33 bp, Homo sapiens
  chr20:57047499-57047532
  hypo
gacttcggggtgtgacggcgtcaccggtgcttg

SEQ ID NO: 87949 - DNA, 30 bp, Homo sapiens
  chr20:57056542-57056572
  hyper
ggccaagaatcttgtcgggccgcagaaata

SEQ ID NO: 87950 - DNA, 55 bp, Homo sapiens
  chr20:57089405-57089460
  hyper
cggtcccactgggcccggcacaaagggcagctctgggtacctacaggccaggccc

SEQ ID NO: 87951 - DNA, 70 bp, Homo sapiens
  chr20:57090103-57090173
  hyper
cgccttccccaaagtcttcgcagtgggcaaggaggcctcccccaagctctggtcccggccaaggcagagc

SEQ ID NO: 87952 - DNA, 47 bp, Homo sapiens
  chr20:57198958-57199005
  hypo
gggtgtgtgccctcccgtgccctctgcctgagcgccccatcctccat

SEQ ID NO: 87953 - DNA, 282 bp, Homo sapiens
  chr20:57224798-57225080
  hyper
ggtcctcacagtgaactcgcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccggg

SEQ ID NO: 87954 - DNA, 248 bp, Homo sapiens
  chr20:57225218-57225466
  hyper
cgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgtgggtgccgtgctcgggcccgggcggcccctgcccgacgcggccccacggagcc

SEQ ID NO: 87955 - DNA, 67 bp, Homo sapiens
  chr20:57268346-57268413
  hyper
aggccgcgacacctgcggacggcggggggggagacgtggccgctcccagggccgcgcgtcggccccg

SEQ ID NO: 87956 - DNA, 131 bp, Homo sapiens
  chr20:57268845-57268976
  hypo
cctctacctgaactacgccaccgtggctgccctgccctgcagggtgagccggcacaacagcccctcggccgcccacttcatcacgcggctggtgcggacctgcctgccgcccggagcgcatcgctgcattg

SEQ ID NO: 87957 - DNA, 21 bp, Homo sapiens
  chr20:5732235-5732256
  hypo
ccaccacgcccggctatcttc

SEQ ID NO: 87958 - DNA, 30 bp, Homo sapiens
  chr20:57385895-57385925
  hypo
tggaagggacatctgcggaatgatgatggt

SEQ ID NO: 87959 - DNA, 149 bp, Homo sapiens
  chr20:57392258-57392407
  hypo
tccgcaaggcagctacggccttgccctggagctcccagtctagcaggggtggaaaacaggtaagccccccagcggaagccccagacctggcatgctgtgaggtcggggaaggagcgggggctttcccgaggaggcgtcagtgagggtgg

SEQ ID NO: 87960 - DNA, 30 bp, Homo sapiens; identical to SEQ ID NO: 46260
  chr20:57398016-57398046
  hypo

SEQ ID NO: 87961 - DNA, 30 bp, Homo sapiens
  chr20:57465637-57465667
  hyper
gcgacctgctgcttccgagtgttcctgggc

SEQ ID NO: 87962 - DNA, 30 bp, Homo sapiens
  chr20:57541389-57541419
  hypo
gttgagagagggagacggcagcagatgcag

SEQ ID NO: 87963 - DNA, 30 bp, Homo sapiens
  chr20:57555048-57555078
  hypo
aaacaaaaacctttccgtgatcatcaggag

SEQ ID NO: 87964 - DNA, 30 bp, Homo sapiens
  chr20:57616915-57616945
  hypo
acagagcaggtaactcgggaaaaaaaagga

SEQ ID NO: 87965 - DNA, 23 bp, Homo sapiens
  chr20:5761884-5761907
  hypo
agggcttcctgagagcgagtgca

SEQ ID NO: 87966 - DNA, 76 bp, Homo sapiens; identical to SEQ ID NO: 46261
  chr20:57622769-57622845
  hypo

SEQ ID NO: 87967 - DNA, 76 bp, Homo sapiens; identical to SEQ ID NO: 46262
  chr20:57622905-57622981
  hypo

SEQ ID NO: 87968 - DNA, 48 bp, Homo sapiens; identical to SEQ ID NO: 46089
  chr20:5762556-5762604
  hypo

SEQ ID NO: 87969 - DNA, 41 bp, Homo sapiens
  chr20:57674658-57674699
  hypo
gtaatgtttgatgtacgtatgcatcgcgcaatgattaaatc

SEQ ID NO: 87970 - DNA, 51 bp, Homo sapiens; identical to SEQ ID NO: 46263
  chr20:57699771-57699822
  hypo

SEQ ID NO: 87971 - DNA, 40 bp, Homo sapiens
  chr20:57723438-57723478
  hypo
tgggttagaacagagcggccgggcgcggtggctcacgcct

SEQ ID NO: 87972 - DNA, 354 bp, Homo sapiens
  chr20:57767543-57767897
  hypo
tcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcgg

SEQ ID NO: 87973 - DNA, 348 bp, Homo sapiens
  chr20:57875541-57875889
  hyper
aggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctcc

SEQ ID NO: 87974 - DNA, 208 bp, Homo sapiens
  chr20:57929975-57930183
  hypo
ggccatgggctcccacgctgcacgactttagtcctgcctctcctcgctctatgaccttgggcggcagccacggaactcacggagcctcagcttgctcatctcaaaagtggacgcgaccacgcagcctcttcccgtggggctgaggtgagcactcagtggaatgatcaccgtgcctcaggcaggacaagagccacggggactgtggcta

SEQ ID NO: 87975 - DNA, 30 bp, Homo sapiens
  chr20:57935754-57935784
  hypo
gtactgtttcatactcgataacctccttcc

SEQ ID NO: 87976 - DNA, 197 bp, Homo sapiens
  chr20:57966144-57966341
  hypo
ggccgctaacataggcgacacaagcctggagctcttgtggcccctgtggcctcctgagcagagctgggctgggaatgaggcctcagagagggcactggagccgggaggtggagagacaggggtctgatgatattcagcagccagatccagatgtgaagcccagcctctcctccgggactttccggttacatgagcca

SEQ ID NO: 87977 - DNA, 55 bp, Homo sapiens
  chr20:57978786-57978841
  hyper
cctgagtggggggcacggggcccgaggaagaaggggccagcgggctgttccccac

SEQ ID NO: 87978 - DNA, 30 bp, Homo sapiens
  chr20:57994831-57994861
  hypo
aaaaggctgggaagacggctggactgcaca

SEQ ID NO: 87979 - DNA, 30 bp, Homo sapiens
  chr20:58100780-58100810
  hyper
gtaataatttggatccgtattctctggaag

SEQ ID NO: 87980 - DNA, 96 bp, Homo sapiens
  chr20:58152463-58152559
  hyper
gccggcctcgcgtggcggcgccgcccccggccctggtcccggtcccgccccgccggcgcctccccgcggccccggctccgctccgcggccctccgg

SEQ ID NO: 87981 - DNA, 283 bp, Homo sapiens
  chr20:58179128-58179411
  hyper
gcagggaggagggttcggagcgagggttcggagggtccggggtgccctagcaggcccaggccaggtggttgcggggaggaagcctcaggtcgctcccctccggtgccggggtgggcgcgtcgggacccactggcctcccagtcccaggagaggaaggaccagggaaaccagctgtctgcagctgctggggaaattaggggctctcagggttccctttcctccgggaggggaggaaacgggactaggaagctttcctgtttctagagcacggcttggtggggtg

SEQ ID NO: 87982 - DNA, 293 bp, Homo sapiens
  chr20:58179702-58179995
  hyper
cccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgc

SEQ ID NO: 87983 - DNA, 190 bp, Homo sapiens; identical to SEQ ID NO: 13892
  chr20:58180213-58180403
  hyper

SEQ ID NO: 87984 - DNA, 106 bp, Homo sapiens; identical to SEQ ID NO: 13893
  chr20:58180470-58180576
  hyper

SEQ ID NO: 87985 - DNA, 25 bp, Homo sapiens
  chr20:58180687-58180712
  hyper
cgctagcccccggacaggtgtgctg

SEQ ID NO: 87986 - DNA, 197 bp, Homo sapiens; identical to SEQ ID NO: 46264
  chr20:58283870-58284067
  hypo

SEQ ID NO: 87987 - DNA, 188 bp, Homo sapiens
  chr20:58311568-58311756
  hypo
ccgcaggtgctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacacctgccccgctgtacacctgca

SEQ ID NO: 87988 - DNA, 56 bp, Homo sapiens
  chr20:58331425-58331481
  hypo
gcttctgcttcagagcgggtggacacctggtcctccgtgcccgggacttccttctg

SEQ ID NO: 87989 - DNA, 30 bp, Homo sapiens
  chr20:58333983-58334013
  hypo
cctcctaacccacaccgagcacttggaaag

SEQ ID NO: 87990 - DNA, 101 bp, Homo sapiens
  chr20:58348371-58348472
  hypo
gccgacccttccctccggggccagctctccacacccacggggtctccgcatctcaccacggtccaccggcctcttcccccaagccgcgtcattgaggagct

SEQ ID NO: 87991 - DNA, 334 bp, Homo sapiens
  chr20:58507729-58508063
  hypo
ggaaaaaaaacaacaaaaaaaaaccacgctgccgtattcgcagatgctcggccagcctggagcccggtccagaaaaggccgcacgtggagccacgtgtcgcgcattgagccgccgcgggacgcatcaggcccagctgcgcggaggggctggcggcctcaaccgcaaggagaggccgcaggtggggacggcgggagggagagaagggactgaaggcgccgagcaggaggaaggttttgcgcgcactcccttcttccctaagtggaaccggcagtggcaacaacgaggccgaaggcgaagtccctgctcccaccgccggcacggtgacccttttcc

SEQ ID NO: 87992 - DNA, 214 bp, Homo sapiens
  chr20:58508688-58508902
  hyper
ctgcgcctcagggaccgccgcagcgcctccggcgaacggcggaaggcgggaagcgcccgtccaatccgcgccaggtgcggtcgatagtgcgtccaatcggcgtcgccgccagccaggtcccgccccccccatcccccccacccccgccaacgctcgccggggtcgcccgaggcctgagccaagggggacgctgtgggcgcggctcaggccaggc

SEQ ID NO: 87993 - DNA, 303 bp, Homo sapiens; identical to SEQ ID NO: 46268
  chr20:58514097-58514400
  hypo

SEQ ID NO: 87994 - DNA, 119 bp, Homo sapiens
  chr20:58514726-58514845
  hyper
cccgcggccttctggcggcgctcgggggagctgggcagtgagcgcgcccgccgcaggatgatgggccgcaggcgggggtcgcagcccgacggcgctggcgttggcggcggcgcgcggcc

SEQ ID NO: 87995 - DNA, 33 bp, Homo sapiens
  chr20:58530899-58530932
  hypo
ggtgtgtgccaccatgcccggctaattttaaaa

SEQ ID NO: 87996 - DNA, 30 bp, Homo sapiens
  chr20:58575987-58576017
  hypo
acttcattattgaagcgtcactattaaaat

SEQ ID NO: 87997 - DNA, 30 bp, Homo sapiens
  chr20:58584637-58584667
  hypo
tattcaatggaagctcgaagctctgcttgg

SEQ ID NO: 87998 - DNA, 177 bp, Homo sapiens
  chr20:58663181-58663358
  hypo
tacagccagcccatccgggatggggagctaccacagggcagcaggtttagctctcactgcttttctgacctgagtatgcctagagaggggagctcagagccatggaggagcaaggagagccttgggtcctacagcggctaccagacctctgcgtgcagttctcgccctgggcaagcc

SEQ ID NO: 87999 - DNA, 30 bp, Homo sapiens; identical to SEQ ID NO: 46269
  chr20:58671797-58671827
  hypo

SEQ ID NO: 88000 - DNA, 139 bp, Homo sapiens
  chr20:58682833-58682972
  hypo
gtcactctgattggacgtctttgggtcacatgctcaccattgaaccaatcaatatggctgcgaattgcaacgtaggggttgggtgagctcagggtcacatgatcttgcatttagggatggatgtcgcctttgtccacac

SEQ ID NO: 88001 - DNA, 161 bp, Homo sapiens
  chr20:58779025-58779186
  hypo
ccccaaagccagcctcgggggcctgtgaggctcctgtacacagtgggccgtgccctctgctctgtcctcccagcttctaggttctgatggctaacaatgaacatttactagtttagtgttgccctcaattcagtcttttttttttttgaggcagagtctca

SEQ ID NO: 88002 - DNA, 354 bp, Homo sapiens
  chr20:5891915-5892269
  hyper
ctgcactactcccctcggccgtccattctttggcccgcctttcccccacccccgctccagaccctgcacaccaggcgactggactggcgtaaatttccgcccatttgcgtcgccgcctgggggtgctgcttcgtgacgtcagggctgagctagggggcgcccgctcctggctgcccgctcctcccggccctgcggcccccgcctgccctttaaaagagcggggcctgcgccggccgcgccacaccgcggggaccaggaggcacgctggttttccggggccgctccatcgcgccttcctcctgcgcctcgcttctccggtccagccgccatcttcctttccgcacaggggccgcc

SEQ ID NO: 88003 - DNA, 30 bp, Homo sapiens
  chr20:58939020-58939050
  hypo
tgcaagtggttctgtcgtccatctctttgt

SEQ ID NO: 88004 - DNA, 175 bp, Homo sapiens
  chr20:59005702-59005877
  hypo
agaatcccattctcacggcggcttgcaggaccccatgtgatctcctaaccccctatatctcccctccacactcttccctcctgccgctctcacccctgcacagcctcactcctctccagccacgcgtgccttcatccaattctggaagcaaacatcattgcggggcttcttctta

SEQ ID NO: 88005 - DNA, 288 bp, Homo sapiens
  chr20:590311-590599
  hyper
cctaccccgacctggcggccgcagcgagggacgcagcacactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgcccagcagcagcacgttggccaggtgcgcgatgtagctggacgccaggcgcacggtctcgatcttggacagcttgcggtccaccggctcggtggggatgagcgtgcgcag

SEQ ID NO: 88006 - DNA, 108 bp, Homo sapiens; identical to SEQ ID NO: 37859
  chr20:590967-591075
  hyper

SEQ ID NO: 88007 - DNA, 30 bp, Homo sapiens
  chr20:59142135-59142165
  hypo
ctccacagaaggttgcgtctgcgtcaactc

SEQ ID NO: 88008 - DNA, 30 bp, Homo sapiens
  chr20:59174643-59174673
  hypo
gccgagagcatgttccgctttggctccctc

SEQ ID NO: 88009 - DNA, 31 bp, Homo sapiens; identical to SEQ ID NO: 46271
  chr20:59185805-59185836
  hypo

SEQ ID NO: 88010 - DNA, 162 bp, Homo sapiens
  chr20:59198071-59198233
  hypo
caagacaggctcccccgcactcaaacaattgtcgagtaaacatgcacactgggctctattctagcccctccccttctgaaacaaatgccatcacaccttgtcatgaaactgttgtatgacgatcttttccaacattttgtctcagtgatgtctgtaattttt

SEQ ID NO: 88011 - DNA, 193 bp, Homo sapiens
  chr20:59232938-59233131
  hypo
tccatgtgccagctccggacctgtttttaactcatcggcaacatttttaaaaataaggtatttcacataaaagtcagtatgtccaggttttggggggaatgataagattcagtatcaaggggctcctgttcccagatggaaggaaacgggcagggccgcccttcacacagcgttgctccgtccagccgctcac

SEQ ID NO: 88012 - DNA, 155 bp, Homo sapiens; identical to SEQ ID NO: 37860
  chr20:592405-592560
  hyper

SEQ ID NO: 88013 - DNA, 33 bp, Homo sapiens
  chr20:59443920-59443953
  hypo
ggctctatttgatcacgtcgtcttctgtgatgt

SEQ ID NO: 88014 - DNA, 30 bp, Homo sapiens
  chr20:59515105-59515135
  hypo
atggatataggatatcgataaaatatatac

SEQ ID NO: 88015 - DNA, 30 bp, Homo sapiens
  chr20:59553124-59553154
  hypo
gggtctgacactcagcgctccagacgctgc

SEQ ID NO: 88016 - DNA, 30 bp, Homo sapiens
  chr20:59565753-59565783
  hypo
ataattgactactggcgatgttgccaggct

SEQ ID NO: 88017 - DNA, 267 bp, Homo sapiens
  chr20:59598638-59598905
  hypo
tgcaggctcctagttcgaagctgtgatgtttgaggggactttgcagcctagagccagcagcagcttctgacaaggaaggggcacattgagcttcctccgtggaaaatcgcaggaacccccacccacgcagccactcgcagaagcccccacccacacggccactcgcaggagcccccaccctcacaaccacttgcagggagccccccgcccacacggccactcgcaggagccccccacccacgcggccactcgcaggagcccccaccc

SEQ ID NO: 88018 - DNA, 19 bp, Homo sapiens
  chr20:59599221-59599240
  hypo
cactcgcagggagcccccc

SEQ ID NO: 88019 - DNA, 43 bp, Homo sapiens
  chr20:59640929-59640972
  hypo
gcgccctcaaggcctcgtggggcaatggcgggattgtgctgag

SEQ ID NO: 88020 - DNA, 164 bp, Homo sapiens
  chr20:59643279-59643443
  hypo
gggtcctgggacctgcgtccgttcccctcacatgccctgaggctcactcctgccccgtccctgtccctctagagggggcttctggtgacccctttccaaggacacatggcctccctccctgagacccttaccgaatggagagcctgcaccgctggtgtcagagg

SEQ ID NO: 88021 - DNA, 185 bp, Homo sapiens; identical to SEQ ID NO: 46274
  chr20:59708146-59708331
  hypo

SEQ ID NO: 88022 - DNA, 30 bp, Homo sapiens
  chr20:59715030-59715060
  hypo
cggcggcaattgagacgaggaggatctttt

SEQ ID NO: 88023 - DNA, 215 bp, Homo sapiens
  chr20:59801639-59801854
  hypo
gtgctatggccataccgggaatataccccactcattgtttcttaagaggagcatcttgcagaagctgtgcaccatgacgctcatttttacaaagccggagacaggaaacacaaccaagcacatttgagtgactgtgtccagaggcagtatgctctgtcctcctgtctccatagccccacctgttactaaaagttcccttgcggtcactggcgtga

SEQ ID NO: 88024 - DNA, 131 bp, Homo sapiens
  chr20:59804316-59804447
  hyper
gaaaccccctgcaggcgcggctgcacctcaagcccggcggggcgaggacgctgagctgcagacagcgccacctagcgtccgagagccacggcgcaccggctgtgcgcatctctgggcgagactggaatgga

SEQ ID NO: 88025 - DNA, 94 bp, Homo sapiens; identical to SEQ ID NO: 46275
  chr20:59821803-59821897
  hypo

SEQ ID NO: 88026 - DNA, 101 bp, Homo sapiens; identical to SEQ ID NO: 38242
  chr20:59826877-59826978
  hyper

SEQ ID NO: 88027 - DNA, 68 bp, Homo sapiens; identical to SEQ ID NO: 4843
  chr20:59828340-59828408
  hyper

SEQ ID NO: 88028 - DNA, 98 bp, Homo sapiens
  chr20:59828962-59829060
  hyper
ggggagccaagcaccgctgtgctcctgctccttcagcggggctggcttcccgcttgcacacactgcctctccctccaccacctcctcctgcctgtcac

SEQ ID NO: 88029 - DNA, 152 bp, Homo sapiens
  chr20:59829061-59829213
  hyper
ccccctcccagaagcttggtcggagggccctgtcgtccaccccatccttccctggccctgtgccatgggctctagacttccccactgagcaggaaaggcgagcgagctccggaggacaggaggagaccccctttccggtcagttaggggagc

SEQ ID NO: 88030 - DNA, 30 bp, Homo sapiens; identical to SEQ ID NO: 46276
  chr20:59855416-59855446
  hypo

SEQ ID NO: 88031 - DNA, 182 bp, Homo sapiens
  chr20:59874095-59874277
  hypo
tccagaacctgtgcgcgtgatcatatctggaaaaaaaatggggggtctttgtagatggaatcaagttaagagacagtcagagtggatcagggtgggccctaaatccaaagacccgtgctcttataagaaaagaagaggaaaccgaatccagtgttagacagaggccccggggagaacctcgc

SEQ ID NO: 88032 - DNA, 202 bp, Homo sapiens
  chr20:59880558-59880760
  hypo
agcctgaggtcctcacgacattccaagtccctggaccaattcctaagttattaaaaataaaactcccttgattcttttcaattctcttgacctcggttcacgaacctctctcttccccttggtctcagagcttcccagggctttggtggccatgagtttgtgcatttccagatgtcatccagctcaccgctcacgtgcacct

SEQ ID NO: 88033 - DNA, 88 bp, Homo sapiens
  chr20:59892038-59892126
  hypo
gtgataagtcttgcacgtaacctgctatttctttttttttttttagtttatttatatacttattatttttattactatttagaaatct

SEQ ID NO: 88034 - DNA, 180 bp, Homo sapiens
  chr20:59910173-59910353
  hypo
ggcaagaggaggtctcgcggccattgacaaatgtcaatatattgatattgatgccttccttcttggcccagccgatctgggatgaatgtgcaggggccaagccagcagtcgtccctgtgttcaacataacaggtaaagctgccgtgtatttggtccaacggagatcgaaggtcattatat

SEQ ID NO: 88035 - DNA, 30 bp, Homo sapiens
  chr20:59960789-59960819
  hypo
tgccttttccaccaacgggaatcaccatct

SEQ ID NO: 88036 - DNA, 30 bp, Homo sapiens
  chr20:59967348-59967378
  hypo
gttttgctgtcaggacgcagcctccctgga

SEQ ID NO: 88037 - DNA, 50 bp, Homo sapiens
  chr20:59967982-59968032
  hypo
tgcagatactcaccccgatacccaccaagggcagccgagcctcctgcttg

SEQ ID NO: 88038 - DNA, 176 bp, Homo sapiens
  chr20:59971512-59971688
  hypo
tcaaattgcgttctgcgcatagaccacctggggtgctgccccctcacagcacaggttcctgccctcacctggccatggaactactgagtaacctgtttccctgagcatctctgtgcctaggactggccacggggagcatcctgagaccagcagacctggcccggcttccttggcct

SEQ ID NO: 88039 - DNA, 30 bp, Homo sapiens
  chr20:59972407-59972437
  hypo
gtggtggccaggtcccgaattcatgttgtg

SEQ ID NO: 88040 - DNA, 70 bp, Homo sapiens; identical to SEQ ID NO: 46279
  chr20:59973035-59973105
  hypo

SEQ ID NO: 88041 - DNA, 138 bp, Homo sapiens
  chr20:59981017-59981155
  hypo
gagccaccgcgcccggcctataatttctataattgatgaacttaatcacgtgagttcctctatagatcataactgtcacttgtcccataaacccagccccttggtgtggatcaaaatcttccacgtctttattgggag

SEQ ID NO: 88042 - DNA, 104 bp, Homo sapiens
  chr20:60000590-60000694
  hypo
agtgggcagggcagacgctgctgtgattatccgtgagataaggcacagagcacatcccgcaggaggggcagagcccagggaaaacagggcggcagcgcacagaa

SEQ ID NO: 88043 - DNA, 145 bp, Homo sapiens
  chr20:60029813-60029958
  hypo
taggcaggggagcagtgtatatggtagcctgcaggtcagaggtctgtggcaaacgcaggagcctgtacctggtgttcgttttccccactacggggggcagtggtgcaggagtggtttgaagggtgggttccgtgaccagggtagg

SEQ ID NO: 88044 - DNA, 61 bp, Homo sapiens
  chr20:60055460-60055521
  hypo
acacagtccctgccacgccatctctgggaagcctcctttccctcttcgtccaggttttatc

SEQ ID NO: 88045 - DNA, 176 bp, Homo sapiens
  chr20:60093092-60093268
  hypo
tgatcccttttcaggcgctattttccccatgcagataaggccctcagttttctaaagaatttgcaagaaatcatgacgctactgcaagggtttagtgctcattcttcactcactgtgtctgggacactaggtgggtgtttattctgccatcatccctttatcgaacaccaccagtt

SEQ ID NO: 88046 - DNA, 46 bp, Homo sapiens
  chr20:60098210-60098256
  hypo
acagaggtgggaaggcggctccatgccagaacggtgcctcagtttc

SEQ ID NO: 88047 - DNA, 30 bp, Homo sapiens
  chr20:60108382-60108412
  hypo
actgcccgccaactccgagcctgcaggggc

SEQ ID NO: 88048 - DNA, 30 bp, Homo sapiens
  chr20:60114113-60114143
  hypo
acagcagatccgcagcgggtcaggtggagg

SEQ ID NO: 88049 - DNA, 78 bp, Homo sapiens
  chr20:60119581-60119659
  hypo
ccatgcaatggcagccgccaagcagagacggtgacgggatccctgcgttgacggtggcatgaccgtgtgtgatgggat

SEQ ID NO: 88050 - DNA, 180 bp, Homo sapiens
  chr20:60120703-60120883
  hypo
agccgtcaagagaaccggaggctttggcaactggtgccgctcatgcttggcgccagcgggcaggaggcagctttgtcctgcacaccgagacagtgtgcttgtgtatgtgagtgtgtgggggtggggtgtgtgtgcatgtgtttggggggtatgtgggatacggtgcgtgttcacatgtgt

SEQ ID NO: 88051 - DNA, 30 bp, Homo sapiens; identical to SEQ ID NO: 46281
  chr20:60121193-60121223
  hypo

SEQ ID NO: 88052 - DNA, 30 bp, Homo sapiens; identical to SEQ ID NO: 46282
  chr20:60122026-60122056
  hypo

SEQ ID NO: 88053 - DNA, 30 bp, Homo sapiens
  chr20:60146355-60146385
  hypo
aggcacactcaggtgcgtggctgatgttgg

SEQ ID NO: 88054 - DNA, 30 bp, Homo sapiens
  chr20:60154658-60154688
  hypo
agtctacccttttagcgattccagccccag

SEQ ID NO: 88055 - DNA, 30 bp, Homo sapiens
  chr20:60155641-60155671
  hypo
agctgccttgctgtgcgctgaaggcagccc

SEQ ID NO: 88056 - DNA, 210 bp, Homo sapiens
  chr20:60162590-60162800
  hypo
ggcagggttccaggccgagcgcggggaggttagggcccagggacaaaatgattccattttgactccgctccttccccagctgaccccataaccagctggggcaccacgtcttccacagcgattgtgtttctgtggcctccaaagggaccctggctgtagggtaactcaaaggcggacggccttacagtcacccaccgtgttctcagcacc

SEQ ID NO: 88057 - DNA, 188 bp, Homo sapiens
  chr20:60170770-60170958
  hypo
cgtctgtctaagcagcgtggtgtgttgttggtacactgcagagctgggccactggatgaatttgtggactacattttgggagcacgtgggtgggaaagatgaactatcagggaccaggctccagtgctgacctgaggcagccatgagcacagtgggggtgaatgattcccgcacggcttcccataaaa

SEQ ID NO: 88058 - DNA, 30 bp, Homo sapiens; identical to SEQ ID NO: 46284
  chr20:60174306-60174336
  hypo

SEQ ID NO: 88059 - DNA, 173 bp, Homo sapiens
  chr20:60175455-60175628
  hypo
cctggcagggtccttcggggtcctggctctggggccttgagggagtcactctagtggctgagcctgagccatctctgcaacgggagccatagtggtgctcaggtggcgggacagcggtgagaatctaattcagaaatgaatgcccgcaactcaccctgcgcagtgcctcagcc

SEQ ID NO: 88060 - DNA, 192 bp, Homo sapiens
  chr20:60176588-60176780
  hypo
cggccctgctcttcccggggcctgttcagatgcccgcccgctgcccaccatgcaccctctgccctcctgtgtgtgtgcccacctctcccacaatgctgcagagtccaggggagggaaggcagagactgggccctgtctggcctttccctggtctcagttgagttgcacctggcggggcgcatgcagcccatt

SEQ ID NO: 88061 - DNA, 30 bp, Homo sapiens
  chr20:60194960-60194990
  hypo
agcgccaggcacatccgagccaagcacagc

SEQ ID NO: 88062 - DNA, 42 bp, Homo sapiens
  chr20:60202364-60202406
  hypo
tgccagcctgcctgccggcttcaggcccgtgggacagcaggg

SEQ ID NO: 88063 - DNA, 30 bp, Homo sapiens; identical to SEQ ID NO: 16635
  chr20:60202615-60202645
  hypo

SEQ ID NO: 88064 - DNA, 160 bp, Homo sapiens
  chr20:60210054-60210214
  hypo
cattctatgtagaggcggcactttgctttcgtgcccgtctgcccgtggacactgggttggttgcagccacattttggtgatgtgaacggtgctgctgtgagcgtggggtgcagacctctcttcgggtcctgcttcctgttccttacgatgtctgctgaga

SEQ ID NO: 88065 - DNA, 174 bp, Homo sapiens
  chr20:60225024-60225198
  hypo
cgggccttctgcctgcgccggagccctgagtctccccaggttgtgccagcagctccactctcctgggcacatttcctaaatgggcagtcagcggctatcccagtcttacctgcctctccttcttgcctcttccagtgtattctcctccatgccgctgcccggcccatcaatatt

SEQ ID NO: 88066 - DNA, 182 bp, Homo sapiens; identical to SEQ ID NO: 46291
  chr20:60227182-60227364
  hypo

SEQ ID NO: 88067 - DNA, 54 bp, Homo sapiens
  chr20:6022905-6022959
  hypo
caaccagttagaagacgtctggcttcagggacacttctgcgcagagctttgaat

SEQ ID NO: 88068 - DNA, 378 bp, Homo sapiens
  chr20:60235329-60235707
  hypo
cacttacaacagaaacgcccgcaaggcatctgttctcttcttatcaaacaaagagtgtttaataactataattaattcactttggtgctcctatgaatcagacatattagacagaagtcagtgaatgttagcagtaaaatgcctcgaagtgttcatcatcgaaggcaggtgacgccgggactcgcttgcacctcactcttggttctgctttcccccaagtcctgcgtgtatccattttcaaacatcagccgtggcaagtctgttacatgtgggtgcgcctgactgtttgaatatggattgtgtttgcagctcaggaggcagaggggtggacggggcggtcgttcccggcaggacctgtgggttcgtggatgtcactga

SEQ ID NO: 88069 - DNA, 158 bp, Homo sapiens; identical to SEQ ID NO: 46293
  chr20:60237356-60237514
  hypo

SEQ ID NO: 88070 - DNA, 205 bp, Homo sapiens
  chr20:60238291-60238496
  hypo
cagaggagctttcatcgagggcttggcgcccacgacaaatgagtccacgcaggaaaggagtggcacccgcaggaggcctgtgctgcggagctcctgggagggtgacgctggggcaggggctgctgcggacaagcgttgggaggcctctctgaggaggcagtgtttgcgctgaaacctagaaaaagagctgcgtaaaagacaataa

SEQ ID NO: 88071 - DNA, 199 bp, Homo sapiens; identical to SEQ ID NO: 46295
  chr20:60238848-60239047
  hypo

SEQ ID NO: 88072 - DNA, 190 bp, Homo sapiens
  chr20:60243944-60244134
  hypo
ccttccaccagcacccgcctgttctcatcagagcaccgtccgccagcccctctctccagtctgtccttgggacaaccctgggaagccagtgggacaggtgttccaggaggacccctgtccagcgaagctcagggctgcggcaggccggcggcaggtcaggtccttccttcaccctcggggatggtgcctg

SEQ ID NO: 88073 - DNA, 38 bp, Homo sapiens
  chr20:60261634-60261672
  hypo
gcattcatgtgtgtgcatgagcacgtgtgtgcatgtgt

SEQ ID NO: 88074 - DNA, 192 bp, Homo sapiens
  chr20:60272958-60273150
  hypo
gtttcttctcttttgcggagtaagtgcctccctgcagagccagggctgggcagcagaagtcagagatggagccaggagaagagggttctggcctggccggccattccttggctgttttgctcaggctcatcactgagctggcaccatcttgggcctgtctcacactgccacactgcccgagacagcagccat

SEQ ID NO: 88075 - DNA, 474 bp, Homo sapiens
  chr20:60281403-60281877
  hypo
actccaaccaccacccgaggcaccgacaactgacagaaaactgcagccggcctcatttgccgcagacccccttctctcaacaataacatgtggggcacggtcttaacaaacatgatgagagaaaaggctgtagccaaaggcagctgttcaggaacggagaaagtttagctacgacgaagactccggggaggaagaacggatggaaaggccagcccaaatggaagttggagtttgctgagctgaggacagggcctgtgggatctgctggaagagaggcgaaccaagaccaaagggatcggtttctcccgagctgcacacagtggcaccgactccctgatccccgatgtgtagaaaccaccttggctgaattctcccgagcccgctgcaggccagtgggaacagtggttgggaatctcaccggaactggctcgggcaggacgttcatggtgaggttccaaccggaatgagtcatgt

SEQ ID NO: 88076 - DNA, 52 bp, Homo sapiens
  chr20:60299388-60299440
  hypo
ctgtgttgtaggtaccgcagttcagaaccccgtgtcccgccaagactcccca

SEQ ID NO: 88077 - DNA, 183 bp, Homo sapiens; identical to SEQ ID NO: 46299
  chr20:60304145-60304328
  hypo

SEQ ID NO: 88078 - DNA, 30 bp, Homo sapiens
  chr20:60306675-60306705
  hypo
ccgtttccagcgggacgcctcctgccaagc

SEQ ID NO: 88079 - DNA, 166 bp, Homo sapiens
  chr20:60312484-60312650
  hypo
cgcaaacaccctgcacggctccccatcccaccccagggacccccggcctgactagggcccttgtgtgaccccactgcagcctggagggcttggccatccatgctgtcatcacctggccactgaccaccctggcctcagcctgtgcggttcccggcagaccccggtg

SEQ ID NO: 88080 - DNA, 520 bp, Homo sapiens
  chr20:6032685-6033205
  hyper
acccgggtcacccctcgaggaagaacgcagccctgccccccggagcgcacgcgcagcctggctctgcgctcaggccggctgaaaacgcggggcgcccggactcaccccgttcaaggaacgtgccgctgagatccaggacttcgagcgtgaccaggggcgcgccatcctctccagcgaacgccgcctcggcgatgcccccctgggctccgcgacccagcgcggtgcaggagaggttgaggagctgcagcgcggggaagcaggcgaaggcccggggctgcagcgcccgcagcggattcccggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtc

SEQ ID NO: 88081 - DNA, 77 bp, Homo sapiens
  chr20:60329584-60329661
  hypo
aggagggatgaggaacgggtgccattccaagggcagcagcacacaacaggtgcaggcacactgcccggaacaccaca

SEQ ID NO: 88082 - DNA, 279 bp, Homo sapiens
  chr20:6033206-6033485
  hyper
aggctgcgcagtgtgcgcggtaggcagccgggcaggcgctccaggttgcggttcgccagggtcaaggccgtcgcatccgcggcgggcagcccctcgcagggcgagtcggtggcgttgctgccactgctcccccaggggccctgctgagtgacccggaagagcgggaccttctcctggggagggtctgcccagctggggcgcagcaccgtcagcagcagcagcggtagggtttgccgcatggcgtctggggagagaacagcaggacgcccatcaaatcca

SEQ ID NO: 88083 - DNA, 30 bp, Homo sapiens
  chr20:60334621-60334651
  hypo
tgcacaaaatatgaacgatttcattcagtt

SEQ ID NO: 88084 - DNA, 25 bp, Homo sapiens
  chr20:60352677-60352702
  hypo
gcatacaaaaacacacgtctacaca

SEQ ID NO: 88085 - DNA, 56 bp, Homo sapiens; identical to SEQ ID NO: 46301
  chr20:60355322-60355378
  hypo

SEQ ID NO: 88086 - DNA, 130 bp, Homo sapiens; identical to SEQ ID NO: 46302
  chr20:60359749-60359879
  hypo

SEQ ID NO: 88087 - DNA, 30 bp, Homo sapiens
  chr20:60373650-60373680
  hypo
ggacaaatgccacctcggccaggccccttg

SEQ ID NO: 88088 - DNA, 468 bp, Homo sapiens
  chr20:60374909-60375377
  hypo
agcctcataacaccacggtccctgcggggcctcgagtggggcctctgcagtggctctgccccgctccccatctctcatgcaacctccctgagagcccagggccatctccgcttgtcttcatggcccgtcccttcccatgacccgctcggctgcagcggccctcggtgggcacagtcaccgggccggcttccccgcctgtgcttcctctgaggggttccccagcccacagcatggtccagggccgggtggggccagcatcctctactccctccttgaagcctgtgcagggctgcatcttctttgtgtgcaagcaagcgagcggcctgcagccccaagggccctttgtgagtgctgcaaagccccgaagaccagaccgcactccctcgagtgcacacacggtgcttctgggaagctgcccggccgccaggggggcagagctcctcgccccatgaccgggcaggggcagtt

SEQ ID NO: 88089 - DNA, 30 bp, Homo sapiens
  chr20:60377972-60378002
  hypo
ctggaggggcttctccgaattctgtttatc

SEQ ID NO: 88090 - DNA, 30 bp, Homo sapiens
  chr20:60382783-60382813
  hypo
tcggaaaatgcctggcgccagtaggaggcc

SEQ ID NO: 88091 - DNA, 181 bp, Homo sapiens
  chr20:60385207-60385388
  hypo
gacctgttctcaagacggagacagagatgggtgagggaggccgggccagccacactaacatcccactggcagaccccgggaaaggccatggccacccacatggatgtgtgggtatggccacatgtggctatccaccgggccagtcggggcggctgtgccaggctgtcgtcccccccatgag

SEQ ID NO: 88092 - DNA, 30 bp, Homo sapiens
  chr20:60394427-60394457
  hypo
tcgctcgctctgccccgggagcgttccatg

SEQ ID NO: 88093 - DNA, 463 bp, Homo sapiens
  chr20:60415711-60416174
  hypo
tgtgctccctattcacggcccatcgtgggcttctgcggtgtttgtctcatttgccagacacaaatcaagtggaaaactgttctcccctgatctggtggattcactcgcacagtatttcttcttaatatggtaaactgtgggagaattcagagcattttgagagctgatgctcagagcccgtggatgcacatcacccgcagccacccgctgcccgccatatttcagaggcggccaaacgggcctggagaataagcaaatgcggcctgatggccaaaacgtaatgagctttccttgaaaaacaaattctctttaaataggtggtggattattttcagcagtctcctcattaaatttccctatgaaagagggattgattcgcccaaaactagcaatagcgcacagtgaatctacaacccatccttccggctgctgcagaccccgtccctggcgcccacctcctgcc

SEQ ID NO: 88094 - DNA, 72 bp, Homo sapiens; identical to SEQ ID NO: 46306
  chr20:60428149-60428221
  hypo

SEQ ID NO: 88095 - DNA, 30 bp, Homo sapiens
  chr20:60433992-60434022
  hypo
attgtggggtcatctcgggagcaggcgttt

SEQ ID NO: 88096 - DNA, 30 bp, Homo sapiens
  chr20:60434822-60434852
  hypo
atgaccgtagcctcacggccagcttcgctg

SEQ ID NO: 88097 - DNA, 30 bp, Homo sapiens
  chr20:60436260-60436290
  hypo
cctagtgaggttccacgtgggaaggacaca

SEQ ID NO: 88098 - DNA, 249 bp, Homo sapiens
  chr20:60439571-60439820
  hypo
aagccacagagaccacgtctgctgatcccaggatcctggagcggccactgtggctcagggactccagacacaaggggccgtggatccagtgaggtcagaggcaccgcagctccctctccaggacacactcactcaactcccagagccaagcccttgccagcgcggacggcgcccatgagaggaccgagggggaggtggccccagcttcccgggcagacccttatgagacaaacccgattatctccaccc

SEQ ID NO: 88099 - DNA, 77 bp, Homo sapiens
  chr20:60447432-60447509
  hypo
gaggagagggaagaacgttccagatgcagaacagattgtgcaagatcccaaggctggtgtggcgagagtccttcatc

SEQ ID NO: 88100 - DNA, 297 bp, Homo sapiens
  chr20:60448654-60448951
  hypo
agaggaagggggttccgctacgccagactcacggagagctctgtggtcggggggctctgcccaggtgtgtgcgggggtggcagcctgtgtggcaggccatccccatctgagctgctgtctccgttccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggacc

SEQ ID NO: 88101 - DNA, 134 bp, Homo sapiens
  chr20:60449362-60449496
  hypo
ccacccaggctgcggcggcctggctgtgacgaagggggcatggagaagcagtgcttttcacacagcctgaaaccatcacagccaaatgaatgggctgctggttggtgctgggttccatgcgctcccacctcctg

SEQ ID NO: 88102 - DNA, 168 bp, Homo sapiens
  chr20:60452936-60453104
  hypo
tccattgtgtgacaacgcgtctttggctgggaggacccccaggcaggggatgaggtgtaacccaaatgaggcccggccccaagcagactgtgacagggtcatcaccaggaaccacgggggccccagagggaggacttcgtggacacagacgggcgtggtcatcccaga

SEQ ID NO: 88103 - DNA, 183 bp, Homo sapiens
  chr20:60453914-60454097
  hypo
tcggcgggggtgtgccgaggccagggcgcccctcgccagggctctgctttcagtgtgggtctgtgcttaatgttcagagctgccctgctcttccttcgcccacctcctggggaaattgaatgatggtttataattataaccgcttctgcagcagaggatgcacgttgtcggattttcagcagc

SEQ ID NO: 88104 - DNA, 201 bp, Homo sapiens
  chr20:60454704-60454905
  hypo
atcctattcatctggcgttgtttcctaattagaatatttatggcctaatgaggaggtgaacgtgccgcccgagccccgtcctgaaggtgagagtgggctctgcagacgcaggcgctgttccgattgttgggcagtgaaattagcaccgggccagcattgttctcagcgtcccttccaggctgctcccgaggatgttgattt

SEQ ID NO: 88105 - DNA, 202 bp, Homo sapiens
  chr20:60457120-60457322
  hypo
gagccggaccctgcccgcgcctccacctcgaacctctggccttccggactgctgtctttaagccacctcatttgaccagaccctgacaggaagcagccagacccagtcccttttgccgagaagcctgtgtctggctttgtgctgaggctttattggcacacagcgtggctgaccatttgcacgtgggcggtgccacgctcca

SEQ ID NO: 88106 - DNA, 193 bp, Homo sapiens
  chr20:60460819-60461012
  hypo
cacattctcaggctccggacagaccccaggtgctgtgcagcctgaggatgagacggagagcaggacccagatctctgtctgctccatctcgcagcttccaaggggatggaggttccagcagtgacagcagggaaggcccttggggagtgtgtggtccaggaggaagcagtgggaacagcgctgacctgagagg

SEQ ID NO: 88107 - DNA, 71 bp, Homo sapiens
  chr20:60470186-60470257
  hypo
tgcggctctgcctgacgggcacttggcagatagcgtgtaagaaaggccctgggcagcggaggctgctgtgt

SEQ ID NO: 88108 - DNA, 30 bp, Homo sapiens
  chr20:60473115-60473145
  hypo
gtgtcagtaaatactcggggttaggatggc

SEQ ID NO: 88109 - DNA, 89 bp, Homo sapiens
  chr20:60476718-60476807
  hypo
agaagcagcacccaacgccgggtggctgggaacgtcaaggcctcattaggaccagccggacgcttctgagtaagcggcagctcagtgaa

SEQ ID NO: 88110 - DNA, 273 bp, Homo sapiens
  chr20:60477306-60477579
  hypo
cagaaaaggtcaagccggggcctctgaaaccaggacccccggggcctccattccaggagaagcagcctcactctgcccttcaccagccacggagacccggggtctatgggcagtgccctaaatgccagccatgccctggggcacgcggtcaccaccccgcagaaccgctcccgtgctcgttgcaggagtgcaagggcagatccacagaggagcgtgcggggccccaccttcccagggatttgcaggcaaatgagcggccgttgacacagggac

SEQ ID NO: 88111 - DNA, 388 bp, Homo sapiens
  chr20:60485016-60485404
  hypo
tggctgcagggctgacgcacctgccgggcaggtctgcacgcctgcttcagtggggccccggcagccgtgctatgaggcgtgcactcccgtgcacccctgagcagcctgtcttctctgattcctgatctgggcgtggctgacacggtgtgttctgtttgtgaacactcgttgagctgggctgacacggtgtgctctgtttgtgaacactccttgagctgggctgacatggtgtgttctgtttgtgaacactccttgagctgggccgacacgttgtgttctgtttgtgaacactcgttgagctgggctgacacggtgtgttctgtttgtgaacactcgagctgggctgacacggtgtgttctgtttgtgaacactcgttgagctgcacat

SEQ ID NO: 88112 - DNA, 44 bp, Homo sapiens
  chr20:60489317-60489361
  hypo
ttcacacacctaccccggcttctgtgaaacgtggatccactgag

SEQ ID NO: 88113 - DNA, 38 bp, Homo sapiens
  chr20:60492770-60492808
  hypo
gaagggtcatggccacgtgtgggcggcagccatgctga

SEQ ID NO: 88114 - DNA, 30 bp, Homo sapiens
  chr20:60493093-60493123
  hypo
ccacatgagtggccccgtcccagccagctg

SEQ ID NO: 88115 - DNA, 49 bp, Homo sapiens
  chr20:60495112-60495161
  hypo
gtgattgtgtggaagcgtggtgtcacggtgattgcgtggaagcatgttg

SEQ ID NO: 88116 - DNA, 35 bp, Homo sapiens
  chr20:60495405-60495440
  hypo
gtgattgcatggaagcgtgtcgtgattggaagcgt

SEQ ID NO: 88117 - DNA, 30 bp, Homo sapiens
  chr20:60497438-60497468
  hypo
gaaccgtagctctagcgtttatcagccagg

SEQ ID NO: 88118 - DNA, 112 bp, Homo sapiens
  chr20:60498996-60499108
  hypo
tgtctagacacaggccggcccgatcctggccacactctcatagctataagactcagcaacctcctgccctctctgctcctcagcgtccttgtccgttcgatggggacaatga

SEQ ID NO: 88119 - DNA, 111 bp, Homo sapiens; identical to SEQ ID NO: 46318
  chr20:60502200-60502311
  hypo

SEQ ID NO: 88120 - DNA, 474 bp, Homo sapiens
  chr20:60502586-60503060
  hypo
gcagcagttcttccacgcgatcatgcgtctgggctcagggcttccagcaccctggggctctgctgggcagggccagcaaaactcagggaggcaaggaaaggttttgccctaagaagtcccagatgggggcaagatgtggtgggcggatcccagccctcaggggccagtgcagagcccagcacccgcagaacccctccctggctccccagtgggagtgagtccccggtgcgtggctgtgacctccgtggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatggcgtgtggcagggtgtcggtcaggagccatg

SEQ ID NO: 88121 - DNA, 124 bp, Homo sapiens
  chr20:60508103-60508227
  hypo
gctgctcattgaccccgaggacgacgtccgcgacaacatcctcaagtatgacgaggaaggcggtggcgaggaggaccaggtgagactgcggcccgcccccgcctccccacgcgaggccggctct

SEQ ID NO: 88122 - DNA, 82 bp, Homo sapiens
  chr20:60509238-60509320
  hypo
ggtgccgcacccaggcgacatcggtgacttcatcaatgaggtgtgtgcctctcggcagtggggggcccgggcaaggtgtctc

SEQ ID NO: 88123 - DNA, 194 bp, Homo sapiens
  chr20:60515808-60516002
  hypo
ctgtgcagctcaaggcgctgtcctaggctgcgggaaaacagaaagaacaaagccaggcccgctcctcacacctgtgggcccacatgccatctgtctcaatgttttaaagggtttagaaggtatccatgaaactaacaagcaaaatcacattcccctcctaccttggcatatacacctcccggactccatggaat

SEQ ID NO: 88124 - DNA, 101 bp, Homo sapiens
  chr20:60541029-60541130
  hyper
cccgcagggcagctgcgtgttttgtgttcctgtctctgcggccaggtgggggcgagtgcgctgaggtcaaccctcggccacccgggcgctgggtggtgctg

SEQ ID NO: 88125 - DNA, 36 bp, Homo sapiens
  chr20:60543265-60543301
  hypo
gcgggctcctgctgtcgcaagcgttccactgcgggg

SEQ ID NO: 88126 - DNA, 53 bp, Homo sapiens
  chr20:60545005-60545058
  hypo
gaacactcggccccccgtcggggcactcggcccaccatcggggccattacatg

SEQ ID NO: 88127 - DNA, 30 bp, Homo sapiens
  chr20:60545266-60545296
  hypo
cctggcgccccttcccgacagtctcctcac

SEQ ID NO: 88128 - DNA, 272 bp, Homo sapiens
  chr20:60552065-60552337
  hypo
acacctgcatgacaccgcccagcagggcacgcgccacacacacgacaccgcccagcggggcacacgccacacacacgacaccgcccagcggggcacgcgccacacacacgacaccgcccagcggggcacgcgccacacacacgacaccgcccagcggggcacgagccacacacacgacaccgcccagcggggcgcgcgccacacacacacaacaccgcccagcggggcgcgcaccacacacacacgacaccgcccagcggggcacgtgccac

SEQ ID NO: 88129 - DNA, 45 bp, Homo sapiens
  chr20:60559225-60559270
  hypo
tccacccgctcatcacgtgcctcagccctacgcacccacagcaca

SEQ ID NO: 88130 - DNA, 114 bp, Homo sapiens
  chr20:60578759-60578873
  hypo
gcggccaggggcccgcgaggccctcacctggctgcagtgggttcagctggatctgctgaggcgtggtgagcatgatccggttgtgaggctgccgcagggcgaccatgggtgtct

SEQ ID NO: 88131 - DNA, 48 bp, Homo sapiens
  chr20:60587262-60587310
  hypo
gacgagggatgtgagcggcaggtggcagcgtggcgtggcaggcaccgt

SEQ ID NO: 88132 - DNA, 39 bp, Homo sapiens
  chr20:60616133-60616172
  hypo
caactggggtttcagcgacctgagcgctccaaaggacag

SEQ ID NO: 88133 - DNA, 30 bp, Homo sapiens
  chr20:60620307-60620337
  hypo
atgcaccctccccaccggccacacaaggtc

SEQ ID NO: 88134 - DNA, 45 bp, Homo sapiens
  chr20:60624858-60624903
  hypo
cagttcatagaaatgcgagcctcagtgtctcgtccctaggcaggt

SEQ ID NO: 88135 - DNA, 30 bp, Homo sapiens
  chr20:60635093-60635123
  hypo
ctgttctgctgagcccggtctgtgctgctc

SEQ ID NO: 88136 - DNA, 30 bp, Homo sapiens
  chr20:60639275-60639305
  hypo
ggacgtcagggacagcgacagggacgcagg

SEQ ID NO: 88137 - DNA, 130 bp, Homo sapiens
  chr20:60662678-60662808
  hypo
acactcacctgcacacgcactcacacatgctcctatacgctcacctgcacacgcacacgctcctgtacacccacctgcacacgcactcacacgcactcctgtacactcacctgcacgcttacccacacat

SEQ ID NO: 88138 - DNA, 32 bp, Homo sapiens
  chr20:60731152-60731184
  hypo
tggccagtgcacacccgcggggctctgcctaa

SEQ ID NO: 88139 - DNA, 39 bp, Homo sapiens
  chr20:60756179-60756218
  hypo
ccctctcctaggagacggatgtcacgcacaaatggggag

SEQ ID NO: 88140 - DNA, 22 bp, Homo sapiens
  chr20:60759136-60759158
  hypo
gggcgcggtggctcacgcctgt

SEQ ID NO: 88141 - DNA, 47 bp, Homo sapiens
  chr20:60766706-60766753
  hypo
ctcccgctctggccccgtgttgagttttcagccgtccactggggccc

SEQ ID NO: 88142 - DNA, 835 bp, Homo sapiens
  chr20:60772977-60773812
  hypo
gagtaaaaactgcttcgggcgcagtggcgccgtcctctacatccgggtgagccgagactgccggacctggccctgtccccgttgttctggatcatccagctcctgggggccaccgtgtgacccacggggcccctgtggcttgatgcccacagctaggaaacagcacaatggaaacggaggctggcagacagcgggaaagcagccccacccctcaaagcaaacccagacgggcatttgtaccagggtctcacaccatgtgcatgtctagtgaaaaagtcatgaaacgattctcttttaaaaagagggagcccacggcacggacgcttcctccgtctctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcagaggtgagtggggcgggcagctgcccggggcacagtccgctcttgtcttctttccttagcgcttgcttcaggaatgggttaaggcctcctttcctcactgctggtagagctcagctgatgagtgcctgctgttccccaggtccccgtgggcacgctggtgaaggagggaggcagagttgtggccgacctgtcttgcgtgggagatgagtacattgccgcgctgggcggggcaggagggaaaggcaaccgcttcttcctggcc

SEQ ID NO: 88143 - DNA, 278 bp, Homo sapiens
  chr20:60781289-60781567
  hypo
ggtcggcgctggccccgggatggaggcctgaagggcagacatgctgaggcaaccggagcgtctcatcagtgaacacacgtgccggggacctgtcctggtgccgctaaagaggctgcagagccgcggggtgcggcagtgcttggcgggggcggggtgcagctctgcgtgcatggcgtccacctggggaccgcaggtgtcaagccggggagagccagtgccaggaggtcacacacgatggttccctctacagagtgttccagaaacgatgaggagaatgg

SEQ ID NO: 88144 - DNA, 285 bp, Homo sapiens
  chr20:60789915-60790200
  hypo
gagccctcatcctcacgcctgcttctcagtggtttctggactccctggagtctctcctcaaagcacgaaggctctgagcaccccacaaagtcctcaggaatcagcaccaataaaaaaatacactttattgtgacctcacggtttgcagggcagcgcagcgggcacaggcagaggagcatgcagagcgcgtggcacgggtgcacagcacatggcgaagcggcccctgcccgggcacctcctctggaccgcccctgcacgccttgggaccctcgggcccagccgggc

SEQ ID NO: 88145 - DNA, 345 bp, Homo sapiens
  chr20:60794701-60795046
  hyper
ccgtgttccagtccccgctggcccggccacgctgggcgcccctgggtccccagcggccaggggctggggatttaccgacgaggaagtcggagatggcgaggttgagcaggaagaagttgttctgggtgcggaggctcgagtcggccacgaaggcgagcatgaccagcgcgttgcccagcaccgtggccacgatgagcagcgccatgagcgcggccagcaccgcggtccaggctgccgagaagccgcgcgccccgcccgccgccgccgcctcgcccgccagcgcccccgaagcgttcagcggcccgtcgggcggcgcgcgctccatggccccgcaggctcacgcgg

SEQ ID NO: 88146 - DNA, 112 bp, Homo sapiens
  chr20:60795944-60796056
  hyper
taagggaagatgaggcgccgggcggacccagccggaggggagcgcgtctagcctgggctccggcggcctcaggctgaggagggagcagcaagccgctcggagcccagccacg

SEQ ID NO: 88147 - DNA, 47 bp, Homo sapiens
  chr20:60796491-60796538
  hyper
ctgcagaggggaccccgggcgctgacatgcaccgtcactcccctact

SEQ ID NO: 88148 - DNA, 34 bp, Homo sapiens; identical to SEQ ID NO: 46327
  chr20:60803825-60803859
  hypo

SEQ ID NO: 88149 - DNA, 27 bp, Homo sapiens
  chr20:60816241-60816268
  hypo
tttgagatggagtctcgctctgtcgcc

SEQ ID NO: 88150 - DNA, 30 bp, Homo sapiens
  chr20:60816656-60816686
  hypo
tttgcgaaggtggtgcgccagaccagggct

SEQ ID NO: 88151 - DNA, 30 bp, Homo sapiens
  chr20:60856371-60856401
  hypo
agacttgactctgaccggtgttggccatga

SEQ ID NO: 88152 - DNA, 30 bp, Homo sapiens
  chr20:60856862-60856892
  hypo
tgcttcactttaaaccgtgtggattatttg

SEQ ID NO: 88153 - DNA, 30 bp, Homo sapiens
  chr20:60894037-60894067
  hypo
cagccccaggtggcccgtctgggacatgag

SEQ ID NO: 88154 - DNA, 30 bp, Homo sapiens
  chr20:60903333-60903363
  hypo
tgagctcctggatgccgggccctgagcagt

SEQ ID NO: 88155 - DNA, 59 bp, Homo sapiens
  chr20:60905951-60906010
  hypo
gatgatgggctggggcggctttgggaagcgcgagggcagacaggcggcactggtgagag

SEQ ID NO: 88156 - DNA, 40 bp, Homo sapiens
  chr20:60909496-60909536
  hypo
ccatggtgagggacacggagaggcccggaggacaagctgc

SEQ ID NO: 88157 - DNA, 153 bp, Homo sapiens
  chr20:60921151-60921304
  hypo
agcccgtgaagccctcggcacacacgtcacaccgctccccagagaagttgggccggcagtagcatcgacccgtcaggtcctcgcaggtgccatccgtgaagtcggactcgcagttgcagcctgggcaggggcaggagccgggtaagcctggag

SEQ ID NO: 88158 - DNA, 498 bp, Homo sapiens
  chr20:60921525-60922023
  hypo
gagacccaggacacccgcccagctgagcccactcacggcggcagacgtggggcgagtcgagagggtggttgggagagcggtagaagccgggcaggcagcgctcacagttgacgccggtggtgtggtgctgggagtgcaatggccgttgagtctggggaggtccctgccccacctcagggccagcccattcccagccctctagcccagcccacctggcagtcgatacagacacccccaccctgataggtgccatccaggctctggctggcgcggcgccggtccacctcagggtcgtagtaacagtcggtggcatggccgtagcagttacaggctagagagaggggagcgcagctgttggcacgccctccacaggcccgggcaccggggccctctcatgggccagggtgtgggcaggacacacgtgtgtgggaggaggcactcacactggcactcgttggcactgttggcagtcgcaggcttccacggctgctgattgaa

SEQ ID NO: 88159 - DNA, 154 bp, Homo sapiens
  chr20:60922248-60922402
  hypo
cagactcagcgtccccgagcctgtggctctgacgcaacttccccaggctcagggaatggacacaaggaaagaggcggtggaggacagggtctcacagggcctttgtggaggcgggactggggagcaggtgtgcactgaccgggtggggcctagg

SEQ ID NO: 88160 - DNA, 260 bp, Homo sapiens; identical to SEQ ID NO: 46332
  chr20:60925281-60925541
  hypo

SEQ ID NO: 88161 - DNA, 224 bp, Homo sapiens
  chr20:60925825-60926049
  hypo
ctgagtactggtttgcgtgtttcccagctgcctcccccggaacaggtgctcctgaggccgggctggggtcccaccctgtgttcccattcccaggaaaacggcccagcgtgtgttaggcgctcaacatacagctgctggctgaaagaaccaacgaagggagggaggaaaggacggacgtgccctggggttgcttctccgcagaatgagcccggccctaccttact

SEQ ID NO: 88162 - DNA, 37 bp, Homo sapiens
  chr20:60943163-60943200
  hyper
cacgcgttcctgccacgatcggcggctcgaggacgcc

SEQ ID NO: 88163 - DNA, 30 bp, Homo sapiens
  chr20:60952466-60952496
  hypo
gagcatttcagctgtcggtatttctaacct

SEQ ID NO: 88164 - DNA, 527 bp, Homo sapiens
  chr20:60953118-60953645
  hypo
ccccagggcccagggcgacctgtgaccctgcggagccacctgcaggagtcccagcagatgagggcctctggctgcccctcaggggcttgttgggtcccacaagaacttccagggcctcggagctccagccgggccacagagctgggaaccttgagtggctgggaaccctgaggagctgggagagccaggctgagcaagacaagcctgggcgactcacctggggcaggaatgtggattccatcactccgcagaggctttcaagcaaaacacagcctcgtctctgggcctgtttctgccgtgcgggcacgtccagcccgacgctctcagaagcagctgggatgggctcggggaggtgggggtggagcaggagtcccagccgccttcctctggggcccatcccaggctcccggctgggcgccagcagggctccagaaatgagggggcctcacaccgttgcctctggacgtgccgtgcccgaaatcccgccattcccactgggcatgccgggccctcgaatcctccatgac

SEQ ID NO: 88165 - DNA, 180 bp, Homo sapiens
  chr20:60970803-60970983
  hypo
cacaaggagggtgcccggcagggggagctccagaaggaagggagcactctggacctcaggacacctcaggacatgcagtgatgggaatacggggccacaggaacagcccctgcggcctccccgacacagcctctcagggtgcagccggtgccagctgcggccctccgccagctttgggca

SEQ ID NO: 88166 - DNA, 106 bp, Homo sapiens
  chr20:60976672-60976778
  hypo
ccggtcagcaggaggcgggacatgcgcaatcaggggacggcatgcacagcatgctgcaggtgcacacagacgccacacgggttgagaggctcgtcatgtggtgaca

SEQ ID NO: 88167 - DNA, 67 bp, Homo sapiens
  chr20:60983219-60983286
  hypo
atgcagtggtcagtccgcgaatgcgctgcagtacctcgcacctgcccgcatgcgcccagcctctcct

SEQ ID NO: 88168 - DNA, 271 bp, Homo sapiens; identical to SEQ ID NO: 46336
  chr20:60983859-60984130
  hypo

SEQ ID NO: 88169 - DNA, 80 bp, Homo sapiens
  chr20:60984435-60984515
  hypo
cctgctcatgagtttcgctccttattttctttggctctcaccctgaactctgagcaggtgtcaagcgcagggctctgtct

SEQ ID NO: 88170 - DNA, 30 bp, Homo sapiens
  chr20:60986667-60986697
  hypo
ctggggcactaggcacgaggatgctggctc

SEQ ID NO: 88171 - DNA, 103 bp, Homo sapiens
  chr20:60988390-60988493
  hypo
accaccctctctctccgtggggaaaacacctcccagctggactctgaccccaggtgctgactgtacctgggtggccgtccaggtcaggcggctgtgggtgggg

SEQ ID NO: 88172 - DNA, 43 bp, Homo sapiens
  chr20:60992738-60992781
  hypo
cgctcctctgtgatgtctgtcctgtccacgcaacgccccccca

SEQ ID NO: 88173 - DNA, 30 bp, Homo sapiens
  chr20:61013248-61013278
  hypo
gcccgtgaccaccaccggggtgtggagaca

SEQ ID NO: 88174 - DNA, 115 bp, Homo sapiens
  chr20:61020493-61020608
  hypo
tctggcctgagagtccgctgttgggtgccggtctcacctggcagcaggtttctccatggagcagtgagacaggaggtttcctcagcagatcacccagaaacggggctctgccatg

SEQ ID NO: 88175 - DNA, 30 bp, Homo sapiens
  chr20:61021131-61021161
  hypo
tcagctcagcgtgggcggcagaggggcaca

SEQ ID NO: 88176 - DNA, 128 bp, Homo sapiens
  chr20:6103795-6103923
  hyper
agggcaaagggtggccgaagggctgctcggcggagagaaggcggcgagaacccggggcgcacgctcagtatctgcagctcctcttgcgatgtctcatcctgacgctttaaggccgcctccagtttccc

SEQ ID NO: 88177 - DNA, 30 bp, Homo sapiens
  chr20:61270288-61270318
  hypo
agcaggaagcagaagcgcaggaaagccaat

SEQ ID NO: 88178 - DNA, 30 bp, Homo sapiens
  chr20:61279729-61279759
  hypo
gtgggtgccctggggcggggcagccacagg

SEQ ID NO: 88179 - DNA, 55 bp, Homo sapiens
  chr20:61284426-61284481
  hypo
gctcagtgtgcacagcgggtgttagcaccctgccacccagcgggattcttcacag

SEQ ID NO: 88180 - DNA, 575 bp, Homo sapiens
  chr20:61287982-61288557
  hypo
ctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacct

SEQ ID NO: 88181 - DNA, 319 bp, Homo sapiens; identical to SEQ ID NO: 46339
  chr20:61291131-61291450
  hypo

SEQ ID NO: 88182 - DNA, 135 bp, Homo sapiens
  chr20:61291658-61291793
  hypo
ccctggaggtctgcccggaggaggggccagcagcccccagtgtgtgtgccatggagggcacaggtgggctgcacgctgacccaggtgccactgcctcttccacaggacggagctgaccaccgagagcccactgtg

SEQ ID NO: 88183 - DNA, 170 bp, Homo sapiens
  chr20:61292611-61292781
  hypo
ggatcatgatggggacgcagcccctaacctctgtcgtgaccctgggccaagagattaaggagcaacagatagagcctctgggccaggggccgcagaccccgcctcagggctgcagagccgtgggagagtcccagagtggggccggggcctcggcccgcacccagggagcc

SEQ ID NO: 88184 - DNA, 373 bp, Homo sapiens
  chr20:61294499-61294872
  hypo
cctgtgaggctggagcggagtttctgacgccaacatcagctctgcaaggcacctgtgggcctgttggggctcagaggctaactagggctgcaccgtctgttcctgattcttcagaatccatttacatttggccacctcctcaaacaagagcatttgaatgttccaggcattcagagttgcgttcatcggaaccaggctctaggtgtggccgagaggaaagagccgccctcctgcaggtgggggtgatgtgaggccgacagtctgctctggtgagaggctggaaagtgtaggtttacaggatgtcactaagctgcagacgcaggggttcaagtcagcgacactgcggtgtgagcagaggcgacatggacatgtc

SEQ ID NO: 88185 - DNA, 172 bp, Homo sapiens
  chr20:61299541-61299713
  hypo
ctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccac

SEQ ID NO: 88186 - DNA, 427 bp, Homo sapiens
  chr20:61305557-61305984
  hypo
gaggtgttctggtaccggagtgtgggtgttggggcacagctggccgcacctgtcagaggcgtgtggcactgagcatccgtgtggaggtgtccatggggccctcggggagactcatgggagctgtcagcctgcgggctgagctgagattggtcaggggagctcatccgggaaggctgggcagatccaaatggaacccggggacctcaggactgagcaggtggaagaggctgcgtcctcacatcagggaaaggggggaagagcccagggacactgggtggagaagggatgagagggaggcggcacacgcggtctggccaccaagggtggtgcaccctctctgctgccagtggtcaagatggtctctgactcacagatgacgattccaagggtctgagcggccctgtgtgttccccgatgtctcacagtg

SEQ ID NO: 88187 - DNA, 65 bp, Homo sapiens
  chr20:61312710-61312775
  hypo
ctgcttatactcactcgtgtgcgtgtgtattaagccgtgtcacttgtgtgcgtgtttattaagcc

SEQ ID NO: 88188 - DNA, 458 bp, Homo sapiens
  chr20:61314248-61314706
  hypo
gacacagcatgaggacggccagcatcctcgccagtccagggccacacagtggtctctttctgtgctgagctggaggctcgaggccgcggatggaccctgaagctgcgcaggctgtgagggcgccctggtgcttcctctcagtgtcagctctttggggaacacaaaagatgaaccatagggagcgattactcagaaccataatttgcacttagattgattttaatcggcagcacattagaaaggcgcatgtgatcaccgtttaatgactgtgatgtgcgtaatccattttattctcagctggctcctgtggtaattacatttctcttgtgtttaattcataacttgatcatttattccaagtcgtgttgggcttggacctcgggctctcgggagcggccgtgacggagctcagacccagcacttctcctgcagagccagccgctcgctgctggccatgc

SEQ ID NO: 88189 - DNA, 150 bp, Homo sapiens
  chr20:61318633-61318783
  hypo
atgaagttgaccaaacgccacacagccacgggagacacagtggccaccctggggcgtctacactgaaggccaagggcatgtggaggaagagccatctgagccgaggcccggggaggagccagcaggccaaggaggcggaagaaaccacgc

SEQ ID NO: 88190 - DNA, 108 bp, Homo sapiens
  chr20:61319024-61319132
  hypo
gcctaagccacacctcggggtgcacgggctgtggggggccgctcctggacacggaaggacgacaccggcttccctgtacctctgctggggccgcgggtcccatgtcgt

SEQ ID NO: 88191 - DNA, 115 bp, Homo sapiens; identical to SEQ ID NO: 46346
  chr20:61321299-61321414
  hypo

SEQ ID NO: 88192 - DNA, 182 bp, Homo sapiens
  chr20:61329166-61329348
  hypo
gcttctttcctcacccggcaaaggggctgggctgctgcgggatgaatgcctggccagtggtggggacatgtcttacaggcagcacagaacacacctgagaggataaaagctcatgtggtctcagcacctgccgatggagtcggggggtgagagagaataagaacacccgaaaaaatcaggga

SEQ ID NO: 88193 - DNA, 189 bp, Homo sapiens
  chr20:61330920-61331109
  hypo
ggctcccaagtggaccgggaaaggctcccgagtggaccgggacaggctcccgagtggaccgggacaggctccctctctcttgctgctgggatgtctccccgggagcttgcgtctctcgccaccctcacctcccagccagagggaagccaggaagccagggagatgcggcctgaccggcaagggtgccct

SEQ ID NO: 88194 - DNA, 567 bp, Homo sapiens
  chr20:61339542-61340109
  hyper
ttcacagaccaggcacgcccatgactgcggccagattttaaaaggaatcaccagaaatgtaatctccagtggtcctagagccccctgggcacccagcttctggcaccctgtggacacccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagacgcgcagagccgggagggcgcgggcgcggcgggaggtgtgcggggctggggtgcgc

SEQ ID NO: 88195 - DNA, 628 bp, Homo sapiens
  chr20:61340110-61340738
  hyper
gagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacat

SEQ ID NO: 88196 - DNA, 64 bp, Homo sapiens
  chr20:61364412-61364476
  hypo
gtggccctgaggccacgtatccaagcagcagtgccgtgcatattcatgtcggcattggacttgc

SEQ ID NO: 88197 - DNA, 30 bp, Homo sapiens; identical to SEQ ID NO: 46349
  chr20:61368079-61368109
  hypo

SEQ ID NO: 88198 - DNA, 190 bp, Homo sapiens
  chr20:61374409-61374599
  hypo
ctccccagatcagctcggtaggctccaatccagagagtcaggctgggaggggagcacggagccgcccctgctggacacgtatcccggccatctcaggcccacccattgcctcattgctccctgcccccggtccagtcagctgagtgccccgtggtgtgggtgcgtcatgccatggcgaccagccccaaag

SEQ ID NO: 88199 - DNA, 285 bp, Homo sapiens
  chr20:61393765-61394050
  hypo
gtggggtctctggggcggggtctgtggctgtgactgaagtcggcttttcccgttgatgtcttgatgctcctatctgtgcacttaccgtaggtagggacacgtgtccacgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactc

SEQ ID NO: 88200 - DNA, 22 bp, Homo sapiens
  chr20:61411096-61411118
  hypo
agttagaaagctcttcgttgtg

SEQ ID NO: 88201 - DNA, 168 bp, Homo sapiens
  chr20:61412187-61412355
  hypo
gagcccaggtgccaccgagggaatgcaacgtgccacaccccaagacatgacacttgtgagaacagtgtggcccagcccccactccgggcacagcctcggacaccctgcccgcctccgcccatggaggtgcggcctgcaaagcgtacctgccgccgccttcccatccct

SEQ ID NO: 88202 - DNA, 413 bp, Homo sapiens
  chr20:61415908-61416321
  hypo
ccttgcagagggcagcgtatctggcagtggccactcgggtggggccgccttcctcaagctcccaacccagcaaggactcccttgcctcaggctctcccctgcctctctctcagccgcgtgagcacggctctgggcaccgcacctgcacccagcagaactgtgctaaccgggccagatctccaggggccaacacagcctggcctctaggacgggccacgctgcgagggagggaggcaagtgtggggaggccggattccacctgtttggtttttgattagggaatggcagaaacccaggcctcccggggcagggattcagctctcctaacggaggcagccttggtgggggatacttttcagcagggactcttttatcccagagtgtttttgctgtgtgcgcgatgactggctcag

SEQ ID NO: 88203 - DNA, 136 bp, Homo sapiens
  chr20:61424061-61424197
  hypo
cattcattccatccccgtaagggagggaatgggtcagtaggttgtgtagccagtccacaaatggtcactgtccacctgctgtgtgttggccttgcctgagaggtgggggacagtggtgccacgccattcccagccc

SEQ ID NO: 88204 - DNA, 388 bp, Homo sapiens
  chr20:61424743-61425131
  hypo
gcaggcagacagccccggctgggatgagccaagcgtgtgtctccatgtggacccggcccaatgtggggctcagcaccctcgggtctcctggtccgggctcctgtctcacgcttttatgccatcttttctcaataggcacaggggacccccaagggaggaggcgctccagactgaaggaggagagtacctggcagggacgggtggagaggcgcagggaccccaaggtgtccagggaacagtaaggagatgagtaacggtgagggtcccgtctcccgagcgtatctgtgctaaggggctgtgggctgggcttcattcctctttagagcaaggctgaggccagggccacctaggggccagggtagaagacgtaccacgtgacagcagtggc

SEQ ID NO: 88205 - DNA, 93 bp, Homo sapiens
  chr20:61447670-61447763
  hyper
ttcctgcccagggcacggttccttcaggccggggatcccggggaggggttcttcccctcggccagggtcatcgttttgcgatctctcctggga

SEQ ID NO: 88206 - DNA, 680 bp, Homo sapiens
  chr20:61448109-61448789
  hyper
aaggagagaaaagagcgtctttctctcttgctcaaagctgcgtgtgtgcaacgcgccagtcccaggataattttaactcgcggccggagagaacgcgccgcccgcccggcgtcttttttgttttcgcccaggcgggctgggcggcggcgcggggcgggtggaagcccccccgcccaggtgggcccggctgaatggggggcttgtgcaggcgggggcgggaaggggaaggggaaggggccgcccacctcccgccccgcccgcccgcgcgccgcccgccccgacgccgcagctcagactccgctcagccatggccgggccgcgcgcgtgcgccccgctcctgctcctgctcctgctcggggagcttctggcggccgccggggcgcaggtgagcgcgagctccgggctctgaggctggacgtggagccgcgaccgccccagccccgaacccgccactccggggtgcccggcgcagcctcgacgcccccagcccgtgtcgccgtcggggcgcggagtcgccagcgcctcgggatgagccccgtccggccgcgtcctcgatgggtcctcgctggcccgggtcggccggcgccgccgcctcctctgggagcacaagggggcctttgttcccgccgccggagggaggcgggggacacactgcgcgggggcgccgggctccgcccgag

SEQ ID NO: 88207 - DNA, 30 bp, Homo sapiens
  chr20:61452912-61452942
  hypo
caagcacgcaagtcccgagagcctgccagg

SEQ ID NO: 88208 - DNA, 30 bp, Homo sapiens
  chr20:61460276-61460306
  hypo
agaggctggtcgcaacggtgctccgggaga

SEQ ID NO: 88209 - DNA, 30 bp, Homo sapiens
  chr20:61462692-61462722
  hypo
ggtccttggggacctcgtgtgcctgctgtg

SEQ ID NO: 88210 - DNA, 30 bp, Homo sapiens
  chr20:61466999-61467029
  hypo
tggaagcaaagtaagcgtgtgtaagagaca

SEQ ID NO: 88211 - DNA, 290 bp, Homo sapiens
  chr20:61471909-61472199
  hypo
cggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgccc

SEQ ID NO: 88212 - DNA, 685 bp, Homo sapiens; identical to SEQ ID NO: 46356
  chr20:61505851-61506536
  hypo

SEQ ID NO: 88213 - DNA, 30 bp, Homo sapiens
  chr20:61527484-61527514
  hypo
ttcctggaaaggacacgaacatctcaaaat

SEQ ID NO: 88214 - DNA, 30 bp, Homo sapiens
  chr20:61527715-61527745
  hypo
tcatgattaagtcatcgctgtcattgactc

SEQ ID NO: 88215 - DNA, 120 bp, Homo sapiens
  chr20:61528027-61528147
  hypo
ctcccaccaaagcagcggagccagggaacttcttggaggcagccgttgccgctgcaggtgccggtccggcctgcctggcagctgaagcaccactcgatggggtagcggagagccatggcc

SEQ ID NO: 88216 - DNA, 265 bp, Homo sapiens
  chr20:61532464-61532729
  hypo
tttgctttcatgttgcggggaaacagttacttcccaaatacagcaggcagactacatcgcagacgctcctcagaggagaccatcactacagccaggacgcccttgcagggtccacagctagactgccgtgttttggaatactcaaagctttccttggtcagttttcttactaatacccgctacttgagtgccttccaacttaatggagaggtgtgtaattctccctaagaaactcgtgtgatgagggccacgtggacagatggac

SEQ ID NO: 88217 - DNA, 69 bp, Homo sapiens
  chr20:61541112-61541181
  hypo
ttatcccttggtcttcgctagacttctgctctattgttcctatacttgtacaatcggtgccatcagcat

SEQ ID NO: 88218 - DNA, 30 bp, Homo sapiens
  chr20:61559777-61559807
  hyper
cagcagaagctggctcggctgtggaggcct

SEQ ID NO: 88219 - DNA, 176 bp, Homo sapiens
  chr20:61560285-61560461
  hyper
tttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggattt

SEQ ID NO: 88220 - DNA, 439 bp, Homo sapiens
  chr20:61560528-61560967
  hyper
cggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggg

SEQ ID NO: 88221 - DNA, 92 bp, Homo sapiens
  chr20:61567398-61567490
  hypo
aatgttaaggaatgtcgccttaaggcgctagcactcaagctttctgctcgtgcatccccttgcacactttctccttgacgttcaggctgggc

SEQ ID NO: 88222 - DNA, 348 bp, Homo sapiens
  chr20:61570543-61570891
  hypo
ttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagtcacgtcaaacttgccct

SEQ ID NO: 88223 - DNA, 30 bp, Homo sapiens; identical to SEQ ID NO: 46360
  chr20:61571213-61571243
  hypo

SEQ ID NO: 88224 - DNA, 30 bp, Homo sapiens
  chr20:61583985-61584015
  hyper
ccgagtggtatgccccgccctgccccgcct

SEQ ID NO: 88225 - DNA, 375 bp, Homo sapiens; identical to SEQ ID NO: 38252
  chr20:61585299-61585674
  hyper

SEQ ID NO: 88226 - DNA, 80 bp, Homo sapiens
  chr20:61618954-61619034
  hypo
tcacattctcacacccgggctgcccccaccctgaggacacgggtgaacacggagctcgggggacacgaccatccagcgtc

SEQ ID NO: 88227 - DNA, 28 bp, Homo sapiens
  chr20:61636751-61636779
  hyper
ggaaaaggccttccccggggtcttcctg

SEQ ID NO: 88228 - DNA, 216 bp, Homo sapiens
  chr20:61636875-61637091
  hyper
cgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttgggga

SEQ ID NO: 88229 - DNA, 368 bp, Homo sapiens; identical to SEQ ID NO: 13904
  chr20:61637281-61637649
  hyper

SEQ ID NO: 88230 - DNA, 222 bp, Homo sapiens; identical to SEQ ID NO: 38255
  chr20:61637735-61637957
  hyper

SEQ ID NO: 88231 - DNA, 250 bp, Homo sapiens; identical to SEQ ID NO: 1492
  chr20:61638220-61638470
  hyper

SEQ ID NO: 88232 - DNA, 264 bp, Homo sapiens; identical to SEQ ID NO: 38257
  chr20:61638534-61638798
  hyper

SEQ ID NO: 88233 - DNA, 48 bp, Homo sapiens; identical to SEQ ID NO: 38258
  chr20:61639020-61639068
  hyper

SEQ ID NO: 88234 - DNA, 78 bp, Homo sapiens
  chr20:61650430-61650508
  hypo
acgtcttagtggccaccctcttcagtaggtaggcttctggtacgtgcttccagatcaccaaggcgtagctctaaagag

SEQ ID NO: 88235 - DNA, 420 bp, Homo sapiens
  chr20:61655406-61655826
  hypo
caccctccctggccccggggtcctgtggtcgcccaccacggtggcaccaccttgcggggatagcacagaacacgggcttctcagacccagagttttgaaattaggcagatttgagtgatttttaagaacggggtgggagatcggaactatttcacattttccaaatacagtgaggctctagagtgacgtgaaaactggatggtgcagcacggcgatgtcagttatgtgaacagccgccaccctcgtgcgggcaaaagcggctgatgggaaggactggatctgtggctgccactccgctgctccgtggcggtggggggcggtggccgcccagtccactctgcagtgcgggagctgggctccgcgagctcctggcccccacgccgctggacactggccagcccgggtcgaggtggatctagg

SEQ ID NO: 88236 - DNA, 23 bp, Homo sapiens
  chr20:61662281-61662304
  hypo
agtcagtgctggggccgggcgcg

SEQ ID NO: 88237 - DNA, 124 bp, Homo sapiens
  chr20:61664446-61664570
  hyper
agaaagacaggagaccgcggcttttcctttcagtccttcgtacccaacagcaactgagagggcgtcccggcagggtatgaatggccagcaggacgctgaggctgcgtggcgtttccaccgtgct

SEQ ID NO: 88238 - DNA, 113 bp, Homo sapiens
  chr20:61665862-61665975
  hypo
caatactcattcagacgcagagtgcgtgtgccctgccaggacagacgtcattgctgtgcggtgcttgagtgccatcaataagccacagaagagaaatccggaaacaagggacg

SEQ ID NO: 88239 - DNA, 45 bp, Homo sapiens
  chr20:61666827-61666872
  hypo
ctgcaggggactgaacggggctctgaaacccggccggagctgccc

SEQ ID NO: 88240 - DNA, 59 bp, Homo sapiens
  chr20:61674697-61674756
  hypo
cgtgggggctgagtgcggcttggctgggtccccaccggtggccacggcacctgcaaggc

SEQ ID NO: 88241 - DNA, 376 bp, Homo sapiens
  chr20:61675324-61675700
  hypo
ggaatgtcaggggaacgtgggcactgcggaccgggaatgtcaggggaacgtgggcacggctgaccgggaatgtcaggggaacgcgggcacggccgaccgggaatgtcaggggaacgtgggcactgtggaccgggaatgtcaggggaacgcgggcacggctgaccgggaatgccaggggaacgcgggcactgcggaccgggaatgccaggggaacacgggcactgccgaccgggaatgtcaggggaacgtgggcacggccgaccgggaatgccaggggaacacgggcactgtggaccgggaatgtcaggggatcatgggcactgtggactgggaatgccaggggaacacgggcacggcggaccgggaatgtcagggg

SEQ ID NO: 88242 - DNA, 30 bp, Homo sapiens
  chr20:61676232-61676262
  hypo
gttgggttttgagcacgcagcccagcagaa

SEQ ID NO: 88243 - DNA, 30 bp, Homo sapiens
  chr20:61677586-61677616
  hypo
gcagaagccaggagccgctgtccccagact

SEQ ID NO: 88244 - DNA, 50 bp, Homo sapiens
  chr20:61681372-61681422
  hypo
aggctggcatgggcacgaaatgtggaaatgctccacgcccccagggcttg

SEQ ID NO: 88245 - DNA, 30 bp, Homo sapiens
  chr20:61683138-61683168
  hypo
tgacgggccctccatcgggatcctgtgggg

SEQ ID NO: 88246 - DNA, 321 bp, Homo sapiens
  chr20:61695617-61695938
  hypo
tgttggtgtggacctcggcacggcccccactgacctgcatgggccgaggtcctgcaagagaacgggctccatttgcgtctgagggccaggatgcctgcactggggatcacgctgtgcttcggatggagcctccaatctcggggatgccattttaccctggaggccatcgggcttcatgccccacgggcattgtatcggcttccgtgtggccccgagagcagggcaatccgagggcaaggccaagggagtggtgagcgtggcctgcagggcggagccaggcgaagtggggtggggctggaggccgcccgggctctggttggt

SEQ ID NO: 88247 - DNA, 166 bp, Homo sapiens
  chr20:61703300-61703466
  hyper
cccactctaaggacccgctcctccccgcccccgcccccaaagccgctcctctcacggcccccgaccccgcaggcaccgactgttctcagccccgcccctcgaggccccgccccgcggcttcccgccggggattgcggctgcgcctctgaccctccgctccgggctc

SEQ ID NO: 88248 - DNA, 53 bp, Homo sapiens; identical to SEQ ID NO: 1494
  chr20:61703709-61703762
  hyper

SEQ ID NO: 88249 - DNA, 262 bp, Homo sapiens
  chr20:61703845-61704107
  hyper
cgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctcagcaaagaggagcttggggcagcccactccccacagaggaagggaggggcccgctccacggaggacctggggg

SEQ ID NO: 88250 - DNA, 201 bp, Homo sapiens
  chr20:61714761-61714962
  hypo
tcagggggttccagccgaggctttgtgaaccggatcctgggtcactgagtaaccagactggtctcaggaggttccagctgaggctttgtgaaccagatcctgggtcactgagtgcccggaccaggggttcaggaggttccggccgaggctttatgaaccggatcctcctctttgcgtttcaaacagcgggaaccatcttag

SEQ ID NO: 88251 - DNA, 199 bp, Homo sapiens
  chr20:61725248-61725447
  hypo
agagcaagacttcatctcaaaaaaataaaaaaatgtaaacatcgcaagctgcacccaggtgtgaatctggagggcgcctccttggaaaacttggctggtgaccgcaccctcagttcaagctcaccggccgcccttccctgtgcacacacgtgagctctccagtatgtttggaatatcccagagccgctgtctcctggct

SEQ ID NO: 88252 - DNA, 828 bp, Homo sapiens
  chr20:61733260-61734088
  hyper
cctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggca

SEQ ID NO: 88253 - DNA, 433 bp, Homo sapiens
  chr20:61734101-61734534
  hyper
cgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaa

SEQ ID NO: 88254 - DNA, 208 bp, Homo sapiens; identical to SEQ ID NO: 38267
  chr20:61747797-61748005
  hyper

SEQ ID NO: 88255 - DNA, 139 bp, Homo sapiens
  chr20:61748817-61748956
  hypo
agcacccgacctgcccggacaaccagccaccaggcagacaggagtgagggggtgaacgaagtatggactgaatccacagcctacctggacaacctcaccacgaagacaggagtgaggaggtgaacgcagtgtggactga

SEQ ID NO: 88256 - DNA, 181 bp, Homo sapiens
  chr20:61749739-61749920
  hypo
gcagtgtctactgcacgccgcttgctgcattgctgggcagtgtctactgcacgccgctcgctgcattgctggggagtgtccgctgcatgtcgctcgctgcattgctgggcagtgtccgctgcacgccgctcgttgcattgctgggcagtgtctactgcacggtggacgctcctgcactcat

SEQ ID NO: 88257 - DNA, 204 bp, Homo sapiens
  chr20:61751588-61751792
  hypo
ccgccagccgctgaccgacatcaggtgcctgtgcattgctgggcccaccctccagcactgtcacgttcatcttagcaatggctcatgaggttggatggctcctgtccatgctcagccaaggatccactcagagcagttcagtggccttcccctggctgcagagtagagccggatggagttggacctggacgcaggccgccccca

SEQ ID NO: 88258 - DNA, 59 bp, Homo sapiens
  chr20:61753309-61753368
  hypo
tgaaactatgaagctcgatgcgtgtgatcatcagcagaggccgacgctgcaggcagggc

SEQ ID NO: 88259 - DNA, 189 bp, Homo sapiens
  chr20:61763539-61763728
  hypo
gagggctcaccggcccgtgagccctgtgacattacttcccctgggcagactcagggcaccatgaagcttcccaccgggtaggcactcactatgtctgttacgccgggcgccggcccgagtcctaaagataggcagccctgagggcagaggcactcactggagctcgtgcacacacgtgcacacacgcaa

SEQ ID NO: 88260 - DNA, 84 bp, Homo sapiens
  chr20:61764128-61764212
  hypo
ggacggggtgccagccgcagtgaagcccacaggcccccaggtgccacctatcttcatagcctggcttatcgtcaccccaggagg

SEQ ID NO: 88261 - DNA, 73 bp, Homo sapiens
  chr20:61765333-61765406
  hypo
ccctggggctgggttcggccccagacgacctgaggaagctgccaggtaacaaagctgtcggcatccccagagc

SEQ ID NO: 88262 - DNA, 45 bp, Homo sapiens
  chr20:61765608-61765653
  hypo
ctcctgtgccagctccgggcacttgaccatcgcccaccaggtttg

SEQ ID NO: 88263 - DNA, 31 bp, Homo sapiens
  chr20:61767248-61767279
  hypo
agacggaggctctgtcgcccaggctggagtg

SEQ ID NO: 88264 - DNA, 30 bp, Homo sapiens
  chr20:61771384-61771414
  hypo
tagcccaaagtagaccgtggctatggccgg

SEQ ID NO: 88265 - DNA, 30 bp, Homo sapiens
  chr20:61772713-61772743
  hypo
aggtgccagggcaggcgccccccgcacata

SEQ ID NO: 88266 - DNA, 30 bp, Homo sapiens
  chr20:61782559-61782589
  hypo
ccctgtgcccaaacccgcaccctggtgccc

SEQ ID NO: 88267 - DNA, 39 bp, Homo sapiens
  chr20:61790599-61790638
  hypo
aacgtcagggagcctcgcaaacgtcgtgctcagtgaata

SEQ ID NO: 88268 - DNA, 30 bp, Homo sapiens
  chr20:61798362-61798392
  hypo
atccaacagggcacccggccactcccctgg

SEQ ID NO: 88269 - DNA, 61 bp, Homo sapiens
  chr20:61799802-61799863
  hypo
ctggctcagggaaggcgctccccaagatggaccatggcgaggctcccgccccaggtcctca

SEQ ID NO: 88270 - DNA, 565 bp, Homo sapiens
  chr20:61806408-61806973
  hyper
ttcctcccctcctcccgctcccgcccccgccggagccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccaccggagcggactctgcggggcgggcggggcagaggctgcaggcgggctccccttcccgcgcggctcctaccggccggctccgcccccaagccctggacggcccttcccccagcccgcctggctgggggccgctgcacaccgggggtggaagtggggagccggggaccccgatcg

SEQ ID NO: 88271 - DNA, 352 bp, Homo sapiens
  chr20:61807183-61807535
  hyper
ggagccggtcctgtacggaaaagagacccaaagaaagatttggggtccccgaagccaaggtaccgatggggggtgctaaggagtctttccccttagaatgggaacaagctccaaggagctggaatcccgaggcgtcctggacccgtccaggaagctaagggtgggggacgggaggggagggggccgggagccggcctccctggccccaacccttggtgagaagagggctgggggtataaagtccgaaagtgaggcggaggtttcagggttccgtttcaacaccatggacagcggatgcctcagactgggagcctaggaccgccctggggactgcccccgtttcattagggtg

SEQ ID NO: 88272 - DNA, 606 bp, Homo sapiens
  chr20:61807775-61808381
  hyper
gacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccggctgtccatgggctgggcagtgctggagagggtggaaaaggaaggaagcaggacctgctcccagggaggcccaggctctgctccgagggcagatggcgcaggggctgggttggccctaggaggaaggagatggggacagaggcctgccggccgcgccggcctgcgctccttgcagtctaaacaaaggccagcgggggaggctccggacggtgaggcttggggaagccactgatccctggccctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccgg

SEQ ID NO: 88273 - DNA, 222 bp, Homo sapiens; identical to SEQ ID NO: 1497
  chr20:61808666-61808888
  hyper

SEQ ID NO: 88274 - DNA, 117 bp, Homo sapiens; identical to SEQ ID NO: 1498
  chr20:61808889-61809006
  hyper

SEQ ID NO: 88275 - DNA, 339 bp, Homo sapiens; identical to SEQ ID NO: 1499
  chr20:61809218-61809557
  hyper

SEQ ID NO: 88276 - DNA, 74 bp, Homo sapiens; identical to SEQ ID NO: 1500
  chr20:61809558-61809632
  hyper

SEQ ID NO: 88277 - DNA, 295 bp, Homo sapiens; identical to SEQ ID NO: 1501
  chr20:61809840-61810135
  hyper

SEQ ID NO: 88278 - DNA, 151 bp, Homo sapiens
  chr20:61810159-61810310
  hyper
cgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggc

SEQ ID NO: 88279 - DNA, 30 bp, Homo sapiens; identical to SEQ ID NO: 46371
  chr20:61820146-61820176
  hypo

SEQ ID NO: 88280 - DNA, 156 bp, Homo sapiens
  chr20:61823043-61823199
  hypo
cacctccaccagggtcgcctcccagataatccttctcagtcataaggaggaactcttgagaagagaccttccagggaggagcctggtggctcgaggagcctctgaaccgggcttttttttgctgtttcttttttttttgagacggagtttcactct

SEQ ID NO: 88281 - DNA, 30 bp, Homo sapiens
  chr20:61830522-61830552
  hypo
ctctaccagcacaggcgcacaaccctctcc

SEQ ID NO: 88282 - DNA, 99 bp, Homo sapiens
  chr20:61838424-61838523
  hypo
gccaagtgctggaggcgagctgtgctgctccctcaacattccttagtgccacggctccatgggcactgagttatgagtgtgaaagtttacttctcaggg

SEQ ID NO: 88283 - DNA, 37 bp, Homo sapiens
  chr20:61857454-61857491
  hypo
ggattacaggtgtgagtcaccgcgcccagcccctcca

SEQ ID NO: 88284 - DNA, 180 bp, Homo sapiens
  chr20:61862280-61862460
  hyper
gcagccggggctctcctccaaccatcccaaccaaactctgcatcgttccactagctgatcgcctgccggagtctcagtgtgctcttctgccggcgtgctccccctgatggcctctcgacgtccagccgcttgtgtgttctgccaatgggctcctctccgtgtccagggcttaggtgcctg

SEQ ID NO: 88285 - DNA, 170 bp, Homo sapiens
  chr20:61883234-61883404
  hypo
cctccccatcgtgcccggaggacactaacctacgaggagggatgtctgccctgccggagccccggggggaaggtaagcgagccccccaaggggagcagttcttgccctggcccactttgcctacgccgggcacagttctgtgaggtctgggctggcggctgggacaagct

SEQ ID NO: 88286 - DNA, 474 bp, Homo sapiens
  chr20:61884629-61885103
  hyper
acctcaggttatctccgcggccccagcgagcctcccaggaaagcgccggaagctccttccttcctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcc

SEQ ID NO: 88287 - DNA, 96 bp, Homo sapiens; identical to SEQ ID NO: 38280
  chr20:61885195-61885291
  hyper

SEQ ID NO: 88288 - DNA, 259 bp, Homo sapiens; identical to SEQ ID NO: 38281
  chr20:61885292-61885551
  hyper

SEQ ID NO: 88289 - DNA, 427 bp, Homo sapiens
  chr20:61885777-61886204
  hyper
cgcagcggccggagcaggagcccatggtgcccgcctatacaggaggcccccgggtgccccgcgctcggcccccgcccccgctccgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccgg

SEQ ID NO: 88290 - DNA, 71 bp, Homo sapiens
  chr20:61886256-61886327
  hyper
cgaggcgttttctctgagagtctcagagattccttggcttggagaagtcctggacccgggtccagagctca

SEQ ID NO: 88291 - DNA, 30 bp, Homo sapiens; identical to SEQ ID NO: 38284
  chr20:61886725-61886755
  hyper

SEQ ID NO: 88292 - DNA, 157 bp, Homo sapiens
  chr20:61894135-61894292
  hypo
agacgggggtggggacgcgctgagtgaccctcaggagacgggggtggggacgtgctgagtgaccccacagctcagaagtcgaagggctgagtttcattccaggtcctgggacccccagtccccagggttggggctctggcagcgcctcctcaccccg

SEQ ID NO: 88293 - DNA, 30 bp, Homo sapiens
  chr20:61940064-61940094
  hypo
accatgcggctcccccggccctggagtctc

SEQ ID NO: 88294 - DNA, 33 bp, Homo sapiens; identical to SEQ ID NO: 46375
  chr20:61941734-61941767
  hypo

SEQ ID NO: 88295 - DNA, 144 bp, Homo sapiens
  chr20:61942831-61942975
  hypo
acccactacctggtgcgatgttctcctgcttcccccaagggtgaagaggaggagcgagaggtgagctgggccggggggtggcgggggaggcagaggagtggggcagagcgagtgggggctggcctgggacgtcatgtctctgca

SEQ ID NO: 88296 - DNA, 74 bp, Homo sapiens
  chr20:61957937-61958011
  hypo
ggaggcaccacctgccggaggaatggcctgaaggaggctggggccagccaggcatccaccgcccttgtcaggtc

SEQ ID NO: 88297 - DNA, 118 bp, Homo sapiens
  chr20:61965232-61965350
  hypo
ccagggcagtggggacgggagagctgggacacgtggactcacaccagggcagatggtgggggaagccagtgtctgtagattcagtgcatttcttggggaagggcgtggaacatttgga

SEQ ID NO: 88298 - DNA, 584 bp, Homo sapiens
  chr20:61973825-61974409
  hypo
tacaggggggagaatcggagccctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagacagggagtgtaaacggcacagtcacgtggaagacacgttggcattatctc

SEQ ID NO: 88299 - DNA, 69 bp, Homo sapiens
  chr20:61974643-61974712
  hypo
attgcctgcagaagccgggcggccgcacctgggctcggcgggccacacggtcggcggggcttggtccat

SEQ ID NO: 88300 - DNA, 30 bp, Homo sapiens
  chr20:61979634-61979664
  hypo
cacggtggcacagcccgggcacagctgcct

SEQ ID NO: 88301 - DNA, 135 bp, Homo sapiens
  chr20:61979961-61980096
  hypo
accaggccctggcaccgggacaagagccaggaggtgccggcgacagcaggtggatggacaggacagatgccgaattgccgctgtggacgtcatgggctgcacagccgaggccgagacccccggccacctgtgtgc

SEQ ID NO: 88302 - DNA, 911 bp, Homo sapiens
  chr20:61980587-61981498
  hypo
cggggcaggcacaggcgcactctggagaaagggccttggcagtgcctcgttgcgttctggggacttggccattgctgggcaggagttcccagagcgcccccgttctgtgctggaaggacgctgcctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgcttcgccagggctggacatgtgctggacgctgagggacctggctttggccagccctggtgcctgggtgccgtggggcgggcggcagggtccaggcgaggggtgggggctggctttctcagcttccaggggctgctgaggagggagctggtcggagggtgacttgc

SEQ ID NO: 88303 - DNA, 751 bp, Homo sapiens
  chr20:61981745-61982496
  hypo
ggtgtgcgtgcgtggcgagcggtggtgcacgttgagcacgaagaccgtgatgacgatggacagggtgacgaagatcatggtgaacagcaggtactcgccgatgagtgggatgaccagtgaggtggacgggatgatctcggtgatgagcagcaggaagacggtgagcgacagcagcacggagatgcacagcgtgatcttctcgccacactcggagggcaggtagaagaccagcacggtgaggcaggagatgagcaggcaggggatgatgaggttgatggtgtagaagagcggcagccgccggatgacgaaggcataggtgatgtccgggtagatctcggcacagcactcgtacttcctggtgttgtaggtgcccacggcatccacgatgacccactcgccactctcccagaagtccagctggtccacgcggctgtgcatgttcaccaggtcgatcttggccttgtcgtaggtccaggagccgaatttcatggtgcagttctgctggtcgaaggggaagaaggtgacgtcgatgctgcaggagctcttgtaaatggccgggggagtccactgcacccgcccgtcatggaacaggtgggccttggtcaggtgggtgaccgcgaagtccccgtcagcactgggcaggaagagagcgaagggtgtgagacccccacatccatgcccacgtccacacccacgcccactgccacacccatgcccacgtccacacccacacccacatccacgcccacat

SEQ ID NO: 88304 - DNA, 31 bp, Homo sapiens
  chr20:61982616-61982647
  hypo
cacagaggcattctcacgtcacaggagcaca

SEQ ID NO: 88305 - DNA, 30 bp, Homo sapiens
  chr20:61983281-61983311
  hypo
aggcagccaggctcacgggggcagcagccg

SEQ ID NO: 88306 - DNA, 57 bp, Homo sapiens
  chr20:61986049-61986106
  hypo
cacaggcacccagagcggcttctctgcccggcccatcctgggcgtttccacttctcc

SEQ ID NO: 88307 - DNA, 165 bp, Homo sapiens
  chr20:61986524-61986689
  hypo
actcagctcagagagcgctggctgccgggcgcagggccctcggcacagatctgcaggaaggacaagttagaggacagcagcctccggaggccaccatctgccacggccaatccgtggcaacgctgccctggcttccaggcacagaaaacccgtttccatgaccag

SEQ ID NO: 88308 - DNA, 30 bp, Homo sapiens
  chr20:61990604-61990634
  hypo
gctgttctttgcttccgaaggtgcctgggc

SEQ ID NO: 88309 - DNA, 226 bp, Homo sapiens
  chr20:61990843-61991069
  hypo
gtgctccttgcagggcgacctcagtcacagtgcacgatggccacgccctcacctaccacgtcaatgagctgagcgatggacaggccgaagcggacgaggaccacgtccgagatgttggccacgggtcgggaccacttgttgtaaccggagaagagtttcttcaggagccgctcctcggcgtgggcccgggtctccacatggctgctggctgcggggagaggcaggc

SEQ ID NO: 88310 - DNA, 92 bp, Homo sapiens
  chr20:62011877-62011969
  hypo
aagccacttgtggtctgcctggtccagcgccagcctcacagggagccggcatgtggagctgtcctccctgccgcagccggcatgcctggctg

SEQ ID NO: 88311 - DNA, 30 bp, Homo sapiens
  chr20:62026530-62026560
  hypo
cccctccagcaggtgcggcctcacctcttt

SEQ ID NO: 88312 - DNA, 229 bp, Homo sapiens
  chr20:62028677-62028906
  hypo
gcctctcgtgaatgacgctgctgcctacctgggtgtgcacgtctcggccagaccccgcgttcaggtgttgggggcctgtgccccgacgtggggttgctgggtcgtctggtaattttatgcggaatgtttggaggagccgctgcctgtgtgttctctgcagcggctgcgccatgtcacctccccatcagcagcgctgggctcccgcgtctgcacgcgctcaccacgcttg

SEQ ID NO: 88313 - DNA, 262 bp, Homo sapiens
  chr20:62031112-62031374
  hypo
agacagacaagcagacgggggccaggccaacaacaggaggtacccaagtggacacatggtgaccggcgatcctgcccgggcgagctgatggaccacaggtgccccagcggcaggcccaggccccagcatctttctgggtggctgcaggcctcagaggggagggagagctcggcgccccaagagagagcccagggaccacagcagccccacagcggcccctcctctggccagagccctaggacccagccgcccctgctcctca

SEQ ID NO: 88314 - DNA, 146 bp, Homo sapiens
  chr20:62031607-62031753
  hypo
gtccgaactcgtccccgtggcagcagggatccccagaaccttccacggccatcgcggccgcaggaccccacacccgaagtcccccgcaaacccgcactggcgcattcttacggctctggcatcaacctgtccgtgtgagtaagtta

SEQ ID NO: 88315 - DNA, 482 bp, Homo sapiens
  chr20:62031973-62032455
  hypo
gacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcctgcctggtagccccggggaccggcccctccttgctggcgcctggccgagagtcagacgctgaggacctctcaggacggggcccctggcca

SEQ ID NO: 88316 - DNA, 159 bp, Homo sapiens; identical to SEQ ID NO: 46386
  chr20:62033495-62033654
  hypo

SEQ ID NO: 88317 - DNA, 209 bp, Homo sapiens; identical to SEQ ID NO: 46387
  chr20:62037523-62037732
  hypo

SEQ ID NO: 88318 - DNA, 665 bp, Homo sapiens
  chr20:62038025-62038690
  hypo
caccaaagggaccctcgccggtggccgagcgtggcgggggcccgcacggggtacagaggtcggagtcggtgtctgactctccctccgcaatgtagggcctgactttggcacaaggcgccacggccgcgtagcagctgttgagagcatccaggttctccttggactgggagatgctgaagccgctgaaggaacgctccagctcctcgtggtccacggacgggatggagatggacgtgtcgctgtcccgcaggttcccctcggggggcctgcagcccggggtgtcctcctgccgcaggaactccatgctggcgcggttgcccccgccgtaggcggacagcgaccgctcgtgggcaggcggcggcgggatgcgcaccagggagccgtggtcccccacgggggaggtgccgtggccctggcgcgggtggctctgtggctgccaggaggtggagggcggacactggacagggggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccatccgctgcatgtagata

SEQ ID NO: 88319 - DNA, 150 bp, Homo sapiens
  chr20:62039576-62039726
  hypo
ggggtgggaggctcacggtggggtgtgaggggtctgcacagagcagctgtcagtggtgacagggccatgtaaaccctagacttgaggagccctccgtggcacccagcccctgaagcccacactgccacaggttgacggcaggcaccacag

SEQ ID NO: 88320 - DNA, 30 bp, Homo sapiens
  chr20:62042564-62042594
  hypo
ggtagatgctgtgaccgtctgtatcttcca

SEQ ID NO: 88321 - DNA, 395 bp, Homo sapiens
  chr20:62046201-62046596
  hypo
caccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgccggagggagacacag

SEQ ID NO: 88322 - DNA, 84 bp, Homo sapiens
  chr20:62048313-62048397
  hypo
cctgggtgttgtgcccgctcggggaagcagagacggagtggccgagatcccccgagtcccgaggcgtcgcgtgcttggggacgt

SEQ ID NO: 88323 - DNA, 101 bp, Homo sapiens
  chr20:62050926-62051027
  hypo
gagccgtgcagcagccgtcagtccgtgcggcgtgttccgcggtacctagagcgtccggggcagcatccacacaggggccctctgcacgggctgcctttact

SEQ ID NO: 88324 - DNA, 40 bp, Homo sapiens
  chr20:62051926-62051966
  hypo
aagcacccagcctcccgtcttcctgcgcacacgtgtgttt

SEQ ID NO: 88325 - DNA, 118 bp, Homo sapiens
  chr20:62052467-62052585
  hypo
aaggaggcagggtcccgcttccccaaacctcccaaggtctcctgttttgaccccagcatgatcgccttgaccaagaggcccctcccgggccggccctgccgcccgattctgcaatggg

SEQ ID NO: 88326 - DNA, 157 bp, Homo sapiens
  chr20:62053182-62053339
  hypo
ccccctggggcagcacggcccgagccccgcagcctgcctggctccccacccgaccccaacgtagacgcttcctctgactccagcacagccccagtggtccctacgggaaccgagcccccgccagccgggtcgcctgccaccacgtgcctgtgttctg

SEQ ID NO: 88327 - DNA, 175 bp, Homo sapiens
  chr20:62053798-62053973
  hypo
gtcccccaccacaggcgtcccaggaggagggccggggcgggtgggtgctcgcccgtgggggagggcgtgggaggcacaggcaaggaccccccggacacatggggaagagacgggggaggggtggggagccacagagcttaccggagagcccggaggctcccgcgtgtcctcacct

SEQ ID NO: 88328 - DNA, 215 bp, Homo sapiens
  chr20:62054221-62054436
  hypo
cgtggggccctgccacgcggaagccgtcgggaagcctcgcgtccacctgggacagcaccgaggttccgcccaaatcacagccaagggtgcccattgtggggggcacagtgctcatccccacagccactcccagcctcagggccagcagcaggggcgggggaggcagtggcagcactgggggctggcaccagcagaggctacgctgccgacccagc

SEQ ID NO: 88329 - DNA, 30 bp, Homo sapiens
  chr20:62054771-62054801
  hypo
ctcagggtgatgtgtcgggggctggggctc

SEQ ID NO: 88330 - DNA, 30 bp, Homo sapiens
  chr20:62057304-62057334
  hypo
accacgtttccaatccggcggggcaaactc

SEQ ID NO: 88331 - DNA, 42 bp, Homo sapiens; identical to SEQ ID NO: 46395
  chr20:62058718-62058760
  hypo

SEQ ID NO: 88332 - DNA, 85 bp, Homo sapiens
  chr20:62060772-62060857
  hypo
gcgttggaggcaggacggccacctcccagcccagccctcacccagctgactccctacgcggctatggccacggccaccccctgga

SEQ ID NO: 88333 - DNA, 30 bp, Homo sapiens
  chr20:620674-620704
  hypo
tcttcctgctccactcggcagccagagcca

SEQ ID NO: 88334 - DNA, 30 bp, Homo sapiens
  chr20:62069071-62069101
  hypo
tcctggtcagctctgcgggtccagtggatg

SEQ ID NO: 88335 - DNA, 30 bp, Homo sapiens
  chr20:62071331-62071361
  hypo
gactcccacgaggctcggctaggacagcag

SEQ ID NO: 88336 - DNA, 43 bp, Homo sapiens
  chr20:62071788-62071831
  hypo
tggacatgttggggccgcagcccacccccgcctgccagaaccg

SEQ ID NO: 88337 - DNA, 30 bp, Homo sapiens
  chr20:62075804-62075834
  hypo
agatggcccaagtcacgagaagaagcaccg

SEQ ID NO: 88338 - DNA, 34 bp, Homo sapiens
  chr20:62078339-62078373
  hypo
caccccaccagagctcgctcgggccagagggcac

SEQ ID NO: 88339 - DNA, 570 bp, Homo sapiens
  chr20:62090078-62090648
  hypo
ccacatccaggcaggcggcagccaagaccctgccctggccaagttgaacctgctcgagagcccaggctggcagctaggcctggggcccacactcaggcgtcactgcaccaccttccgcacagcgggaagagcaaggcgagggctccgggagggggcctgtgtgggtctggggggctgagatgaggagggcacggcccacccagggcacctggccacatgtgacgcaggcttcgtcccaagaggaatgacgaaatgtccagagacactcaccgcgtgtccacagcagcctcacggcagacgcaacccaacatccagttggtgggtgggtagataaactgaggtccgtccgtgcggccacaggaaggacgaggcagcggcccccagacacggagaggatgaaggagtaccctaaacacgaaggaacctgagggcaggctcggcaaggaaagccaggcacaaaacggcaccacgatgacaactccacttacacgaaacatccgaagcaaacaggccaggcccggcggccacgcctgtactcccagagcttggcgaggccgaggcaggaggaca

SEQ ID NO: 88340 - DNA, 32 bp, Homo sapiens
  chr20:62092270-62092302
  hypo
gccaactacctggcacgcgagactcatcttgc

SEQ ID NO: 88341 - DNA, 181 bp, Homo sapiens
  chr20:62094124-62094305
  hypo
accggtcagagaagtcgtgagcgcccgacggagcctagagggggacatgcagggagagggggccacacgcacaaggcaggacacggagtgactccacacatgtgaaaagaagtgagtgaacacacacagacacacacatgctgtaccgtggcacgcatgcagagaacggctccaggagatg

SEQ ID NO: 88342 - DNA, 30 bp, Homo sapiens
  chr20:62096894-62096924
  hypo
tcaacagagaaagctcggcacacgggctgg

SEQ ID NO: 88343 - DNA, 128 bp, Homo sapiens
  chr20:62097848-62097976
  hypo
ccctcctggcctccacgctccgtccggggtgaggccttccactctgctgaaggagcctcacggtcacggcgatgacagctacgagcttggggaacatcgcacgcatcaggcatcgtgtggagtgactc

SEQ ID NO: 88344 - DNA, 839 bp, Homo sapiens
  chr20:62102787-62103626
  hyper
gggtcccaggtctgccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggacagacagctgcgctcagcccgggctggggtgggggggtcatgggagggcccctcccccatctcaggaacccagaagctcaccctagtctgagggagagcggctcgggaggatggcggaggacaggccagacccctcccccccgccctcgcttggtcgggcggccccagccccgcgggtccccgagagtcccggagagtccagacccagcgctgccgccgtccctccccggccggccctttgttcggcgcagaggccgcggggaggggcctcccaggctgaggagggggctggggcggccgcacgtctctgtcctgcgggcctggagcccccaccccgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccgg

SEQ ID NO: 88345 - DNA, 230 bp, Homo sapiens
  chr20:62103667-62103897
  hyper
cgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggctcaggctcagcgggggcggagcgcggggggcggcgcgggccccagcccag

SEQ ID NO: 88346 - DNA, 163 bp, Homo sapiens; identical to SEQ ID NO: 46399
  chr20:62115182-62115345
  hypo

SEQ ID NO: 88347 - DNA, 44 bp, Homo sapiens
  chr20:62117912-62117956
  hypo
ggagcagagccccatcgacaccttgatttcggcagggaggctgg

SEQ ID NO: 88348 - DNA, 306 bp, Homo sapiens
  chr20:62119313-62119619
  hyper
agggggtccggggggcgcggggcccaccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgc

SEQ ID NO: 88349 - DNA, 249 bp, Homo sapiens
  chr20:62119922-62120171
  hyper
ggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacagggcccaccccagctcgtctgggcagggtcacctgcactcagtgacacggaggccgtggctctcctgccatgctctgggccaagctccgcaggaaagggggc

SEQ ID NO: 88350 - DNA, 526 bp, Homo sapiens
  chr20:62126038-62126564
  hypo
ggaacctgcatttcccggggacaggccctcgacctccccgtgccacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacagtgagccctgccccgcctgcctggcaggggacagagcgagcctggccccacctcacttccaggcctctccaggcagcgggctggggcctga

SEQ ID NO: 88351 - DNA, 196 bp, Homo sapiens
  chr20:62131908-62132104
  hypo
acttccgagtgctgccgatgccgtcaaacaggagccaggaataaaaataaccgcctggcaagaaagcaaggcccgccccaccccacccagctggtctctatatttaacgcctcccctgcagcctgaaggttaggcagggatttggaagtgggcttgctgcaggtgctcgagtggcccaggccggggtcccggggat

SEQ ID NO: 88352 - DNA, 30 bp, Homo sapiens
  chr20:62137607-62137637
  hypo
ttgaagaatgcaaaccggttgttttgtaga

SEQ ID NO: 88353 - DNA, 30 bp, Homo sapiens
  chr20:62141242-62141272
  hypo
ttttgtgtgtggacacgttttcatttatcc

SEQ ID NO: 88354 - DNA, 126 bp, Homo sapiens
  chr20:62149153-62149279
  hypo
tctccctccaggggccgaccaacgagctccgggggtccaaccctggctccggctttggcagaactctcacctcgcccccagacacctgtgggaggagcacagtgcaggtggcgacagctcccaggg

SEQ ID NO: 88355 - DNA, 36 bp, Homo sapiens
  chr20:62149530-62149566
  hypo
tcctctccagctgaccgtccccgtcaatctcatccc

SEQ ID NO: 88356 - DNA, 253 bp, Homo sapiens
  chr20:62153209-62153462
  hypo
ccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctga

SEQ ID NO: 88357 - DNA, 76 bp, Homo sapiens
  chr20:62157231-62157307
  hypo
gactccgtctcaggaaaaaaaaaaaaaaaagttccagtaaagcaaattttaaaagagcccacgtgtccaggtgtac

SEQ ID NO: 88358 - DNA, 30 bp, Homo sapiens
  chr20:62163260-62163290
  hypo
cagagcgcaaacgtgcgtggtgcctcagtg

SEQ ID NO: 88359 - DNA, 276 bp, Homo sapiens
  chr20:62165579-62165855
  hypo
gctgaggaaggacaccgcctcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgccctgcacgctctggccaagct

SEQ ID NO: 88360 - DNA, 30 bp, Homo sapiens
  chr20:62166949-62166979
  hypo
gctccaggtgacctgcgccctttgtgtgtc

SEQ ID NO: 88361 - DNA, 272 bp, Homo sapiens
  chr20:62167554-62167826
  hypo
cacttctcacctgggcgagttctcaggactcagggtctttgcacctgggagctgaccagcctccggccagaccccacccctgcacccctgctcactaacgaggtcgtgggtctgcgcgtgaccctgctaacgaggtcgtgggtctgcacgtaatagaggggtctccaccatgggcccctgcccgacggcctctttacagcctcccctgcttgttgcttgggtcccccgggagctaaccctacacagcctgtgactcacgcacacacacagtg

SEQ ID NO: 88362 - DNA, 237 bp, Homo sapiens; identical to SEQ ID NO: 46405
  chr20:62168240-62168477
  hypo

SEQ ID NO: 88363 - DNA, 248 bp, Homo sapiens
  chr20:62170122-62170370
  hypo
gcgtccctcagagcccggccagactctgggcccgtgagtctatgtccaggaagcctcgagtatccctgagttcggacgtgcaggactttcagtctaagccacaccaggaggcaggaacgtccccagcccctcccagatacccaggagcaccaaacctgttcagctggtggctggcgagatgcctaggagggcacaggtgccacagacacacctggtccccttaatcccagtggcggctgcagagagca

SEQ ID NO: 88364 - DNA, 252 bp, Homo sapiens; identical to SEQ ID NO: 46407
  chr20:62172062-62172314
  hypo

SEQ ID NO: 88365 - DNA, 553 bp, Homo sapiens
  chr20:62172646-62173199
  hypo
cgctgtccacttgaccgggatcttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttagggcacggggccaacggccggtgaggccagcgtccacccacgtcaccttcccccatgcctcagcctcctcatctctaagacgtggcgaggatggcatggccggctaaggccacgggaagccccaagtgagacagggcgagggtcctgtactcaccacagtgacccggcagccggcccaggcccccgacaaagaccaggg

SEQ ID NO: 88366 - DNA, 115 bp, Homo sapiens
  chr20:62181335-62181450
  hypo
cagggtgagtgtggtcggcaggcagccgaggccggctttatccagctcctccccggtggtcctcagaatccccggccccgcatgcccagctgccctgtcccgctgccctccaagt

SEQ ID NO: 88367 - DNA, 237 bp, Homo sapiens
  chr20:62185322-62185559
  hyper
cttggaccagccacccgccgtggcccctcagtcggggacgcgggcccccagaagtctggggctctccaggaagcgaagcggatggaagattactcggctcggggtcccgggtccccacccccgccccgcccccgggccgcagcgtcacaaaggccgctggtccccagggcaacccgcggagtgcggagggaggctgggctctgggaagtccgcgcgcggctccgcttcagaggcagg

SEQ ID NO: 88368 - DNA, 30 bp, Homo sapiens
  chr20:62197386-62197416
  hypo
tctcccagagcttgccgcaggccccgaagg

SEQ ID NO: 88369 - DNA, 47 bp, Homo sapiens
  chr20:62200790-62200837
  hypo
cttttgtagcagcaccggccggcggccaaagtcgaagaccacccatt

SEQ ID NO: 88370 - DNA, 159 bp, Homo sapiens
  chr20:62204228-62204387
  hypo
cttgggaaggtgggccggcagcccaccacgcgccagaccttgctcttggtggcctgcttaaagcgggccagcaggatctcgcgggagcagtcatgctccaccctacggaggacgtaggtgctttcattgagccgctgggtgcagcgggagcagcccaga

SEQ ID NO: 88371 - DNA, 123 bp, Homo sapiens
  chr20:62221319-62221442
  hypo
tggttctgcagaccacgtgacccacctgcccgagccagccctgcggcctctgcccgctccctgctgccgcggctgagagacagccagccctgtccgtcccaggggcctcgccctcctgtcggc

SEQ ID NO: 88372 - DNA, 30 bp, Homo sapiens
  chr20:62250986-62251016
  hypo
taagcgcactccacccgtttttcccactgg

SEQ ID NO: 88373 - DNA, 35 bp, Homo sapiens; identical to SEQ ID NO: 46411
  chr20:62274577-62274612
  hypo

SEQ ID NO: 88374 - DNA, 30 bp, Homo sapiens
  chr20:62275052-62275082
  hypo
cccgtgggccgcctccgttgaaactcctgg

SEQ ID NO: 88375 - DNA, 30 bp, Homo sapiens
  chr20:62276993-62277023
  hypo
tttctcactagtgctcgataatccttttgg

SEQ ID NO: 88376 - DNA, 163 bp, Homo sapiens
  chr20:62281532-62281695
  hypo
tctttgactcccttctttctcaccgccccctccccaccatccttccccttcactgacttcagggagttaaaaacaattctcgcagtgagctgggcttgttttgtctccctgcttctctttgtactaaacattagataccgaggaaatgcggattggcctttgg

SEQ ID NO: 88377 - DNA, 141 bp, Homo sapiens
  chr20:62283695-62283836
  hyper
ggaggtgcggcccttcgtcctgtcctcccaaacgtcgagtgaaaaacgaagcgggttctgcggcctcgcggcggagcagagcgtttcgggaagggcgggcccagcgtcctcgcgcccgaggtcgcccggcagctcccctgc

SEQ ID NO: 88378 - DNA, 94 bp, Homo sapiens
  chr20:62290954-62291048
  hypo
ccgggccagaggcagcgtctgtcataaaaagggctggtgttccaggtggggtcagagagaggattgacaagtaaaaacgatcgtcctttgaagg

SEQ ID NO: 88379 - DNA, 60 bp, Homo sapiens
  chr20:62310644-62310704
  hypo
agccactgtcctcagcgtaatgctcaaggctctggcctggctcctcggccaccctgcacc

SEQ ID NO: 88380 - DNA, 30 bp, Homo sapiens; identical to SEQ ID NO: 46414
  chr20:62311251-62311281
  hypo

SEQ ID NO: 88381 - DNA, 1111 bp, Homo sapiens
  chr20:62320911-62322022
  hypo
ctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactcc

SEQ ID NO: 88382 - DNA, 30 bp, Homo sapiens; identical to SEQ ID NO: 16693
  chr20:62329526-62329556
  hypo

SEQ ID NO: 88383 - DNA, 192 bp, Homo sapiens
  chr20:62331754-62331946
  hypo
caccaggggaccagccgtcccgacggcagcgcggctgcgcctacgtgatgtccctctgccgcggcggccggtgcacattccgcacgacacacttcaccatccactcgatgccctcgcgcacccctttgctgtgaagacagcgggtgtgaggcggggggtctcggtccccaaagcccccgcaggtgcagcccc

SEQ ID NO: 88384 - DNA, 96 bp, Homo sapiens
  chr20:62340225-62340321
  hypo
gtccggatcagagaccgttcctaaagcagaggcggggccagaatctgcggcaggtgggcaggaggaggaagagggagaggacgaggaagagctgag

SEQ ID NO: 88385 - DNA, 77 bp, Homo sapiens
  chr20:62340648-62340725
  hypo
gtgtctgtgttcaggcgtctacgtcttccttctggggtgaatcaagaagcatggaaggaggccaggcgcggtggctc

SEQ ID NO: 88386 - DNA, 204 bp, Homo sapiens
  chr20:62369069-62369273
  hyper
ggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcc

SEQ ID NO: 88387 - DNA, 33 bp, Homo sapiens
  chr20:62378380-62378413
  hypo
caggggccaggccctcgtcgtcctcgcccagct

SEQ ID NO: 88388 - DNA, 1084 bp, Homo sapiens
  chr20:62383131-62384215
  hypo
ctccccatgaagccccgcccccggtgggtctccccatgaagccccgccccccggtgggtctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggggcgggggggcgcagaggtggctgagggttgggggctccaagcagagcgagctgagtttgccgaggcctggctgccttggcggccagcaggtgagcagggtgggccgaagcctctgcaggggccatgtggcccagccacacccaggaggccggggcagagcagacaggggcccggggcggatctccctgccctgctgtcgtcccccctgtgcagagtggacccggtgtggggtccggggcggtctgcgccctcatcaggacccgcctgcccggacatcgtggccacgcgcagcgcgcggcacgcggaccctccccgcactcaccagcgtgtggcgcttcatgtgctcgcgccgcgtgaacttcttcccgcagatctcgcaggggtagggccgctctcccgtgtgcgagcgcatgtgtcgcttgaggatgcactggtgcatggccgagaagctgcagtacggacacttgaacttcttcctgatcaccgtgaactcattcac

SEQ ID NO: 88389 - DNA, 42 bp, Homo sapiens
  chr20:62386430-62386472
  hypo
atgagcaggactcagcgttaataaccccgtgagaataaacgc

SEQ ID NO: 88390 - DNA, 495 bp, Homo sapiens
  chr20:62398454-62398949
  hypo
aaagcagcacattcccgtaattccacgccgacacgtggagcgccgcgcacatgccaggcacacaccgccaaggacgccgtggcaggctttgtctttcgatctccctagaaagttgctgggtcggagccacgtggctccacttcccacggatggggacatgttttcccgcccctgaaagccccccgtccccacacattggcaatcccgtaggatctcggtcatctgaaccccgtcgggcagaagctggaggtccacccgccccagctgcccaccggctgggcatggagatgccttcacctggcagcagccggcagaggactcgagaaatgaccacagaaaggcacacaccggctcccagtcacagctctccgcagatatccccctccgacgcggctgttcggtcacccagttcccctcctgctcccacacacttgagagctctctcgcctgggcagctgcacccagctggagcccgggacccggacgccaaagctc

SEQ ID NO: 88391 - DNA, 198 bp, Homo sapiens
  chr20:62400759-62400957
  hypo
tctcacccacaggaacgcgcaccagctgctgggttctagagagttccagaagcactgacgatcttcccggcatgcggtgtgagcccggtgatgccccaagggtctcgctggaggcaggtgtttgaacgctttgatcagctggccaaccccaaatgcccgaggtctccacccatgacttctctgcggtgtgtctctttc

SEQ ID NO: 88392 - DNA, 30 bp, Homo sapiens
  chr20:62403252-62403282
  hypo
actctgctgggcaggcgtctggggcatcca

SEQ ID NO: 88393 - DNA, 163 bp, Homo sapiens
  chr20:62404995-62405158
  hypo
acgggcatgtgccaccggccgcacccaagctgctcatgtgaaaaggcggtcggaggggagggtagtgagggaggcccgggatccccctccgaccgcacccacgggcatgcgccgctggccgcacccagcctgtccctcctgacgcccacgaaacgtgcccagc

SEQ ID NO: 88394 - DNA, 77 bp, Homo sapiens
  chr20:62407078-62407155
  hypo
cgtcatcccccagcacgtcggccttcagcgacagcaggctgttcttactcatgagcgccgcgcgcaggttggccacc

SEQ ID NO: 88395 - DNA, 320 bp, Homo sapiens
  chr20:62407384-62407704
  hypo
catttagaaggacagcgaccagcttctgcctgagctacagagcagcatcaagtccagcccaccctgggagccgggcacctgccccagcaatgcagcagcctcggcccagcccggcctttcctgcccacccaggtcccatggctgcggtggagtctcagccaaggctttggaggacggctcaactcagaacaacggggttgccctccctggacgaggcgctgcagacctggtacctgctctgctccagggccgagggcctgagagtcagaggctcctggggcggcagtatttccatctcgcaaagacgaggagaggctcaa

SEQ ID NO: 88396 - DNA, 30 bp, Homo sapiens
  chr20:624100-624130
  hypo
aaacggcccaaaatgcgtgtgtgtgtattt

SEQ ID NO: 88397 - DNA, 47 bp, Homo sapiens
  chr20:62415068-62415115
  hypo
gagcagctgtgggatcggggtgcggagccggacgcccttcccacccc

SEQ ID NO: 88398 - DNA, 30 bp, Homo sapiens
  chr20:62417499-62417529
  hypo
taaaccccccaaagccgtgtctcttgccag

SEQ ID NO: 88399 - DNA, 74 bp, Homo sapiens
  chr20:62422247-62422321
  hypo
tgggaggacgacccacgcgagagcccatccacaggtgtgcagcgggaggcctgtgtctccgcctgaagcagggc

SEQ ID NO: 88400 - DNA, 267 bp, Homo sapiens
  chr20:62427164-62427431
  hypo
aagagtggcctctgccgaatgcgcataggaacggcccagcctctagggccatcttggaagtggcggtgcccatcccaaatcctctctccaacagactcccggaaggtgacgggtgtccatcattgagcgcctttgaagactgtaaacaggcgcgctgctgttgaggacgcacacttcccactcactccaatcctctcatttgaggacgaatgtgccctggccacagcctggatagatgcctgtgtcgcaggacgcagaccaaggaaa

SEQ ID NO: 88401 - DNA, 30 bp, Homo sapiens
  chr20:62431319-62431349
  hypo
ccagacagactcatgcgtgaacgttcacac

SEQ ID NO: 88402 - DNA, 30 bp, Homo sapiens
  chr20:62433257-62433287
  hypo
gtgctgtttgctgcacgtaaattatgcctc

SEQ ID NO: 88403 - DNA, 96 bp, Homo sapiens
  chr20:62440444-62440540
  hypo
tcaaggggctctccacgttcgccttccacgttccccttcgcagggaccgcagcgcctggggcacttcgccatgggcttggccgaagtgggcactaa

SEQ ID NO: 88404 - DNA, 348 bp, Homo sapiens
  chr20:62461291-62461639
  hyper
tgcgcccaggccgcgcgctaaacacgtttctaattagcatttctttaaacaatgctgatcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttaggga

SEQ ID NO: 88405 - DNA, 166 bp, Homo sapiens
  chr20:62463049-62463215
  hyper
cacccgctcccttcccgggccgcgcaccgggcgctgcccacgcgcaggttcctcgggggcgcgcgggtgcccaggtcaccggccgtccccgcgcctgacgcgcggttgcactgcgcgcgtctcgcaaacttggcgactcccccagcccggccgggcatcaacgcgg

SEQ ID NO: 88406 - DNA, 186 bp, Homo sapiens
  chr20:62463622-62463808
  hyper
gcattcctggccggcctgcgcaggggtaaaggccacctcgcttcctctccccgggcgcggcgggaagggaggtgagcctgtggccggcagccgcgcgagggagtcgagcccggcccggccaaccaatggggaggcgcccgggccgtccagcctgcctccctgcgggcccagcgcagcggattcctc

SEQ ID NO: 88407 - DNA, 99 bp, Homo sapiens
  chr20:62472040-62472139
  hypo
accaagtctcaggatcgaaggcaaggtgcccctctggagggaggtggggctctgggaagcttgggggccgtggccatggagatgcggggggatggggag

SEQ ID NO: 88408 - DNA, 30 bp, Homo sapiens
  chr20:62474624-62474654
  hypo
gcccatccacctgctcggatggccttggct

SEQ ID NO: 88409 - DNA, 212 bp, Homo sapiens; identical to SEQ ID NO: 46423
  chr20:62481430-62481642
  hypo

SEQ ID NO: 88410 - DNA, 147 bp, Homo sapiens
  chr20:62487806-62487953
  hypo
agaaaagcacggagccgccggcgtggcagaagagcctgcggagaagctccctcaaagactggcaggcgacacaaccacaacctgtggaaaagcaactggggcaaagctcttggctttaagaatacccccttggggccgggcgcggtg

SEQ ID NO: 88411 - DNA, 506 bp, Homo sapiens
  chr20:62488253-62488759
  hypo
agcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacctcggagaagagcaagcctgctgcagagtgacatgaacaccaggtctgtttctgtacgagccagtgacagaagacccctagataagactctctgtacgtatatgtttgtaggcaaatggaaggtgagaaagacacggtcccgactagcaagtctggatgtctacgaggagtgtgggaagaacggttaatcgcttcacatccctgcgtcactgtgtatgatgagaatgttacatttcgaataacaaaaatgagcacttatatcaaaaactggttattgcagtgagagaaaggaccctgctctagggtcttccaagccggggtgagcctggg

SEQ ID NO: 88412 - DNA, 74 bp, Homo sapiens
  chr20:62513823-62513897
  hypo
gagactcggcagggtcgccgagagctcagtgagcgagcaatgcacaggcggctcctcgccgcaggggcctctgg

SEQ ID NO: 88413 - DNA, 20 bp, Homo sapiens
  chr20:62586346-62586366
  hypo
taatcccacggaggccgagg

SEQ ID NO: 88414 - DNA, 162 bp, Homo sapiens
  chr20:62600647-62600809
  hyper
cagagacgcgactggcgccccggatgagaaggggcttcggccctcccgagcccagcggggacacagagccctcgcggggagagggggctccgccgcgctgcgcgcaggagacgccagcagcgggtccgccgcgtaggccgttcggcccgggaccccggccca

SEQ ID NO: 88415 - DNA, 98 bp, Homo sapiens
  chr20:62607076-62607174
  hypo
tcacgcacctgcaggcggagcacctgctgcagcacctcctgcctctgggcctcctgggccagccccatccgctgcagcttctccgcattcagccgcag

SEQ ID NO: 88416 - DNA, 30 bp, Homo sapiens
  chr20:62632965-62632995
  hypo
tggcacgtgcagacccgttgtgggtgttac

SEQ ID NO: 88417 - DNA, 98 bp, Homo sapiens
  chr20:62662173-62662271
  hypo
agtgtgaaattattccgtttggcaactgagacgaacccgaacagctgcccggagtggaggctcctcgtgttgtctcttgactacggtgcctctggctc

SEQ ID NO: 88418 - DNA, 247 bp, Homo sapiens
  chr20:62673837-62674084
  hyper
ctggacgcgggttcccgggtcgccttccggcctcgctcccgtcgggaggtcccgacacgggcttcctcgcagcctccccgcctggcccggcccgattttggccgctgcggtcaggggaagaggcggccggggctccccaccaggtgagcaggtcctgcccggcttgaggccaggggtccgggctgcggcccgagataagcgtcgcgcccgccgccgcttcctgcgcttccagcgccgccacttcctg

SEQ ID NO: 88419 - DNA, 15 bp, Homo sapiens
  chr20:62680216-62680231
  hyper
tgtagttggggtggt

SEQ ID NO: 88420 - DNA, 22 bp, Homo sapiens
  chr20:62680421-62680443
  hyper
cgcggcccgggacccctgcccc

SEQ ID NO: 88421 - DNA, 130 bp, Homo sapiens
  chr20:62680766-62680896
  hyper
ggccgcgcgtgtcagcggcggccccgtgtcccggggcccatgcacagtcgcggcgggcgggcgggtcgtcctgtgcgccgtagccgggcggcgatctctgcattccagctgggcgcggcctgggcggaac

SEQ ID NO: 88422 - DNA, 141 bp, Homo sapiens
  chr20:62694285-62694426
  hyper
ggggcccggtcgctccgggatgtctgagctctgggaggggcgtgcccggggcgcctccctcgcggggtattgtgggatcacgagtcactggcgacggtgggtcaggactacacttcccaggaggctgtgcgcgccgcgtgg

SEQ ID NO: 88423 - DNA, 290 bp, Homo sapiens
  chr20:62694477-62694767
  hyper
cgcgtggactacgcatcctaggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccggg

SEQ ID NO: 88424 - DNA, 30 bp, Homo sapiens
  chr20:62695018-62695048
  hyper
cgcagtcacaggctccgcacccttccctgt

SEQ ID NO: 88425 - DNA, 30 bp, Homo sapiens
  chr20:62695315-62695345
  hyper
ttcttctggagcttccgtgcctcccctgcc

SEQ ID NO: 88426 - DNA, 30 bp, Homo sapiens
  chr20:62701901-62701931
  hypo
gagcaccagatggcccgcactggcggcacg

SEQ ID NO: 88427 - DNA, 30 bp, Homo sapiens
  chr20:62705558-62705588
  hypo
catgctggttggcctcggccttcagctcct

SEQ ID NO: 88428 - DNA, 201 bp, Homo sapiens
  chr20:62714665-62714866
  hyper
agcgtccatactccccgcttccctcggggtcctggggagtggcagcaaaaagaccagcgagccttcggagaattataactttatgtgggaggctggggcgcgtcgcacactctcagtcgccgtcaccgcgggaagatggtgccatccacgttctcctccaggatggtctccacgcgcctccgctgccggggagagaggctg

SEQ ID NO: 88429 - DNA, 450 bp, Homo sapiens
  chr20:62715171-62715621
  hyper
cgcatgcgggtgtagcgcagccgcagggcgcggactcgcccgcgggcctccgctgccttgaggacgccgaggagccggttctggcgctcggcgggcagctcgagcgactgcgtccacgggcgcgggtcgggcatgcggtaccccggttccaccgacccgcacgggaaggtggaggccgccgcgcccacgtcctccagcaggtcgccgaagagcagatggcggtggcgctgcgcagggagcatggccgccagtccctgcggcgtcagggcccagcccggcttggggggctctgtcgcgggcgcccccttggcacgctcctcaccctgcgccgtgcctggcgcgctcttcccgcttcgctcccgcgggcccttgcgcccgccctccttcgctggcggcggcatcctcccgccctgcggagggaggagggcgtcccgtcggtgccggggctgg

SEQ ID NO: 88430 - DNA, 214 bp, Homo sapiens
  chr20:62722733-62722947
  hypo
acccgggtttcaccccgtctctgccactgtgacaggtggcctcacacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctgtcgagagctggccgggtgggggcattt

SEQ ID NO: 88431 - DNA, 101 bp, Homo sapiens
  chr20:62726693-62726794
  hypo
tagtcgggggggagccgggggatagcattggggacagcatgggcacagcatggggggcagcgtgggggtgggcaaggaacccttcacgtggattgtggatt

SEQ ID NO: 88432 - DNA, 749 bp, Homo sapiens; identical to SEQ ID NO: 38300
  chr20:62733381-62734130
  hyper

SEQ ID NO: 88433 - DNA, 163 bp, Homo sapiens
  chr20:62734172-62734335
  hyper
cgcctcacacctggctctgccgcgggcttggagcgggtgtctgggaaacacagtctcacttgtctcctcaaggggctccggggcaccgtaacagcgtgcagagcgcagtcaggctgccgtgctgctgctttgcgaggtgtgactgcagcgcagccaggaaaca

SEQ ID NO: 88434 - DNA, 115 bp, Homo sapiens
  chr20:62736331-62736446
  hypo
catggcacatgggcacggcggggctgggcctcctgctggaactccacttgggcttcaggccacgagagtggatttctgggtctcatgcggtgcaggtgtccgcctttgcagcaac

SEQ ID NO: 88435 - DNA, 46 bp, Homo sapiens
  chr20:62737744-62737790
  hypo
agcaccaccaggtatcggtccacgctcatcacggctaggaagtaga

SEQ ID NO: 88436 - DNA, 36 bp, Homo sapiens; identical to SEQ ID NO: 16700
  chr20:62762699-62762735
  hypo

SEQ ID NO: 88437 - DNA, 22 bp, Homo sapiens
  chr20:62766300-62766322
  hypo
cgaatcacaaacacacgctccc

SEQ ID NO: 88438 - DNA, 152 bp, Homo sapiens
  chr20:62767680-62767832
  hypo
gcatcacaaacacacacgctccctcagttgtcaggggactttgcactgtgcctttgcatgaaacaccatggcttgaagaggtcccgcatcgttagggcccccttgcccatggtgtggcgtcccctgaccgatttagccgttattgagggaca

SEQ ID NO: 88439 - DNA, 195 bp, Homo sapiens
  chr20:62784544-62784739
  hypo
tggccactcagaacacggctgcgctcccctgccgcctccttggggctcacaccttgctcggtttagtcgctgtctgagccttagttcctggtcataactgggctgtgcggggcttggggcctcatatgaggaggaactgatggcctgtgtgtgctggcagaggaggcggtgtcatcccggcgggtctctgcagat

SEQ ID NO: 88440 - DNA, 30 bp, Homo sapiens; identical to SEQ ID NO: 38302
  chr20:62793356-62793386
  hyper

SEQ ID NO: 88441 - DNA, 30 bp, Homo sapiens
  chr20:62796246-62796276
  hypo
aactgctctggaggacgggggctttcttct

SEQ ID NO: 88442 - DNA, 17 bp, Homo sapiens
  chr20:62815469-62815486
  hypo
gccgacagtgttatttt

SEQ ID NO: 88443 - DNA, 30 bp, Homo sapiens
  chr20:62819320-62819350
  hypo
ggagcagttgatccccgggatgctagtgct

SEQ ID NO: 88444 - DNA, 58 bp, Homo sapiens
  chr20:62832330-62832388
  hypo
aagaagcggtgattgcgacggcgagagatgctcagaaggaccccgagtaaagggaaga

SEQ ID NO: 88445 - DNA, 66 bp, Homo sapiens
  chr20:62839592-62839658
  hypo
ggatgatgacaaggacgaggacacccactcccggaagtcaacagtcactgacgagtcggagatgca

SEQ ID NO: 88446 - DNA, 30 bp, Homo sapiens
  chr20:62863399-62863429
  hypo
tcagaagccctttaacggctctgagttggg

SEQ ID NO: 88447 - DNA, 30 bp, Homo sapiens
  chr20:62863671-62863701
  hypo
cgacctgccccaccccgggctgtgacggct

SEQ ID NO: 88448 - DNA, 30 bp, Homo sapiens
  chr20:62868739-62868769
  hypo
ccaggtaggtggtgccgccccccgctcctg

SEQ ID NO: 88449 - DNA, 114 bp, Homo sapiens
  chr20:62871823-62871937
  hypo
cccagcccaccacaccgtttacctccctcgccctgccccgcaccgtggggatgcccaactcacagtgacttcccgtttggggcccggtgtggccgcgggcgggtttatccaaag

SEQ ID NO: 88450 - DNA, 30 bp, Homo sapiens; identical to SEQ ID NO: 46431
  chr20:62873290-62873320
  hypo

SEQ ID NO: 88451 - DNA, 124 bp, Homo sapiens
  chr20:62947861-62947985
  hyper
cgcggaagccccttccgagccccctcgggccgggaacgcgggaggaggcggcgccctgcgccgggaggccccagacaccgtgggcgggcggctgtgcgcggccaggctgcgtgggagcgggcag

SEQ ID NO: 88452 - DNA, 327 bp, Homo sapiens
  chr20:62948007-62948334
  hyper
cgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacggaggcggaaaggc

SEQ ID NO: 88453 - DNA, 274 bp, Homo sapiens; identical to SEQ ID NO: 1418
  chr20:644552-644826
  hyper

SEQ ID NO: 88454 - DNA, 382 bp, Homo sapiens
  chr20:644985-645367
  hyper
cggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatagccgccaccccaacccacggagcatggggccagcacggttgtacagagcgtaccttcactatc

SEQ ID NO: 88455 - DNA, 63 bp, Homo sapiens
  chr20:656222-656285
  hyper
tttaccaggaaggagcgcggcatggcgcggccggcgcggggctcggtgcggggaggcggccgg

SEQ ID NO: 88456 - DNA, 155 bp, Homo sapiens
  chr20:656542-656697
  hyper
gtcccccaggacaatcgctccgcacacgttcccctgaaccggcggcggtgggggcaggcccggagcaggcaggaggggagaaagtgagggcgagaaaggcgcagagacagagagggacggagaaaggggagtgaggggggcggggagaagaagag

SEQ ID NO: 88457 - DNA, 188 bp, Homo sapiens
  chr20:656937-657125
  hyper
aagagagggggaagccgaggggaacggagggaaagcggtcccgagcaggcggggttcaggcacatggggccgcagggaaggggatgcagaggaaagagtgcgcactggccagcggccaccctcccgcctccagtcctctccctctcccccagttctgaagtggccagggtggacgctcagctttcact

SEQ ID NO: 88458 - DNA, 27 bp, Homo sapiens
  chr20:673796-673823
  hypo
cagaaaactaggactcggacacaccag

SEQ ID NO: 88459 - DNA, 86 bp, Homo sapiens
  chr20:673883-673969
  hypo
gagagaggggtcctggcgaaaatgggttgcccccaagttcattcttgttgttcgcaatgttcagcgtcttgcggttgtgggactga

SEQ ID NO: 88460 - DNA, 47 bp, Homo sapiens
  chr20:6748423-6748470
  hyper
ccggggactggcagccgccgccgcacatctgccgccacagcctccgc

SEQ ID NO: 88461 - DNA, 300 bp, Homo sapiens
  chr20:6748763-6749063
  hyper
ccagggctaggagagcgaggggagagcacagccacccgcctcggcggcccgggactcggctcgactcgccggagaatgcgcccgaggacgacggggcgccagagccgcggtgctttcaactggcgagcgcgaatgggggtgcactggagtaaggcagagtgatgcgggggggcaactcgcctggcaccgagatcgccgccgtgcccttccctggacccggcgtcgcccaggatggctgccccgagccatgggccgcggcggagctagcgcggagcgcccgaccctcgacccccgagtccc

SEQ ID NO: 88462 - DNA, 30 bp, Homo sapiens
  chr20:688324-688354
  hypo
tttttggtaatagggcggcagtcctggtcc

SEQ ID NO: 88463 - DNA, 224 bp, Homo sapiens
  chr20:690677-690901
  hyper
cggggccgaggcccgcgcccccgccccgcgccgacaacttgattgggcaattaatcttcgcgccccccacaccccctcccggccccgggcctttgtgcgcccgagcgtgggccgtgggcgccccccgggccgcccggtctgctggcgcagataaggcgcccctcgccgcgcggccccgcctttgtcagggcgcccgcaggcccggccgccgcgctgccgtctcg

SEQ ID NO: 88464 - DNA, 251 bp, Homo sapiens
  chr20:708600-708851
  hyper
ccgggggcctgggaacggactggtgcttgcgtgcggggcttttccactggttcccttccgtactcgggcttcccccgctgttgttactccctcaacgggaacacaactccaccgccgcctccgggacacacccccgccgcgtgggccggggtccgggacgcgcgctcagctcggccccgcgggggcggcgcaggagggaagggggtgcggaccccggaggcgccgcaggaagccctcgcccacccttcccg

SEQ ID NO: 88465 - DNA, 213 bp, Homo sapiens
  chr20:741858-742071
  hypo
gctgaaaagcacccacgaggccacctgcggggccgggagggaagaggtgcagagtcacggggcttgcggggcgagcgccggagcaaagaactctcacagggctcaggggaacccacggaatactctctaggtgcgaggagcgccttctgggagtgagcctgcggggccgacgggtcccatgagttggccgcccgggggcgaaggagaatccag

SEQ ID NO: 88466 - DNA, 30 bp, Homo sapiens
  chr20:7958418-7958448
  hypo
agctaataacaaatacgattaaaccacttc

SEQ ID NO: 88467 - DNA, 30 bp, Homo sapiens
  chr20:796141-796171
  hypo
catcaagaacaataccgcaggccgggtgcg

SEQ ID NO: 88468 - DNA, 45 bp, Homo sapiens; identical to SEQ ID NO: 46068
  chr20:799104-799149
  hypo

SEQ ID NO: 88469 - DNA, 44 bp, Homo sapiens; identical to SEQ ID NO: 46069
  chr20:799689-799733
  hypo

SEQ ID NO: 88470 - DNA, 1765 bp, Homo sapiens
  chr20:8112233-8113998
  hyper
agactctcccccacccgccacacatcctacacactcaaggagaggagcgggagagggcaccctctttcttcctcggaaaataaaacctttgctttctttaggatgggctttctgtctcgaaagcacaacgtaaccgtttgcccgggtttcaagatcagcgcgctgcaaactctcaggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagccaggaggtgccgctgcgtccccgcttcctggcgcctgacccagcgtgcaaagttgggctgggagccgcggggggaaggaaggacccagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagttgccatcctttctgggtctggcaggcgccccctgagggtcttacatcttttgggccagtggagagggaggggcaagctttgcctggtgacaggtcctgagagttcggaaagtagggagtgtgaagttgggaccaactggaaagcgcctggtgtgaacaaatcgcgtccctctccgcctgcggacgcaccccctattacctcttttgcccgatttcaagaaggaaggacctgaagttcaaaacactttagtgattgcgaaccctcttggcgcttttgtgggagccaaggcggcggaggacacaacggtccagccaacaggtggtcgttgatgccaaacttcagcgcctggctccggagtgagggtccctgaaaagggctgcggggacacatctgg

SEQ ID NO: 88471 - DNA, 30 bp, Homo sapiens
  chr20:848500-848530
  hypo
aggcgtgagccaccgcgcccggccaatgac

SEQ ID NO: 88472 - DNA, 108 bp, Homo sapiens
  chr20:865993-866101
  hyper
tgagcctggcatcctcgcgaagcacgcacccccgcgcgcctccccggccctggagtccctgcagcccgacgatgagactcaagtgtggtggaacgtcctgtgcccact

SEQ ID NO: 88473 - DNA, 37 bp, Homo sapiens
  chr20:9048495-9048532
  hyper
gaggagggagccctccggagttcgggagcagcacgtt

SEQ ID NO: 88474 - DNA, 75 bp, Homo sapiens
  chr20:9049163-9049238
  hyper
gcccaccacctgcctcggctgctcggcccccggctcgcgaggctgcgcccccgacccagtcggcgcccactcctc

SEQ ID NO: 88475 - DNA, 203 bp, Homo sapiens
  chr20:9049467-9049670
  hyper
gggcccggcggtgggcgggcgggtcggcgctgccccgtgggctcgctggggagccacggcggagacccccgccctcaactgaggtaaggaccgcgcggcgcggagacggggaggcggggaggccagggagggggtgcggaggcaggcgggagggcgggactggggtgcgccgggagggggcttggcggcggctctttatggcg

SEQ ID NO: 88476 - DNA, 30 bp, Homo sapiens
  chr20:9376224-9376254
  hypo
aaacatcttagaggacgataatgaagagga

SEQ ID NO: 88477 - DNA, 50 bp, Homo sapiens; identical to SEQ ID NO: 37917
  chr20:9487096-9487146
  hyper

SEQ ID NO: 88478 - DNA, 509 bp, Homo sapiens
  chr20:9487211-9487720
  hyper
cggactttaggtggacccggaatggaaggagggtttttgctgcccgcatgcccccagggctctttccgggaaatagaagggcgagtcctttgcttccgcagcgtccggtgggaaaagatgccacgtggcgcggtgcgggcggactcagaggccccaggcgcccccgggaactgccacttactcagggcccgcggtccctggcgaaaacgggcgtggcgccagtgctcagaccgtgaagtggaaaaacggatcataacctcgcgttaaggggaaattcaggtttttttctctgagaaatgtatccttccctaaccaaaatccagcacctagggccacccatccctcggtccctgagcccaccctctccctgcaggcacagctatcccaggttccggcccatcaagttgggaaatgagacgatccatcagtgccaggctcccgggagctgcagctggctccaagtgcgtggccggaggcgtcccccatctgcacgagtccccagagtcacc

SEQ ID NO: 88479 - DNA, 159 bp, Homo sapiens; identical to SEQ ID NO: 37920
  chr20:9487788-9487947
  hyper

SEQ ID NO: 88480 - DNA, 184 bp, Homo sapiens; identical to SEQ ID NO: 37921
  chr20:9488328-9488512
  hyper

SEQ ID NO: 88481 - DNA, 446 bp, Homo sapiens
  chr20:9488726-9489172
  hyper
tgtctccagggctggcgccagccccgcgcacaaacaccgcttcctctgggtaaccgcctggactgcctgcgcgccctcggagcccgcctggttggcagtctctgcttcgatctcctctaagcagaatctattttctgtttggaaaatctcttacaggtcctggggttgtcccaggaccaaactgcagcgaggccgcgcgcccctggccctggaacgcagcatcctccccattttacctggaggctagatcgttggggctcttcgggggaatttccctgggcacggatactgtgctggcggtttagaaaagaaaaagaaaaagaagcgaagcctctgtaacctggtctcctccctctcctcggtttaataccctgcctcccctactagtctccaggcttttctctggacaggggagggacccgagaagcccgcggccagtgatcgcc

SEQ ID NO: 88482 - DNA, 261 bp, Homo sapiens
  chr20:9489455-9489716
  hyper
ccctgagctttggagcgggtttggacctagccgttgcaagtaggcatgacttttatcacccatcgctatacccagagcagctgctcgaatgtgccaaggagcccaactcgggtgcaaagcgccgacgtctttcccaggttgaggacatcgcgagccagaggtgcaggcagcgaggcgcccaacagtagaatgcatcttccttcccgcgggcagaagccgtcaagtctggagtccgcagcgggcgcgcgggccagcccaggg

SEQ ID NO: 88483 - DNA, 389 bp, Homo sapiens
  chr20:9495183-9495572
  hyper
atctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccgtgagtagc

SEQ ID NO: 88484 - DNA, 117 bp, Homo sapiens
  chr20:9495573-9495690
  hyper
atttggcgactgggagagaggacgggcactctttgcagagaacagagccggcaaagtaaagtcaattagcttgagataaaaaatatggcccttaatgttttgcggtgttttttcttt

SEQ ID NO: 88485 - DNA, 505 bp, Homo sapiens
  chr20:9496026-9496531
  hyper
gtctccccaccctagcgcccgagacgcgtgggctgagccctgaactgatggaattgttttgtttgttccgcagatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgtaaggaatctttcccccccctcagcttgctcctagggctccagggcgaagggcacccttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcacgtagagcatctaaccgcatgttcccggaacctgggatg

SEQ ID NO: 88486 - DNA, 402 bp, Homo sapiens
  chr20:9496580-9496982
  hyper
cgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaa

SEQ ID NO: 88487 - DNA, 30 bp, Homo sapiens
  chr20:9497348-9497378
  hyper
attttaattttcttccgcatcctggttttg

SEQ ID NO: 88488 - DNA, 135 bp, Homo sapiens
  chr20:9819189-9819324
  hyper
tgggttgagggtgggcggtcccctatccctaccctccaggcagcaggtccctagcctttgcatctcctaggagatgcaggatcgcgctgtcacagtggtcctcttcgcatcctctcccggcaaagagagatgctc

SEQ ID NO: 88489 - DNA, 322 bp, Homo sapiens
  chr20:9819466-9819788
  hyper
cgctcccagcgccatgttcccggtctccccgggcgcacgctggggaactactactggctgggtaggggcaaggggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgggaggcaggctgtagcggcggccgggggtggaggtgagggggagggtcggggggcgtgtctacactcagggtgcaggagccaggagc

SEQ ID NO: 88490 - DNA, 41 bp, Homo sapiens
  chr20:9819833-9819874
  hyper
cgtccccggcgggggcagctcctgcacgccctctcccccaa

SEQ ID NO: 88491 - DNA, 138 bp, Homo sapiens
  chr20:982661-982799
  hyper
cggtcctccggcccccggtctgccccgcagcgcctgcccggccgccctgcccagccaccccttgtaccttgcttcttccttcggttcagggcgagcatgtccacggcgtgggcgacgagcaggagcaggcagagtggc

SEQ ID NO: 88492 - DNA, 317 bp, Homo sapiens
  chr20:982891-983208
  hyper
gggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcaggtacagatgc

SEQ ID NO: 88493 - DNA, 34 bp, Homo sapiens
  chr20:9981583-9981617
  hypo
aaaaaaaaaaaaaaagtagcgaacacatatccta

SEQ ID NO: 88494 - DNA, 30 bp, Homo sapiens
  chr21:14752739-14752769
  hypo
agaagcgcctcttcacggatgacacaccat

SEQ ID NO: 88495 - DNA, 35 bp, Homo sapiens
  chr21:15309741-15309776
  hypo
tcggctgccagggcccgccgcgctgccccctcagt

SEQ ID NO: 88496 - DNA, 102 bp, Homo sapiens
  chr21:15383566-15383668
  hypo
gcaccgggggaggagcgccgaggccccagatgagcagtgggggaggagccccgaggcccccagatgagcagtgggcggggcagggagcgccgaggccatccc

SEQ ID NO: 88497 - DNA, 176 bp, Homo sapiens
  chr21:15442571-15442747
  hypo
ccttgtcgggacaagcgacgctgttagtgacattgtgagagaaagggctcgtagggctagggcggctgttcacccctgggcagccctggtagctctgggtgggtgaggaaagagggggccttgcaggtggggcggcaagggaaccaaaacaatccctcgggcggcaaggaggagga

SEQ ID NO: 88498 - DNA, 42 bp, Homo sapiens
  chr21:15442995-15443037
  hypo
gctcttggaggccggcggaaggtccagcgcggagacccacag

SEQ ID NO: 88499 - DNA, 62 bp, Homo sapiens
  chr21:15443988-15444050
  hypo
atgacagtgccttcccgacagaccctgcggcagaatgggagggggagcgtggagtccctgtc

SEQ ID NO: 88500 - DNA, 77 bp, Homo sapiens
  chr21:15444767-15444844
  hypo
aagccagggactccccgacgccccgggcctggcgcaggggctgccgggaaggcactgtcctccgtgggaggaacccg

SEQ ID NO: 88501 - DNA, 75 bp, Homo sapiens
  chr21:15446513-15446588
  hypo
cctgttcccttaccccggaggacttcttgccgctttggggtgtcccccatggacgtgacacgcaccctgggtgca

SEQ ID NO: 88502 - DNA, 107 bp, Homo sapiens
  chr21:15455882-15455989
  hypo
cagagaggtggatggcggtggattgtcccgcgctcctgtggttttaggtggccacgcatggaggatagatttcaaatatttccggagaggctcgagccacagtcatt

SEQ ID NO: 88503 - DNA, 555 bp, Homo sapiens
  chr21:15588356-15588911
  hyper
caagtccgctgggggcgtggccctggagccatgcctcgcccccagcgcgcgctcccggcgccggccccgccccctcacccaggcggcgccgtaaagccggagaaggggcggggtctcagctcctacttcattctacggccgagaccggaggatgttccctgctcaggaggaggccgacaggaccgtgtttgttgggaatttagaggcccgagttcgggaagagattctgtacgagctgttccttcaggtaccgtctctgggaaggggcggcggaggggcggagcacgtcgggccggaaacatagcgcgcacctggaccacccggagcccggcccccttccgtcccatcctgagcaggggttttaatttcgtttcctcttggcgcacctgtctccaggtgagcggctggggagtgaaatgagggcgcgttccccatccccatccgcgctgcagagtcctggggttgggcagggacgtggttccttcaacccccgtttctgattaagggcttcccagaggctgcctgggcctcgggtgtgcgcgggcagaaccgaaa

SEQ ID NO: 88504 - DNA, 34 bp, Homo sapiens
  chr21:15693964-15693998
  hypo
tttttttttttgagacggagtcttgctctgtcgc

SEQ ID NO: 88505 - DNA, 94 bp, Homo sapiens
  chr21:15694238-15694332
  hypo
tgagccaccacgcccagcctaggctaattcttacacaagctaattatactgatgatagcttgtatgtcgtggatagtaacgatctcaatatatt

SEQ ID NO: 88506 - DNA, 30 bp, Homo sapiens; identical to SEQ ID NO: 46436
  chr21:15762808-15762838
  hypo

SEQ ID NO: 88507 - DNA, 30 bp, Homo sapiens
  chr21:15955683-15955713
  hypo
atggccaaggaatggcgacagtggacactg

SEQ ID NO: 88508 - DNA, 23 bp, Homo sapiens
  chr21:16033840-16033863
  hypo
ttgcgtctatgaattcgactttt

SEQ ID NO: 88509 - DNA, 179 bp, Homo sapiens
  chr21:16438535-16438714
  hyper
tagcatttagtaattcgccatgaaaaaaattaccaggggaagcgagtgttgttgctgaaattgtttttgcttgacacaaaaaagctaaagtacagcttagtctcacccgaaattctgaaacggcatgcccgtgttaaaacacttattacataagacaaatgagccgatgaggcactcca

SEQ ID NO: 88510 - DNA, 211 bp, Homo sapiens
  chr21:18985471-18985682
  hyper
ctccccggcaaaaagcggcgctgaaggcctgtgggacccccgcccggccgccctacgtgcgtcagcgccttcgggggtcgcgcgggcttggtcctttcggctgtctcggcctttttgtttccccctcaggtctctccacgctgcacttgacaccctcagggcggaatggcgagttctagacccagctctctagacccggggcttcatgggg

SEQ ID NO: 88511 - DNA, 85 bp, Homo sapiens
  chr21:19274379-19274464
  hypo
atgtttttccaagtgcggcatttctaggatacagcatctggacagggaaaatgtttctgagcagtggagtagttaattttttttt

SEQ ID NO: 88512 - DNA, 96 bp, Homo sapiens
  chr21:19274828-19274924
  hypo
tgtagtactcagttacgtaaccaaacaccaatccaggtgtcactgtgaaggtatttcgtagatgcaattaacatctacggtcggttgattttaagt

SEQ ID NO: 88513 - DNA, 42 bp, Homo sapiens
  chr21:19517459-19517501
  hypo
aagtggcatttgggccgggcgcggtggctcaggcctgtaatc

SEQ ID NO: 88514 - DNA, 30 bp, Homo sapiens; identical to SEQ ID NO: 38308
  chr21:19617785-19617815
  hyper

SEQ ID NO: 88515 - DNA, 17 bp, Homo sapiens
  chr21:19668175-19668192
  hypo
agaatcagaataggccg

SEQ ID NO: 88516 - DNA, 172 bp, Homo sapiens; identical to SEQ ID NO: 46439
  chr21:20359980-20360152
  hypo

SEQ ID NO: 88517 - DNA, 40 bp, Homo sapiens
  chr21:20703497-20703537
  hypo
aaaagtatctttggccgggcgccgtggctcacgcctgtaa

SEQ ID NO: 88518 - DNA, 104 bp, Homo sapiens
  chr21:21264013-21264117
  hypo
tgagatctgatggttcgaaaccgtgtggaactcccccctcgttctctctctctcctgccaccatgtgaagaatgtgcttgctgcggggagcggtggctcacgcc

SEQ ID NO: 88519 - DNA, 35 bp, Homo sapiens
  chr21:22173764-22173799
  hypo
aattaaagttggagccgggcgtggtcgcggccacc

SEQ ID NO: 88520 - DNA, 303 bp, Homo sapiens
  chr21:22369922-22370225
  hyper
ccaacagcaatgggtcgagatgtagaggaaacactctgtacgttatttttccgcccaccctttagcgcctgaggagacagacagtgtagactttagggtacaattgcttcccctctgtcgcggcggggtggggagcgtgggaaggggacagccgcgcaaggggccagcctgctccaggtttgagcgagagagggagaaggaggtccacggagagacaagaatctccctcctcccacgcccaaaaggaataagctgcggggcacaccgcccgcctccagatcccccattcacgttgagccgggg

SEQ ID NO: 88521 - DNA, 111 bp, Homo sapiens; identical to SEQ ID NO: 38310
  chr21:22370236-22370347
  hyper

SEQ ID NO: 88522 - DNA, 128 bp, Homo sapiens; identical to SEQ ID NO: 38311
  chr21:22370348-22370476
  hyper

SEQ ID NO: 88523 - DNA, 181 bp, Homo sapiens
  chr21:22370552-22370733
  hyper
cgtgcagcgcggagggatacgcctcggccgcacctcccctcgccgcgcccccgcccccgccgccctccccgcccggctctgctgccgccgcggcggccgctgctgctgctgcttctgccgccgctgccgccgccgctgcctggatatagtgcggcaagagcggagcttgcagtcactttgc

SEQ ID NO: 88524 - DNA, 209 bp, Homo sapiens
  chr21:22370734-22370943
  hyper
aggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaaggtaggag

SEQ ID NO: 88525 - DNA, 30 bp, Homo sapiens
  chr21:25159328-25159358
  hypo
agggaatataatggccgggcatggtggctc

SEQ ID NO: 88526 - DNA, 41 bp, Homo sapiens; identical to SEQ ID NO: 46441
  chr21:25338183-25338224
  hypo

SEQ ID NO: 88527 - DNA, 30 bp, Homo sapiens
  chr21:25540338-25540368
  hypo
atctatcaagatgaccgtgtttgtttttag

SEQ ID NO: 88528 - DNA, 30 bp, Homo sapiens
  chr21:26734320-26734350
  hypo
aacacccacctttcccgaggtccctaccac

SEQ ID NO: 88529 - DNA, 25 bp, Homo sapiens
  chr21:26737217-26737242
  hypo
tgcgcccggccgagggatttttttt

SEQ ID NO: 88530 - DNA, 30 bp, Homo sapiens
  chr21:26785920-26785950
  hypo
attcactccccaccccgctgcaatctggtt

SEQ ID NO: 88531 - DNA, 659 bp, Homo sapiens
  chr21:26934159-26934818
  hyper
ggagcccaagccttgcggcgcggtgcaggaaagtacacggcgtgtgttgagagaaaaaaaatacacacacgcaatgacccacgagaaagggaaaggggaaaacaccaactacccgggcgctgggctttttcgacttttcctttaaaaagaaaaaagtttttcaagctgtaggttccaagaacaggcaggaggggggagaagggggggggggttgcagaaaaggcgcctggtcggttatgagtcacaagtgagttataaaagggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcaggtacgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcgcgcgcctgcgggtgccccctggggactcagtggtgtcgcctcgcccgggaccagagattgcgctggatggattcccgcgggcagaggcaggg

SEQ ID NO: 88532 - DNA, 67 bp, Homo sapiens
  chr21:27011420-27011487
  hyper
acctgacttccagcacgagtcttgattgcttttttttttctcgagttcgaggcggagcccgcgaacc

SEQ ID NO: 88533 - DNA, 30 bp, Homo sapiens
  chr21:27011609-27011639
  hypo
gggcaaaacaggaggcgtttccctacccgc

SEQ ID NO: 88534 - DNA, 349 bp, Homo sapiens
  chr21:27011772-27012121
  hyper
gtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgc

SEQ ID NO: 88535 - DNA, 28 bp, Homo sapiens
  chr21:27012148-27012176
  hyper
cgccaccgcctcctcctgctgctgctgc

SEQ ID NO: 88536 - DNA, 548 bp, Homo sapiens; identical to SEQ ID NO: 38317
  chr21:27012177-27012725
  hyper

SEQ ID NO: 88537 - DNA, 30 bp, Homo sapiens
  chr21:27184709-27184739
  hypo
aacattccaataagacgatataaaaatgac

SEQ ID NO: 88538 - DNA, 62 bp, Homo sapiens
  chr21:27541809-27541871
  hyper
actgccctttccagacgcacatcccactctccgccttatttcctccccgccaaggactttac

SEQ ID NO: 88539 - DNA, 75 bp, Homo sapiens
  chr21:27543433-27543508
  hyper
tgaatcatccgaccccgcaggcctcccgggggtgtcgtataaaggactgctgctagggtgcgtttttatccgcat

SEQ ID NO: 88540 - DNA, 235 bp, Homo sapiens; identical to SEQ ID NO: 13934
  chr21:27944913-27945148
  hyper

SEQ ID NO: 88541 - DNA, 38 bp, Homo sapiens
  chr21:27945604-27945642
  hyper
cgggcagggggcgggggtggccccgactcctccccaag

SEQ ID NO: 88542 - DNA, 55 bp, Homo sapiens
  chr21:28215942-28215997
  hyper
cccaagcaggttctgcgaaggggccccaccgccttcagcccgcctgggtcagcct

SEQ ID NO: 88543 - DNA, 360 bp, Homo sapiens
  chr21:28216223-28216583
  hyper
gcacaagctccaactcgctaaaggtggaaggagtcaggttacaaactctccctccccggcctaaatgctttgctttagtttgcagaaaatcgtttgtcagtttttttcttggttattcattattcgggcaaatgcaagtatgttttctagctgagttcaccaatccaaacctcaaaccacattcctccactccaggcctccgttctgtccgcggacttatgatcctgcctgccagcaggagtctaccctgaagtcgcgtgggatagataaagtgaggagaggaggatgaatggacagacaaacgagagcaattcttctacctgtgggctgtcctacgccttgcagtgccgggtcctgcgg

SEQ ID NO: 88544 - DNA, 1300 bp, Homo sapiens; identical to SEQ ID NO: 38320
  chr21:28216633-28217933
  hyper

SEQ ID NO: 88545 - DNA, 1300 bp, Homo sapiens; identical to SEQ ID NO: 38320
  chr21:28216633-28217933
  hypo

SEQ ID NO: 88546 - DNA, 81 bp, Homo sapiens; identical to SEQ ID NO: 13938
  chr21:28218267-28218348
  hyper

SEQ ID NO: 88547 - DNA, 166 bp, Homo sapiens
  chr21:28218552-28218718
  hyper
tttttcttcttcattcgagaaatgatcggctcccgccagtctgcgtgctttcactcaacagcagctgcaagccctaggccagcgtcgcagaaacggccaggaaccccactttcctacccgggggccagcagcgatcgctggggctagcaagcgtgcagagggggaa

SEQ ID NO: 88548 - DNA, 196 bp, Homo sapiens
  chr21:28218958-28219154
  hyper
cgcaaccctcacactcgcgcgcccccgcgttagtgctcgaactggtctccgcctttccgccccactcccgtccggtctcttggttggctccaagtagatctgggtcctttcctcgctcctccccagatcttccccacttcagttggccccagccagaagcgtcccttctagttctcccacacgtccctcttacaag

SEQ ID NO: 88549 - DNA, 30 bp, Homo sapiens
  chr21:28338210-28338240
  hyper
ggctttagggtgtagcgcgcgtgcttgacc

SEQ ID NO: 88550 - DNA, 238 bp, Homo sapiens
  chr21:28338515-28338753
  hyper
cgccagggggtgcgggtggccgggaggctcggctcgctcctgcacctcctccccctgccgccggcggggctgggcggctgctgcagcagtcggaggctgcccggctttatcctgggcaggtgtcgcggcggggccgaccgcggccaggggcaggcggaacgcgcacagcagcagggacgcccacccgagcagcatagtgcgctgcccgcggggaggggctgcgcgactgggactttat

SEQ ID NO: 88551 - DNA, 294 bp, Homo sapiens
  chr21:28339162-28339456
  hyper
ggaggttccaagctccggggcccacttcctttcttattttgtgggtttccttggctctgctgggaccaggaggaagggaagaaagagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctg

SEQ ID NO: 88552 - DNA, 56 bp, Homo sapiens
  chr21:28339851-28339907
  hyper
gtgggaagttcctgccgcaagtttttcccctttgcacacccgtgcgctctggcctc

SEQ ID NO: 88553 - DNA, 141 bp, Homo sapiens; identical to SEQ ID NO: 38327
  chr21:28339908-28340049
  hyper

SEQ ID NO: 88554 - DNA, 286 bp, Homo sapiens; identical to SEQ ID NO: 4860
  chr21:28340062-28340348
  hyper

SEQ ID NO: 88555 - DNA, 30 bp, Homo sapiens
  chr21:28793121-28793151
  hypo
ttattggcacaaattcgggcagcctccagg

SEQ ID NO: 88556 - DNA, 135 bp, Homo sapiens
  chr21:30275964-30276099
  hypo
tgcctctgtgcttcccgccgccaggctgaggaggctgctgggcagcagccgccatgatgtgtgcaagctgagaggaaagagaaacgtttctccactgcagttggcgtcctcacctcccggcgaacttctccacgg

SEQ ID NO: 88557 - DNA, 44 bp, Homo sapiens
  chr21:30653794-30653838
  hypo
taataaagacacacccgagtggctgggcgcagtggctcacgcct

SEQ ID NO: 88558 - DNA, 30 bp, Homo sapiens
  chr21:30973204-30973234
  hypo
ccccaagtaaattttcgtatttatgcaatt

SEQ ID NO: 88559 - DNA, 165 bp, Homo sapiens
  chr21:31015159-31015324
  hypo
tcataaatctgggtccgaggcgccatggcttatgtctatggcactgcagggagctgacggtcagctgggatgcccggtgcgaggcaatggccaccatgtacacagcatcgtacatcagagccgcttcagtctgtggaggaaaacacacaccgcatcttaaattcc

SEQ ID NO: 88560 - DNA, 44 bp, Homo sapiens
  chr21:31057107-31057151
  hypo
gcgtgagccaccacacccggctgcaaaaacgcaattacttttgc

SEQ ID NO: 88561 - DNA, 190 bp, Homo sapiens
  chr21:31059342-31059532
  hypo
agagacgaggcgagacgaaactttgctcctcctaagagttctccagagtctttcgacattttatcttctagaggacagaattctgcttgctagtatttagcgaattgaattttgtccttagagacgtgcacactgctcccattgacttcaatgggagtaatgggccatttggtcccgcgacatctgtgtt

SEQ ID NO: 88562 - DNA, 248 bp, Homo sapiens
  chr21:31311386-31311634
  hyper
cggctcgcgatcccttgcccagagtaggggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacc

SEQ ID NO: 88563 - DNA, 220 bp, Homo sapiens; identical to SEQ ID NO: 38330
  chr21:31311700-31311920
  hyper

SEQ ID NO: 88564 - DNA, 102 bp, Homo sapiens; identical to SEQ ID NO: 4862
  chr21:31312079-31312181
  hyper

SEQ ID NO: 88565 - DNA, 19 bp, Homo sapiens
  chr21:31312405-31312424
  hyper
actgatcaagatactcgcg

SEQ ID NO: 88566 - DNA, 19 bp, Homo sapiens
  chr21:31312484-31312503
  hyper
cacacgctcttttttctct

SEQ ID NO: 88567 - DNA, 17 bp, Homo sapiens
  chr21:31347914-31347931
  hypo
gacgactgatcaagact

SEQ ID NO: 88568 - DNA, 30 bp, Homo sapiens; identical to SEQ ID NO: 46447
  chr21:32592616-32592646
  hypo

SEQ ID NO: 88569 - DNA, 23 bp, Homo sapiens
  chr21:32677003-32677026
  hypo
ttttatttttgagaccgagtctc

SEQ ID NO: 88570 - DNA, 263 bp, Homo sapiens
  chr21:32716235-32716498
  hyper
gccggcaacgcgcgccgagcctcggggcgcagcttggagacgcgcttgctcgttctgggaaggggcacgggacgcacggttccccggccccagctgcacagctcagctcggggctctcacctatcctcgttcagagccacattcggctgcctcccctgaccacccgacacaaagagattcgccggtggaaagaatcgatttcaaaattcaagctcaccgctgctcaacaaggcgcgcacgtttctccccgtctggcttcacat

SEQ ID NO: 88571 - DNA, 19 bp, Homo sapiens
  chr21:33143333-33143352
  hypo
tttttttttttgagacgga

SEQ ID NO: 88572 - DNA, 55 bp, Homo sapiens
  chr21:33244992-33245047
  hyper
ggccctactgtgtggcggactcagggccgggcacgcaacccgactcacagtccac

SEQ ID NO: 88573 - DNA, 152 bp, Homo sapiens; identical to SEQ ID NO: 38334
  chr21:33245337-33245489
  hyper

SEQ ID NO: 88574 - DNA, 84 bp, Homo sapiens
  chr21:33245793-33245877
  hyper
ccgctattgtctacgcgcctcgctgggcggcgcggggggcgtgatcgcggcggccccgggctctgggtgcggagacccaggcgg

SEQ ID NO: 88575 - DNA, 274 bp, Homo sapiens
  chr21:33246140-33246414
  hyper
ttccagcaccacaagcgcgtgggcaactacctcatcggcagcaggaagctgggcgagggctcctttgccaaggtgcgcgaggggctgcacgtgctgaccggggagaaggtgagtctcccgggcgccgtggggctggggcacaggggcgggagtcggcggccaggaccccgcggggagcactgcactgggagtcccagtgtgcagtcccgggccaagcgccttccccctccgcccggctttcctgttgggttaaaacgcgcgctcagcatctcgc

SEQ ID NO: 88576 - DNA, 23 bp, Homo sapiens
  chr21:33491252-33491275
  hypo
actttcttcttctttcgcatcct

SEQ ID NO: 88577 - DNA, 164 bp, Homo sapiens
  chr21:33579243-33579407
  hypo
gttcagtttcacaaacgccaaactgtgagccacccaccacggctgccagaagattccttcccctgcacgcccctttcctcatgggcttactttgggatcaaaatcttaataaggggcatctgattgatgaagtctaaattccacgcctgcgccccagctgtaat

SEQ ID NO: 88578 - DNA, 17 bp, Homo sapiens
  chr21:33604215-33604232
  hypo
tccgtctcaaaacaaaa

SEQ ID NO: 88579 - DNA, 30 bp, Homo sapiens
  chr21:33614037-33614067
  hypo
agctcagaggcaaagcggtaacatttcact

SEQ ID NO: 88580 - DNA, 76 bp, Homo sapiens
  chr21:33627506-33627582
  hypo
cttctaatttttctacggtaaaaatacatttcttgggtactttttttttttcttgagacggagtcttgctctattg

SEQ ID NO: 88581 - DNA, 84 bp, Homo sapiens
  chr21:33628811-33628895
  hypo
gtgtgctggttttcccgggacaattgacatctgtcatcccgacttaattattagacattccctgtttcgcgaatgtgccctgat

SEQ ID NO: 88582 - DNA, 30 bp, Homo sapiens; identical to SEQ ID NO: 46448
  chr21:33630406-33630436
  hypo

SEQ ID NO: 88583 - DNA, 197 bp, Homo sapiens
  chr21:33694545-33694742
  hypo
aaaatatgagaatgtcgtaaaactcaggactctgaagcagagtttttaaggtttgaggcgccatgtagaagtgagccaacagcacggagacattccgaagtgcaggcctgcgtggccaccgactgcacaatcgtgttggccgtgcagcatacaggatccatggggaaatgtcagaatgacaacggtggctgcatcat

SEQ ID NO: 88584 - DNA, 30 bp, Homo sapiens
  chr21:33720348-33720378
  hypo
acactccacctgccccggaaggactggact

SEQ ID NO: 88585 - DNA, 125 bp, Homo sapiens
  chr21:33721756-33721881
  hypo
gagctgcaggaggggcgggcccacacttctgcccagctgtgaggacaagagcacgagcctcagcagggaagagacgggttcacagctaccaggcagtgacttccagggcccgtgttttcagagca

SEQ ID NO: 88586 - DNA, 134 bp, Homo sapiens
  chr21:33754456-33754590
  hypo
atttcacttagacggcggggagggctgagatcaaaagagatgggtggggagggcatctgatggataattattgccaggcttactgccaggtaagaccaaagaaccgtgatatttgccctcgtctgcaaatagca

SEQ ID NO: 88587 - DNA, 49 bp, Homo sapiens
  chr21:33784031-33784080
  hyper
acactgtgtgcctagcgcccgccctcctcccttccgccggccccgcgcg

SEQ ID NO: 88588 - DNA, 53 bp, Homo sapiens
  chr21:33784912-33784965
  hyper
ctctcggggaaactacgcggatccttttcggggatcctcgccccgccccagtt

SEQ ID NO: 88589 - DNA, 30 bp, Homo sapiens
  chr21:33805592-33805622
  hypo
ggtttgcctcctgtgcgtatgttggttggg

SEQ ID NO: 88590 - DNA, 202 bp, Homo sapiens
  chr21:33855579-33855781
  hypo
gggtggcctgtctggcgcccgaatgtgcagcagtgactattcctgctatactggttgagctaaacttgcccttcacaaagacagacttgacgtttctggcatttggtatagacaggcacttaaaacattctcttaaagctcaatagacttcttgacttgctgtgtttactcttcattcatgaagacccgccagagtagctcc

SEQ ID NO: 88591 - DNA, 28 bp, Homo sapiens
  chr21:33945034-33945062
  hypo
ggtctgaaggaggcggagctcaggccta

SEQ ID NO: 88592 - DNA, 278 bp, Homo sapiens; identical to SEQ ID NO: 46451
  chr21:33954157-33954435
  hypo

SEQ ID NO: 88593 - DNA, 30 bp, Homo sapiens
  chr21:33958272-33958302
  hypo
ggagcaagcaagagtcgatattcctgttaa

SEQ ID NO: 88594 - DNA, 84 bp, Homo sapiens; identical to SEQ ID NO: 46452
  chr21:33983236-33983320
  hypo

SEQ ID NO: 88595 - DNA, 30 bp, Homo sapiens; identical to SEQ ID NO: 46453
  chr21:34127723-34127753
  hypo

SEQ ID NO: 88596 - DNA, 155 bp, Homo sapiens
  chr21:34392013-34392168
  hyper
ctggttctcaagagccgggtgtaaggaaggaaaatcaaagattgaatttagatgtatgtattggaggggaatattggaggaagggggagcaggggagcacgcccagcctcctctcctgtctttcccgcccccttgtctaaactcaaaaccgagtc

SEQ ID NO: 88597 - DNA, 199 bp, Homo sapiens
  chr21:34392205-34392404
  hyper
cgttgcgggctgaacccatccggcacaaactgcgggccactggcccctcacacctgggagtttgcggcgctggcctgcagcccggggcccacgtggcggaagctttcccgggcgcgcgctgcgcagccccgcggggccggggagacaccgctcgggagtcctccgctcggctgcagaatctttatcagctgcactttac

SEQ ID NO: 88598 - DNA, 902 bp, Homo sapiens
  chr21:34392436-34393338
  hyper
cgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctggatgctacaggggctcaaggaggggtggaggggccttcccaggccaacccctgaacggcttggacaagatgctcagatggacgggaggaacggcgtgtgggatgggggagctggaggcgggtgggtgggggggggaggatggggaaagcgctggcccacccagtgtgggaggggtagaggaaaagcccgcaggggccaggttgggaccccgtaggccgggttagagggcttggacttgatcctgacaggcgacagggagacata

SEQ ID NO: 88599 - DNA, 1774 bp, Homo sapiens
  chr21:34394993-34396767
  hyper
tttgtgagaaagacacgccatttgtttgcagagttctgacttctgaggggtcatgtagcacatgtttggtagccaaacgctgtcattcacgaccaggagcgatggctgcaatgcctttttctttgctttgctttccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctggagccccgcgagagcccgccggtttggcacgggctcctcccgggccgcccggcggtccaacaaaggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaa

SEQ ID NO: 88600 - DNA, 789 bp, Homo sapiens
  chr21:34396987-34397776
  hyper
tacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggt

SEQ ID NO: 88601 - DNA, 141 bp, Homo sapiens; identical to SEQ ID NO: 13950
  chr21:34397990-34398131
  hyper

SEQ ID NO: 88602 - DNA, 67 bp, Homo sapiens; identical to SEQ ID NO: 13951
  chr21:34398132-34398199
  hyper

SEQ ID NO: 88603 - DNA, 22 bp, Homo sapiens
  chr21:34398200-34398222
  hyper
ctgccaccgggctataaaaacc

SEQ ID NO: 88604 - DNA, 1036 bp, Homo sapiens
  chr21:34398223-34399259
  hyper
gccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcag

SEQ ID NO: 88605 - DNA, 664 bp, Homo sapiens; identical to SEQ ID NO: 1505
  chr21:34399441-34400105
  hyper

SEQ ID NO: 88606 - DNA, 309 bp, Homo sapiens
  chr21:34400231-34400540
  hyper
cgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcac

SEQ ID NO: 88607 - DNA, 404 bp, Homo sapiens
  chr21:34401144-34401548
  hyper
atgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaagtcgggggatttccatccgtgtgccaccccgaaaaggggttcag

SEQ ID NO: 88608 - DNA, 113 bp, Homo sapiens
  chr21:34442144-34442257
  hyper
tgctggaggaaggcacgtgagttgcagcctgaccagtgcgaccagtcctccttcaacagccccgcttgccttgaaaaggcgcccttactccgctcagggggcctgtcccgcgc

SEQ ID NO: 88609 - DNA, 1769 bp, Homo sapiens
  chr21:34442594-34444363
  hyper
gggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtac

SEQ ID NO: 88610 - DNA, 154 bp, Homo sapiens; identical to SEQ ID NO: 1508
  chr21:34444444-34444598
  hyper

SEQ ID NO: 88611 - DNA, 95 bp, Homo sapiens; identical to SEQ ID NO: 16704
  chr21:34459377-34459472
  hypo

SEQ ID NO: 88612 - DNA, 113 bp, Homo sapiens
  chr21:34466080-34466193
  hypo
caggttcctggctggcgacggggtgcccctgggtaaagctcccctccagagggtgcccccatgaccagggctttgctggaagcagccttctgatgagacgctaccagattaga

SEQ ID NO: 88613 - DNA, 103 bp, Homo sapiens
  chr21:34466627-34466730
  hypo
aatccaaaaaaattacgtatgtatttttatctgtattacaagtctattcacatgtaagttatagaagaaagctattctagaaaatacaccaaaacaggccggg

SEQ ID NO: 88614 - DNA, 80 bp, Homo sapiens
  chr21:34471025-34471105
  hypo
caaattgcccgtctacgttcttagaagactgaggaggatgtatgagacgaagatttaaaaaacgcagctgggtgcgatgg

SEQ ID NO: 88615 - DNA, 422 bp, Homo sapiens
  chr21:34481844-34482266
  hyper
cgtctacaaaacacacgagggacctagaaaccaacagacccatcccatctctctcaggttcagcaattctttccttcctcggagggcgtttctgataggacaagctgggcccgggcggattctcaccccaccaccccaactccaggcttgggtccatctgccgccagtggtgacttgggtggcgccctccgcagcagacagccgtgcgccctcggcgacccggtccctgcgctccggcgcccgcaggtcctcgctcccggcttctgcacctcccgctccgggacatctggctgagccgcgcctccctctccccgcagcctccgccggccccgcctcccctcaccacccttcccttgtttggggcggtaaggtcagaagcgttcaacaattcaacgtgggaagtctctcggaggaagtgccag

SEQ ID NO: 88616 - DNA, 30 bp, Homo sapiens
  chr21:34494179-34494209
  hypo
tggcccatgggatggcgtctcctgccaagg

SEQ ID NO: 88617 - DNA, 62 bp, Homo sapiens
  chr21:34499655-34499717
  hyper
tgctggggttgaagccgcttgtttgagttttccagctctaatcagatcgtcctccaaagagg

SEQ ID NO: 88618 - DNA, 223 bp, Homo sapiens
  chr21:34508376-34508599
  hypo
agcaggtggatggttcgtttccaagaagctgagctgggctgaagcacgcagcgtgtccgttgctgctccactgaacctccagctggatttccatgtggtggtgcaggcgaggggccgtgccgattcattatgacaaaatgacatatcaaaaaggttttgctggcctgcgaaagatgcccaacagcagatatgcattatcttataagttaagaatgctgtcttt

SEQ ID NO: 88619 - DNA, 86 bp, Homo sapiens
  chr21:34525146-34525232
  hypo
cccaatagaacaaagcggagaaagactaaccagggcgactttgattcctgccatcctcgaaacaacacagtgttcaaagatcaggc

SEQ ID NO: 88620 - DNA, 30 bp, Homo sapiens
  chr21:34538805-34538835
  hypo
ggttttccttctcaacgagctgtatggcct

SEQ ID NO: 88621 - DNA, 30 bp, Homo sapiens
  chr21:34637000-34637030
  hypo
aagggaagtctggcccggagcaattgctcc

SEQ ID NO: 88622 - DNA, 167 bp, Homo sapiens
  chr21:34675270-34675437
  hypo
ccctggagggagctgcggtcaaggtctcaggcccctgctggccatgctcttatgcacacctgtgttcccagccttgcacgtgtgcccaaggccttcttcaggcacctcaactaaggcctccttattctcagggagtagggaagggggagccacgaagacattgttat

SEQ ID NO: 88623 - DNA, 81 bp, Homo sapiens
  chr21:34927282-34927363
  hypo
aagacagttagagctcgaagtcgaaccccaagtcgtcggagtcggagtcatactccaagtcgtcgacgaaggtctagatct

SEQ ID NO: 88624 - DNA, 30 bp, Homo sapiens
  chr21:35426849-35426879
  hypo
tgttggcaaagctttcgagaggagctgaga

SEQ ID NO: 88625 - DNA, 303 bp, Homo sapiens
  chr21:35574350-35574653
  hyper
gctcggccaatgagacgcaattctgcaaactcggctgagcggtggaaaattccatgctctcggcgctgccctcggtggcggccctggcgggatcgcgcgctcggaatgccgcagcccggccgccgagtggccaccagctggggaagagctgagcgaaaccgccccggggtccaggcgttttgccacgagtcgccgtgcgacaagttggggtctcccttgttctcccacctctctgcaccaaaagctcttgaagcaaattaaagaaagcaggcgatgcttgtatcattgcggagtggggaatgg

SEQ ID NO: 88626 - DNA, 30 bp, Homo sapiens
  chr21:35755245-35755275
  hypo
ttagtaatagggccccggccaggtgcagtg

SEQ ID NO: 88627 - DNA, 205 bp, Homo sapiens
  chr21:35819430-35819635
  hypo
tcacactgcgggtcacgtgcactctgggtctctctctgcaaacctgccctgcctcagtctgggaatatgcaactgcctaagaagggtctggcttacacaggggccatgagacgtggcaggcatagctgggctgctactggtcatgaatcctggacacggcaggcaaggtgtggtgtccatatgcattattcgggtggggcaaaga

SEQ ID NO: 88628 - DNA, 46 bp, Homo sapiens
  chr21:35832327-35832373
  hypo
aacctccgctcccgacgactctttctagcctcgtcccgcaccccag

SEQ ID NO: 88629 - DNA, 30 bp, Homo sapiens
  chr21:35947071-35947101
  hypo
tgagcacgttctcctcgggtgcctcccgcg

SEQ ID NO: 88630 - DNA, 19 bp, Homo sapiens
  chr21:36005713-36005732
  hypo
caggcgtgagccaccgtgc

SEQ ID NO: 88631 - DNA, 96 bp, Homo sapiens; identical to SEQ ID NO: 1509
  chr21:36041933-36042029
  hyper

SEQ ID NO: 88632 - DNA, 79 bp, Homo sapiens; identical to SEQ ID NO: 1510
  chr21:36042091-36042170
  hyper

SEQ ID NO: 88633 - DNA, 1139 bp, Homo sapiens
  chr21:36042171-36043310
  hyper
cggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaacccttggtggtatcctgattgtcatcaggcgcttccatgcgcgggcggtaggcgggacagccgggatttcccggagaagagtttccagggcatttgcgggaggactcaatggtttggaagcaaagactttgggggtgggggcgacggggagtgcgatgg

SEQ ID NO: 88634 - DNA, 190 bp, Homo sapiens
  chr21:36596361-36596551
  hypo
gatttaactatgatacggttacaagaaaacaaataatttcctcattgacaatttttcctgaagggctctcttcccaatacaattcccttctcaatacagttgaccagtatttaaatgagtcaatatccccgaaagttgaaaatatcagaaattctggattgttaaaaaaaaaatacgtcttctggataat

SEQ ID NO: 88635 - DNA, 30 bp, Homo sapiens
  chr21:37430856-37430886
  hypo
agctatgtgttaggccgagcatgctggctc

SEQ ID NO: 88636 - DNA, 109 bp, Homo sapiens
  chr21:37527928-37528037
  hypo
acaagtggcccacttcgggttggctggagccacagctgggtggggacagggcctgtgctcaggtgagcactgcctaccgcgcaccctccaggtgcgtcctaccctgaag

SEQ ID NO: 88637 - DNA, 30 bp, Homo sapiens
  chr21:37565748-37565778
  hypo
acgcctgtcacagggcgttcaggggagaag

SEQ ID NO: 88638 - DNA, 30 bp, Homo sapiens
  chr21:37619012-37619042
  hypo
tgatggtttttataacgaatgactgttttg

SEQ ID NO: 88639 - DNA, 19 bp, Homo sapiens
  chr21:37632345-37632364
  hypo
tgggaggctgaggcacgag

SEQ ID NO: 88640 - DNA, 23 bp, Homo sapiens
  chr21:37699121-37699144
  hypo
ttttttttttgagaccgagtctc

SEQ ID NO: 88641 - DNA, 33 bp, Homo sapiens
  chr21:37704743-37704776
  hypo
taggacaggcttcagaaccggaacaggttctaa

SEQ ID NO: 88642 - DNA, 133 bp, Homo sapiens; identical to SEQ ID NO: 46460
  chr21:37750031-37750164
  hypo

SEQ ID NO: 88643 - DNA, 46 bp, Homo sapiens
  chr21:37754435-37754481
  hypo
atgttgaccacctatcgggtatgtcttagcccgggcaaactgaggc

SEQ ID NO: 88644 - DNA, 145 bp, Homo sapiens
  chr21:37758492-37758637
  hypo
acttccagcatgggacggctgggaggatccacagactggcgtctgccggcgtggacaccaatgtcagggtaaactggggcagagatagacatccgggaacactgcttgaagcaatagttttcattcttttacttaaaaccagtgt

SEQ ID NO: 88645 - DNA, 120 bp, Homo sapiens
  chr21:37775052-37775172
  hypo
caggcaagaagctaccggatgtttcacgacgacagcatgaagtctttcttccgtagactgagtttcactcccgacggatctttgcttctcacgccaggtgtgtttcgtagctttggactt

SEQ ID NO: 88646 - DNA, 30 bp, Homo sapiens
  chr21:37780714-37780744
  hypo
agctgaatctagtcacggtgcttcaatcga

SEQ ID NO: 88647 - DNA, 23 bp, Homo sapiens
  chr21:37781166-37781189
  hypo
ttttagacggagtttcgctcttg

SEQ ID NO: 88648 - DNA, 83 bp, Homo sapiens
  chr21:37781609-37781692
  hypo
cttttatttttgcttttgcttagtcacagtgccttttcctaacactgcaattaatccattaggcccatcgctcatcttccatg

SEQ ID NO: 88649 - DNA, 210 bp, Homo sapiens
  chr21:38063485-38063695
  hyper
ataactagaaaaagacggttactgtcaaataattgttcaaaggagttttgtacaaatataaattttgtaacttcacttggagccttttttcttttcttctagttaggaattttctctgtgtttgaattattgcctttctaatcctcagctgacgttttgcagcttttaagggatcgctgtggctacagcaggaaacgttcctgctccatg

SEQ ID NO: 88650 - DNA, 97 bp, Homo sapiens
  chr21:38064515-38064612
  hyper
gcacactcgcaccaccgccgcctctcccacaaagagaaaagccacgagaagggtcccgactgtgcaaatctgtgtgccctcccgaggaaggcgcccg

SEQ ID NO: 88651 - DNA, 525 bp, Homo sapiens; identical to SEQ ID NO: 38360
  chr21:38064998-38065523
  hyper

SEQ ID NO: 88652 - DNA, 355 bp, Homo sapiens
  chr21:38065799-38066154
  hyper
cggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgacccggagcagctctaggccgtgggcttcgtctcctcctcctggaaggaatgaatgggctccccgacacacacctctcagaaaactcacctttcacgctgaccttcaaaagaaaagaaagaaagaaaaagaaaaatccgctcgaagcgggaaaatgtccacgcccggatttggggtggacacgcgccccggcctggctggagg

SEQ ID NO: 88653 - DNA, 176 bp, Homo sapiens
  chr21:38066809-38066985
  hyper
gggggtgagggggagcgagatgaggtcgtcgctggacgctgggctcccttgtcgttgtccttttccccagaatccatggtcaggcctagggagccacccctgggtgctcgagatgagtccccaccctcactgaaggtcggtcactggatgtttgtgtgcatcgtaaggggcccacc

SEQ ID NO: 88654 - DNA, 162 bp, Homo sapiens
  chr21:38067345-38067507
  hyper
gcacatgaaccaagacgatcagcttcaggcagctccttacccccacaagcggcccaggaggtgggcattatcccccacccctgggatttctccatccctccctcttctctcctgcgggagagagagctgtggtcacccagttgggcgcgatggctctggact

SEQ ID NO: 88655 - DNA, 30 bp, Homo sapiens; identical to SEQ ID NO: 38364
  chr21:38067871-38067901
  hyper

SEQ ID NO: 88656 - DNA, 52 bp, Homo sapiens
  chr21:38068178-38068230
  hyper
tagcctctcccatcccgcggggaacggccggagttcttcccttgatctctcc

SEQ ID NO: 88657 - DNA, 137 bp, Homo sapiens
  chr21:38068646-38068783
  hyper
cgcgaggctggtccgggctttctgagctgggcgttcggctttaggcccaatacctggaccaggaatttcttctccccgcgccagaagggaaagacataggaggtgtcccaatctgcggtcaccgccgatgctcctga

SEQ ID NO: 88658 - DNA, 682 bp, Homo sapiens
  chr21:38069124-38069806
  hyper
cggcgaaaggatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccccttggagctccttctcccagaggcccggagccggcagctgtcagcgcagccaggagcgggatcctgggcgcggaggtgggtccgactcgccaggcttgggcattggagacccgcgccgctagcccatggccctctgctcaagccgctgcaacaggaaagcgctcctggatccgaaaccccaaaggaaagcgctgttactctgtgcgtccggct

SEQ ID NO: 88659 - DNA, 202 bp, Homo sapiens
  chr21:38069853-38070055
  hyper
cgatgtggactccgcaaggggctagggacaggcagggggagagcccgggtttgcgcacaccttccagcccctggagggagcctgctcggcttcgaacgccttcgaacttttgaccttcaaaggagtccctggaaaaggtcaggagcgcctgctgcaggcacggttgccgaaggccaggccttcctggcgcaggggagggcca

SEQ ID NO: 88660 - DNA, 639 bp, Homo sapiens
  chr21:38070425-38071064
  hyper
ccaggctgcgggagccggacaggggagggcagaggggggacaaaaggactctttaggtccaaaatgaccctgaaggagagtccagaatgcccagtggccgcgtctgcaacggagtcttctttctccaattgccttctgccccatcaccatgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccctgtttccgccggcgccctgggagaggcctcaccactcggctgggctccctggcccctcccttcccctggcctgagcgcccctgcggcctcccgctcctcctgagaaggcgacaatctctttgcaccttagtgtttcgaggacagaaagggcagaagggtcacttcggagccactcgcgccgttttcacgtgtgtgtgtaatggggggaggggggctcccggctttccccttttcagctcttggacctgcaacaccgggagggcgaggacgcgggaccagcgcaccctcggaaggctcgatcctccccggcagggcgcctggccaacgagtcgcgccgcctcctctcggcc

SEQ ID NO: 88661 - DNA, 52 bp, Homo sapiens
  chr21:38071635-38071687
  hyper
ccggaggggccttgccgcagccggttcgagcactcgacgaaggagtaagcag

SEQ ID NO: 88662 - DNA, 551 bp, Homo sapiens
  chr21:38072016-38072567
  hyper
cgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggccttggcggcccaggcgaccaaaccctctcctggtccagggctgggtgagggcgaattacgaattgttccaggggcaggcagtcccccagcccgcacggccagcgagttctttctggttttgttctttctccctttcctccttccttccttcgccagtgcattctg

SEQ ID NO: 88663 - DNA, 265 bp, Homo sapiens; identical to SEQ ID NO: 38372
  chr21:38072905-38073170
  hyper

SEQ ID NO: 88664 - DNA, 287 bp, Homo sapiens; identical to SEQ ID NO: 38373
  chr21:38073239-38073526
  hyper

SEQ ID NO: 88665 - DNA, 262 bp, Homo sapiens
  chr21:38073615-38073877
  hyper
cggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcc

SEQ ID NO: 88666 - DNA, 40 bp, Homo sapiens
  chr21:38074462-38074502
  hyper
agaattgctgggccccgagtttgggcgggggtggtccttc

SEQ ID NO: 88667 - DNA, 30 bp, Homo sapiens; identical to SEQ ID NO: 38375
  chr21:38075927-38075957
  hyper

SEQ ID NO: 88668 - DNA, 35 bp, Homo sapiens; identical to SEQ ID NO: 13975
  chr21:38076386-38076421
  hyper

SEQ ID NO: 88669 - DNA, 225 bp, Homo sapiens
  chr21:38077206-38077431
  hyper
ggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctac

SEQ ID NO: 88670 - DNA, 132 bp, Homo sapiens
  chr21:38077617-38077749
  hyper
cgaagtggtttgcaatccgaaagtgagaccttgagtcctcagatggccggcaacgcgccgaggtcacgctccccagaaacacccctctcccctcccctaccccagctccccctggggcgggtggtaattggg

SEQ ID NO: 88671 - DNA, 72 bp, Homo sapiens; identical to SEQ ID NO: 38379
  chr21:38078415-38078487
  hyper

SEQ ID NO: 88672 - DNA, 44 bp, Homo sapiens
  chr21:38078751-38078795
  hyper
gtgagtgctgggagccgctaaccccgaggcgcctagcacagact

SEQ ID NO: 88673 - DNA, 155 bp, Homo sapiens; identical to SEQ ID NO: 38381
  chr21:38079908-38080063
  hyper

SEQ ID NO: 88674 - DNA, 213 bp, Homo sapiens; identical to SEQ ID NO: 4879
  chr21:38080174-38080387
  hyper

SEQ ID NO: 88675 - DNA, 203 bp, Homo sapiens
  chr21:38080550-38080753
  hyper
ggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaatt

SEQ ID NO: 88676 - DNA, 248 bp, Homo sapiens
  chr21:38081665-38081913
  hyper
gggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagc

SEQ ID NO: 88677 - DNA, 162 bp, Homo sapiens
  chr21:38082478-38082640
  hyper
ctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgca

SEQ ID NO: 88678 - DNA, 490 bp, Homo sapiens; identical to SEQ ID NO: 38385
  chr21:38082684-38083174
  hyper

SEQ ID NO: 88679 - DNA, 234 bp, Homo sapiens
  chr21:38092055-38092289
  hypo
ttgcccctccccctgcgccaatcccagagaggcggtggcatttctgacccttcccttccacggcaggtggagctcacgggcaacagtatttatgaatacatccatccttctgaccacgatgagatgaccgctgtcctcacggcccaccagccgctgcaccaccacctgctccaaggtattccatccagagggaaaaaaaaaaacagactaaaagcaaggcgacattcttaaatg

SEQ ID NO: 88680 - DNA, 784 bp, Homo sapiens; identical to SEQ ID NO: 38386
  chr21:38119754-38120538
  hyper

SEQ ID NO: 88681 - DNA, 159 bp, Homo sapiens
  chr21:38120553-38120712
  hyper
cgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtc

SEQ ID NO: 88682 - DNA, 40 bp, Homo sapiens; identical to SEQ ID NO: 46465
  chr21:38363098-38363138
  hypo

SEQ ID NO: 88683 - DNA, 164 bp, Homo sapiens
  chr21:38378464-38378628
  hyper
cggggaccacagagggacggagaagccgggactcctcacatcccacatccggcaggggaagcccagcaggtgagcgcaggtccccccagtccccgagggagtgcgcccgacggaaacgcccctagcccgcgggcctcgctttcctctcccgggttcctgggtca

SEQ ID NO: 88684 - DNA, 335 bp, Homo sapiens
  chr21:38378928-38379263
  hyper
cctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagaggtgagggtggccccgcgccccggtggacgcgctgagaggcgtgcgcggtggcggtgcggggagcgcagcgagcgggaggctggggcg

SEQ ID NO: 88685 - DNA, 65 bp, Homo sapiens
  chr21:38379523-38379588
  hyper
tactttctcggtagccgtttctgttgtccctggattgggggctcggcgttcgctgtccctgggca

SEQ ID NO: 88686 - DNA, 30 bp, Homo sapiens
  chr21:38383158-38383188
  hypo
cgcacatatgttaaacgcagtgcttgcgtt

SEQ ID NO: 88687 - DNA, 30 bp, Homo sapiens
  chr21:38593074-38593104
  hyper
cgcagcggcacttcccggaagagcccagga

SEQ ID NO: 88688 - DNA, 367 bp, Homo sapiens
  chr21:38593362-38593729
  hyper
aggcttttgaagccacgcctgagcgcggaggatgggcaggatttgccccgtgaactcccgcgcacgcaggctccgcgcgaggcccgggcgcccgagcggcgattccctcccctatcaccagctccagggtggtgccccccggctgtggagcccagaccccggccgtccagcagcgtatagacgagcccatgtctgcgatgtaactgcaccgcgctggggatccacctcccgccagggtgagggcgccgtcctccagcgtatgctaggcaggcgcgccccgccctcctggtcacgtgaccacgcctacagccgaagaggatgggaaaatgcggccctgttcctgaacaggaagcggaagcaggaagga

SEQ ID NO: 88689 - DNA, 77 bp, Homo sapiens
  chr21:38602978-38603055
  hypo
tgaagtgtttctgtccggcagaaagtggacagacaatccggctcccgggagttcggggcacccgtcctccaggtggc

SEQ ID NO: 88690 - DNA, 30 bp, Homo sapiens
  chr21:38603457-38603487
  hypo
atgtaaactgacaaccgaggatcaatacac

SEQ ID NO: 88691 - DNA, 63 bp, Homo sapiens
  chr21:38606032-38606095
  hypo
cagggagcaggctggcgagacagaaagggcagtgcgctcaggagcagacgccaggccagatcc

SEQ ID NO: 88692 - DNA, 216 bp, Homo sapiens
  chr21:38638487-38638703
  hypo
gtaatacaagcgtgagccaccgcgcgggccagatttttccctttgtaattaaccatcaaggggatgaccatttgagcttgtgtaaataagagcaggcttccctagttgtcttttgcccaaaagttttagcatccatccaagacctttgtctgaaattctgtcccttttgagattactttgcattaatatgaccaaccactgcgatcaattttattc

SEQ ID NO: 88693 - DNA, 30 bp, Homo sapiens; identical to SEQ ID NO: 46467
  chr21:38823635-38823665
  hypo

SEQ ID NO: 88694 - DNA, 23 bp, Homo sapiens
  chr21:38880597-38880620
  hypo
tctcccctgctgagacggagtct

SEQ ID NO: 88695 - DNA, 102 bp, Homo sapiens
  chr21:38918459-38918561
  hypo
cgctgatggggcatccgagctttccttggaggtgggcagctctttcggggttggtacccatcaggtgctgtggccagaactcagattcggagtctaaattca

SEQ ID NO: 88696 - DNA, 142 bp, Homo sapiens; identical to SEQ ID NO: 46469
  chr21:38935380-38935522
  hypo

SEQ ID NO: 88697 - DNA, 77 bp, Homo sapiens
  chr21:38936189-38936266
  hyper
cgtccgcagcgaccacgtgactgtgcgtccgcggcgtcgattgactgggagctccctggccacgccctaagcgccag

SEQ ID NO: 88698 - DNA, 30 bp, Homo sapiens; identical to SEQ ID NO: 46470
  chr21:38987670-38987700
  hypo

SEQ ID NO: 88699 - DNA, 138 bp, Homo sapiens
  chr21:39047670-39047808
  hyper
gccgggctgggcagccgacgcaccgctaggtggcgcacgcgctcgctgcgtctttcagggctgcaggtacggtgcgggtttctggtgcgctgaccgcgctggggatgagcaccactgtcatcgcggggaccctcgggc

SEQ ID NO: 88700 - DNA, 295 bp, Homo sapiens
  chr21:39286580-39286875
  hyper
gtgattgacctccagcgaccaaaggagtgggtactgcttgctgggggctgcagacaggtgaggcttcaccctcggcgcctgggctctggccttggtgctgaatccggaacccgctgaggaaccaccacctcggcggcccccaggcaactttcgggaggtttcaggggcacccggccagctctgggcgccctctcgagcgtcgccgtcagggagttgggcacaaccgatgccctgggacccgccacagggcacgcggctggcgtattcctttgcctggagccgggaaagttttgtc

SEQ ID NO: 88701 - DNA, 395 bp, Homo sapiens
  chr21:39287999-39288394
  hyper
cttctgttatgtaaccggcttctccctcgcctttcggctgacttgggcacaatgtttctcatgagagtggagatgcctgcggcgacggcggagctggggaaggggacgcggggacccgagagcacggaacgcctcgcccaggtggacgccagctcctcgcctgcgagcagctcagcgcaccgcttacctggctgcggacggggtggcttcactcaatcatgatctcctctcttgaaacggagcaagactgaacaattcactacacgacggatggcgagggaaggaaatgcaaaaaagaaaaggaaaagaaaaaaactggaatcagatggtcaaatttcacatcagcaccgagaggctgttaggagactccattctgctcgcggctgctccggctc

SEQ ID NO: 88702 - DNA, 111 bp, Homo sapiens
  chr21:39288790-39288901
  hyper
cgcacagcgccggcgcggtccgggaggaaggggcgggggcgagcaggacagagccacagacccagagacgcccaccccgccgcccatgccagctagcgtgtcagcgcgtcg

SEQ ID NO: 88703 - DNA, 145 bp, Homo sapiens
  chr21:39289180-39289325
  hyper
caccgggctgaaatccgtgagaggcagccccggcgcgggagccggagcctgcaccgcccagagggggcgcagcgagcggccgggacggaggggaggggccctatccctgagctttgcttgcacctggtggcgccccagcctgctg

SEQ ID NO: 88704 - DNA, 30 bp, Homo sapiens
  chr21:39953590-39953620
  hypo
cataaaataccctgacggggttaggacagc

SEQ ID NO: 88705 - DNA, 30 bp, Homo sapiens
  chr21:40022607-40022637
  hypo
aaggttactcaatgacgcatcacgtatagt

SEQ ID NO: 88706 - DNA, 82 bp, Homo sapiens; identical to SEQ ID NO: 38398
  chr21:40032153-40032235
  hyper

SEQ ID NO: 88707 - DNA, 169 bp, Homo sapiens
  chr21:40032679-40032848
  hyper
ggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgc

SEQ ID NO: 88708 - DNA, 252 bp, Homo sapiens
  chr21:40033106-40033358
  hyper
tgtgggagggggagccgcgggggtgcgcgctcctcctaactcggggtcgcttttagcgagaagtgatatttttccagcctcattgaaaaccgttgcaaacattgaaaatagtaaaagtgaaaacggttgcgacactaagacgtttataaaatgaccgcggactgccctcgatgctgatgagaactgggacgacgtcgcgcagagcgtccggagggagaggcgcggtgcccgggacctcggtcgtggggagga

SEQ ID NO: 88709 - DNA, 30 bp, Homo sapiens
  chr21:40106338-40106368
  hyper
aaatcactcaactgccgctcggcggcggga

SEQ ID NO: 88710 - DNA, 30 bp, Homo sapiens
  chr21:40394086-40394116
  hypo
cccttaggttccatgcgagggttcctccgg

SEQ ID NO: 88711 - DNA, 146 bp, Homo sapiens
  chr21:40510522-40510668
  hypo
tttcactgttccccacgagtaagtaagtgaacggcaaatgtgcaagggagttaaagtgtaaattcctcccggcccatataattgacttgctgaatttttgcagtaacaaaagactgctgttcaaaacatttccagtgacattttaa

SEQ ID NO: 88712 - DNA, 206 bp, Homo sapiens
  chr21:40630336-40630542
  hypo
acctgacaaagacttcgtttactctttaatttcaatgcagccatattcaggtaaaacatttatcactatttattacctctccggggtgtttcttcaccatttgaaagtcctcttggaatagtatcctgatctgctcccattctctgatcttgctgctgctgcaactgtcttatcattccatcaagaatactcgattctgggctgcg

SEQ ID NO: 88713 - DNA, 41 bp, Homo sapiens
  chr21:40717636-40717677
  hypo
catgaagttgaataccggaggagtctcgtcgaccgtattcc

SEQ ID NO: 88714 - DNA, 30 bp, Homo sapiens; identical to SEQ ID NO: 38401
  chr21:40984793-40984823
  hyper

SEQ ID NO: 88715 - DNA, 36 bp, Homo sapiens
  chr21:42218886-42218922
  hyper
ggagagagccgcagacgcgggcgtgagctcatcccg

SEQ ID NO: 88716 - DNA, 30 bp, Homo sapiens
  chr21:42447793-42447823
  hypo
ccagcccaggggctgcgggctgccccaggg

SEQ ID NO: 88717 - DNA, 39 bp, Homo sapiens; identical to SEQ ID NO: 46472
  chr21:42448116-42448155
  hypo

SEQ ID NO: 88718 - DNA, 145 bp, Homo sapiens
  chr21:42572656-42572801
  hypo
gacaccagggatgtgcgcagagggaccgccatgtgaagaagcagcaagaggagcaagaggacggccatctgcaagccaagggggaagccacctgcccacaccttgatctgagacttccggcctccacaaccgtgagaagatacgt

SEQ ID NO: 88719 - DNA, 30 bp, Homo sapiens
  chr21:42606870-42606900
  hypo
cttactttatgatcacggtggagtgaacca

SEQ ID NO: 88720 - DNA, 63 bp, Homo sapiens
  chr21:42613756-42613819
  hypo
tctggagaccttcttcgactccctggtgacacaagcaaacatccccaacgttttctccatgca

SEQ ID NO: 88721 - DNA, 611 bp, Homo sapiens
  chr21:42688619-42689230
  hyper
cccacgcccgccccgcgcacctgccgggtccgcacctgccatttgcccgactggccgcgcacccagctggcccgcccctgcccgacacgaccgctgcccgccccttgccttcctgacccaggggctccgctggctgcggtcgcctgggagctgccgccagggccaggaggggagcggcacctggaagatgcgcccattggctggtggtgagtgcgcccccgcctcggggcgagggtaggggcggggaaggaggaccccaggggaagcgtcgctccccaaccctgcctgggacccgccacgcttagcaaaagcgggagggctggttcttggcgccgaggctggtcttagacctgggatcaggaatgcgggaagcgattccagagggggcgaacagcgggggtttccagcagggttccccgaccctgtttccccgcgctcgccaggcctgttcccgccgccccagccggggtgcatgggattagggaggaacctggaatgtaacactgtaacattttacttggaaagtagattggtggggagcgcaggcacagccccgcacccccaccccccacccgggctctccacgcttctccttccggggaagggtacgc

SEQ ID NO: 88722 - DNA, 104 bp, Homo sapiens
  chr21:42797863-42797967
  hyper
ctaggttcaaggatacgtgcaggcttggatgactccgggccattagggagcctccggagcaccttgatcctcagacgggcctgatgaaacgagcatctgattca

SEQ ID NO: 88723 - DNA, 47 bp, Homo sapiens
  chr21:42798497-42798544
  hyper
ctcgggggaggtctccgagggactctagtaagcggggaagggcgccg

SEQ ID NO: 88724 - DNA, 530 bp, Homo sapiens
  chr21:42878710-42879240
  hyper
cttgtaactgggctgcgtagcctttgtaattttccatgattcgggaggttctcgcggctgggagctccgtgaggtcaggcattgccttgggcgcgatgcgctcatctttcccgcgggaccactgcacaggttcgcacggagggaagggctgcgcagcctcgaaggcgagccctgggtgctccctgcccacagggctcacctcgggccgccgtgctatcctttccttcccaaacaagccaccaggattcctcgtgattagggctgccaccagggcgttctgaacaggattcagggccaccgcgctgtgctctacggcggagcgggcgaaggccctcctctgccacaagcgctcagggctctcggcgcacaaactttctggacatggggcagtttttcagctggacccgtgctcgagcagagcgcccactgccagactggagcacttgaccactcagggtgccactgtgccgagccgggcaggacaggatgaggtggaccgaagcgcccaggtgccccgccttccccccaac

SEQ ID NO: 88725 - DNA, 45 bp, Homo sapiens
  chr21:42880059-42880104
  hyper
gcctcctgcttagctcgcgcctactcggcccggcccgccctggct

SEQ ID NO: 88726 - DNA, 194 bp, Homo sapiens
  chr21:42880402-42880596
  hyper
tcctgggtgagcccccggagctgctacctcacgagctcctgtaggcggccggccccgtcttggcctccggggaacccactgtagcctctgggcaaggacccagggtaggccttggggactgctggcccaagcacgagtggcggggacacagcgccggacgcccaagaccctccccagtccgcctaggctggcat

SEQ ID NO: 88727 - DNA, 18 bp, Homo sapiens
  chr21:42925199-42925217
  hypo
ttaaagattacaggccgg

SEQ ID NO: 88728 - DNA, 30 bp, Homo sapiens; identical to SEQ ID NO: 46474
  chr21:42953643-42953673
  hypo

SEQ ID NO: 88729 - DNA, 30 bp, Homo sapiens; identical to SEQ ID NO: 46475
  chr21:43033404-43033434
  hypo

SEQ ID NO: 88730 - DNA, 30 bp, Homo sapiens
  chr21:43187812-43187842
  hyper
acaggaatcatacagcgcctaattttttga

SEQ ID NO: 88731 - DNA, 55 bp, Homo sapiens
  chr21:43188093-43188148
  hyper
atttgggttagaggccgaagtgcatcacagatcacgcacgcgtccacacctcaga

SEQ ID NO: 88732 - DNA, 30 bp, Homo sapiens
  chr21:43188455-43188485
  hyper
cacatcccaacatgacgatgcttgctcggg

SEQ ID NO: 88733 - DNA, 430 bp, Homo sapiens
  chr21:43248491-43248921
  hypo
cgcccgcagcaggtgcgcaggcggcctcaccttccaggtgccggcgctggtggtccagcatgacgtccttgcggtagaacatcttgctgcagacctcacaggcaaacttcttgtcgccgtgcttcttcttgtgcttggagaggttgctgttggtggagaagaatctgaaacacatctcacattggaacgtcttgtcatctgtccagagagcaaacaaacacacaacgattttgaggtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttc

SEQ ID NO: 88734 - DNA, 272 bp, Homo sapiens
  chr21:43255502-43255774
  hypo
gtaccgcacagcggccgaggggagacgtgaccggcgccctcacctgtcctgcagttgtggaactccagcgcgctctcgatgcggaaggtcttctcacaagtgccgcagcggtacctgtactcgccgtccacctggtcagagggacacgccgtgagtgagatggcccagcgcagagtccacagatgccgagcccccgacgtgctgcccgggcgactccacgcctgtgtctgttatgactctgacctccaccaccctcccgctctatttaggaa

SEQ ID NO: 88735 - DNA, 61 bp, Homo sapiens
  chr21:43376373-43376434
  hypo
tgcagtcagataattcgagtcctgctggtccccttgccagaataaccggggtgaggaatcc

SEQ ID NO: 88736 - DNA, 38 bp, Homo sapiens; identical to SEQ ID NO: 46479
  chr21:43493035-43493073
  hypo

SEQ ID NO: 88737 - DNA, 30 bp, Homo sapiens
  chr21:43520167-43520197
  hypo
cacttgcctggtgcccgtggtgcctagact

SEQ ID NO: 88738 - DNA, 123 bp, Homo sapiens
  chr21:43521309-43521432
  hypo
gtgttacggtggcagcggatgcccagagcctccagggagtccaattcccagggccctggaggaggccgccagtccacggggctctgcgatacgtcggggcctgagaatcggaggccacatgga

SEQ ID NO: 88739 - DNA, 43 bp, Homo sapiens
  chr21:43526266-43526309
  hypo
gactactggtgtcttcggacgccagagtcgggggagcaaccat

SEQ ID NO: 88740 - DNA, 30 bp, Homo sapiens
  chr21:43527383-43527413
  hypo
gagcaggactcccaccggcatccttctgcg

SEQ ID NO: 88741 - DNA, 60 bp, Homo sapiens
  chr21:43640641-43640701
  hyper
atgattttgtgtaaacgatagaatggggccgcagacatggccaggcggtgggtggaggag

SEQ ID NO: 88742 - DNA, 30 bp, Homo sapiens
  chr21:43714330-43714360
  hypo
ctgtggaggagcagacggcagtctgttgag

SEQ ID NO: 88743 - DNA, 95 bp, Homo sapiens
  chr21:43725826-43725921
  hypo
gaaaaggctgggcaccgcccacactccatgcagctctctttccctggctcggaatcgctgcaggcgccacagaccagacgcgcactgttccccac

SEQ ID NO: 88744 - DNA, 245 bp, Homo sapiens; identical to SEQ ID NO: 46481
  chr21:43786496-43786741
  hypo

SEQ ID NO: 88745 - DNA, 30 bp, Homo sapiens
  chr21:43852234-43852264
  hypo
gctggtggttcgccacggggagagagtgga

SEQ ID NO: 88746 - DNA, 30 bp, Homo sapiens
  chr21:43859152-43859182
  hypo
tcctcagatccccttcgccccgtcagagac

SEQ ID NO: 88747 - DNA, 45 bp, Homo sapiens; identical to SEQ ID NO: 46482
  chr21:43864728-43864773
  hypo

SEQ ID NO: 88748 - DNA, 30 bp, Homo sapiens
  chr21:43981657-43981687
  hypo
gaagaaggagccattcgatactcagtccac

SEQ ID NO: 88749 - DNA, 193 bp, Homo sapiens
  chr21:43991300-43991493
  hypo
agccaagtcccttcccgaaggaggtgcccgcatgcttattcagtgtcactgtccactccttggcagtgactcgggtggaggcgaaacatgactaatcgtaaatcacccctgccttctcccaagtgccacacggtttgttgacacggtgtgcgcctggggcgttcacagtgcttagaatcgcagaggttgccgt

SEQ ID NO: 88750 - DNA, 102 bp, Homo sapiens
  chr21:44037537-44037639
  hypo
aaatctgagagcacccgacagtaagccagaggaccttgatgtgagatcccagcacggtgtgggggcggactgtggtgggtgctgtctcggcccccacccctt

SEQ ID NO: 88751 - DNA, 191 bp, Homo sapiens
  chr21:44073316-44073507
  hyper
agaaggaacttttcccgttttctattcaaatgaaatgagggtggcggtcgcagcagggagagaggagcgaggggagttttcccggcggggctggggggtccacagcggcgcggccacgctcagcccagcgctggcttaggagggacgggctgcgtggggaggcgacggctccgggccgaaggggtcgctca

SEQ ID NO: 88752 - DNA, 30 bp, Homo sapiens
  chr21:44081613-44081643
  hypo
ctggcctccttcactcggatcatgccctca

SEQ ID NO: 88753 - DNA, 43 bp, Homo sapiens
  chr21:44086020-44086063
  hypo
ccctgggcacctctgcgccatgaggccccgttgaagtcagttg

SEQ ID NO: 88754 - DNA, 30 bp, Homo sapiens; identical to SEQ ID NO: 46484
  chr21:44093215-44093245
  hypo

SEQ ID NO: 88755 - DNA, 30 bp, Homo sapiens
  chr21:44163509-44163539
  hypo
ttttgggataaaagacgcctttgtcccatg

SEQ ID NO: 88756 - DNA, 30 bp, Homo sapiens
  chr21:44187199-44187229
  hypo
atcgtctcactgctacggagccccagacgg

SEQ ID NO: 88757 - DNA, 42 bp, Homo sapiens
  chr21:44283111-44283153
  hypo
acctggcacagctcccggccaaggaggcggagccagaggctc

SEQ ID NO: 88758 - DNA, 88 bp, Homo sapiens
  chr21:44283686-44283774
  hypo
tacacctccttgccacggtcctagaaggccagaaagacacccccattagcttccaggagcagcgcagggtcctcgacagcctggcagg

SEQ ID NO: 88759 - DNA, 378 bp, Homo sapiens; identical to SEQ ID NO: 46486
  chr21:44338174-44338552
  hypo

SEQ ID NO: 88760 - DNA, 52 bp, Homo sapiens
  chr21:44340200-44340252
  hypo
aggatagggcagagacgttgcaggacaggtttgtacccgacatggaaagagt

SEQ ID NO: 88761 - DNA, 30 bp, Homo sapiens
  chr21:44361878-44361908
  hypo
atcagggcatctcagcgggtccaccaaata

SEQ ID NO: 88762 - DNA, 30 bp, Homo sapiens
  chr21:44474704-44474734
  hypo
catgaaattcaaacccgcttacagggccgg

SEQ ID NO: 88763 - DNA, 129 bp, Homo sapiens
  chr21:44480656-44480785
  hypo
ctgcagagagggccacgagtcagacgcgccagggtgagcgtgcgtgggtgcacacgtatgcatgaattgtgcacgtgcacgcatgggagcatgtcagacacactccgaaggatccgtcaagaggggttg

SEQ ID NO: 88764 - DNA, 115 bp, Homo sapiens
  chr21:44482572-44482687
  hypo
cctcatggtggaccccgtgtctaggcggtaggaccccagaggtctcaccccagcctctccccctgggatcggcacgtctgcagactttccagttccaacacgttttgcagacagc

SEQ ID NO: 88765 - DNA, 62 bp, Homo sapiens
  chr21:44482892-44482954
  hypo
cagtctactttgtctcgaccttcgagaccagcttctcaccatgcgtgcggggcttgcccttc

SEQ ID NO: 88766 - DNA, 30 bp, Homo sapiens
  chr21:44483216-44483246
  hypo
ggccagcaaaagccccgcctggacatgcct

SEQ ID NO: 88767 - DNA, 50 bp, Homo sapiens
  chr21:44483958-44484008
  hypo
aagccggggccactccgcactgcccctctccggcccggccacaccactca

SEQ ID NO: 88768 - DNA, 163 bp, Homo sapiens
  chr21:44494615-44494778
  hyper
gtaagaagccgccgccgtgagcggagcagcaccttcctccgcgggtcgcgggagtcacctacgggaagggactctccgtctggcacaggccctgtctggcctggggcgcgcatgctccgccgccgaatcttccagaaagccgtggacccgaggccccggcaga

SEQ ID NO: 88769 - DNA, 57 bp, Homo sapiens; identical to SEQ ID NO: 1513
  chr21:44494940-44494997
  hyper

SEQ ID NO: 88770 - DNA, 1059 bp, Homo sapiens
  chr21:44494998-44496057
  hyper
ggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacgctccaggactcgccgccagtggggtccactccgccggcgcgggggctggggtgggagcccggggccacgtgcacggccagcccccatcttctgggcggtcaagaccgcaggcgtgggcgccggtggggcgggggtcttgggagaccctgtctcgccgcctttcggtgcagatgatgcaactctgggcggaggcgcggagagggaaaccgggacccagttgagatcctctgtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccggccaatgtctcgtggcagagcaccc

SEQ ID NO: 88771 - DNA, 596 bp, Homo sapiens
  chr21:44496362-44496958
  hyper
taacttcttgcccttcgggaatttaaggaacctttactgatgagcttgaaacgtgcgtcctggtgggtggggggccctgcgcgtcctcgaggaccgaccccgagggcgtgtgtcgcgggcccgggagggggcgccgcgccggggcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgccaggtcccggaggccgcgggcggggccgtttcccaaacatcgtgctctggactttcagaggctgaacctgatccccccgccctatggctaaatgggggatcccaggcccccgagtctccccccggacctgcagcgaaagacacggacggtgcccatcagctctgggcagaggaacgtgctgcgcctccgcagcgtccccggctcaggtcagagcgatgctccgcagcctcctccgg

SEQ ID NO: 88772 - DNA, 145 bp, Homo sapiens
  chr21:44561152-44561297
  hypo
ctccaggtgtggaaacggggctctacctcgtggggagcgtccgctgcgggccacaaccttgctgggaggctgcgggagatggggggtaagaggggtgatgttgaggctttccctcctcggcagtgaccggcgcagccctccccag

SEQ ID NO: 88773 - DNA, 203 bp, Homo sapiens
  chr21:44752326-44752529
  hypo
gagcatagcaggcatcgtacactgtgcagtgtggggtacacacgtaggcacttcagacccaggaatcacggactcctgtctcctgccatatatgtgggaggtctgtctccactgtagacagagatatgaggtgtgtgtgtttgcatgtgtgtgcgtgtgtttgctttgtgtgcgtgtgtgcatgagtgtgtgcttgtgtgtgc

SEQ ID NO: 88774 - DNA, 409 bp, Homo sapiens
  chr21:44836740-44837149
  hypo
gcacagcggggagggcggtggggccggtgccaatgtgcaggtgtgtgtccaggagctgcgccgctgaggccaccggggacgcgccggtctgcaggagtgggggcggcagcagcgggagccccgacgtgaggagggtgctggggagcggggcagccccagggccatcacagggggcgatcacaaacggggcaggggccggctggggggcctgggagcagccgggtgcagcggccgggtggtgctgtaactggagcagcctgtgggaacagaggacaggtggtcactgcgccggctcgcagggttctcgggtttccgagtgcccgtgtggcagggcccgcccgaggagctgccagccgcggctgccgagggcaggtgcgtggctgatccctgaccgcgccccacctttcat

SEQ ID NO: 88775 - DNA, 253 bp, Homo sapiens
  chr21:44837378-44837631
  hypo
tgccgtgtgcccacccggggtcccagggcgggggcaggccctacctctgctgctctagcacctcctccagcaggctccagccctcccggctgccggctgcgccgccgtgcaggcctgggctctgtgcaggggcgtggaaggggctcaggccgcccctgctggcccggctggcgggggcctggcacacctggcgagccagccccttgattttgttcagtcccagaaaccctttggtccgcgtggtcttcctcag

SEQ ID NO: 88776 - DNA, 671 bp, Homo sapiens
  chr21:44840856-44841527
  hypo
aggcccctgcccaggcgagaccacacgactcaccttgagacatgaagaaggggatgcggaagcggccctccagcacccgctgtctcagcgtcggcaggttaggcccatcgaaggggagagaaccgcagaccaggacgtacagcaccacgcccaggctctgttgaggaccacagagccacatcagcgccagggcggtgcccccgggaacacggcgccctcggggaacgcggcctcgggaagggggtctgcgcgcacagggctcctacccagatgtccagctgggggccttcatactccttcccctcaaagacttccggggcggcatacggggggctcccacaccacgtggacagaggctctcctgacttgtagaaattcccaaatccaaaatctgagcggcaaagaaacagatggatgaggttaaacggcaaatggcaaggggctgcggtttcggcacaggggctgtggtttcggcacatgccgggaagctggggctgcttgcgggcacactcccaccccggggcctccgtgcctgccagcttgatgtccctgctcccaccccggaccctccgtgcctgccagcttgatgtccctgctcccaccccagaccctccgtgcctgccagcttgatgtccctgctcccaccccggaccctccgtgcctgccagctt

SEQ ID NO: 88777 - DNA, 95 bp, Homo sapiens
  chr21:44847511-44847606
  hyper
ggacgtgcgggggcccgggggcctcgcgggctcgcgcgtggggctggcggcgcggatgccctggggcgctgcagaccccgagaggccgcttgccc

SEQ ID NO: 88778 - DNA, 257 bp, Homo sapiens
  chr21:44847607-44847864
  hyper
cggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccaggccggccgcctgggtagggga

SEQ ID NO: 88779 - DNA, 378 bp, Homo sapiens
  chr21:44866552-44866930
  hypo
tactggcacttgggccggtgtgaagccacccccctgccatgaaaaatggctcttccctgccacagccggcccagcgggagccaggtcagggcctggagacacagcgccccccaccggagccactgcccggcccagcagcacctgcggagaatcccaccagctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcacgtcggtttgtggcggcaggagcccagc

SEQ ID NO: 88780 - DNA, 30 bp, Homo sapiens; identical to SEQ ID NO: 46493
  chr21:44871839-44871869
  hypo

SEQ ID NO: 88781 - DNA, 139 bp, Homo sapiens
  chr21:44881175-44881314
  hypo
agtgtcctcatgttgcggaggcctgagctccctggaggaaaagcaacaccttccaagccatgcggcggaacgctggtgaggctcaaagccctggaggtgacagcccccagacagaggcgtggaccgtgtttccctgtcg

SEQ ID NO: 88782 - DNA, 98 bp, Homo sapiens
  chr21:45078776-45078874
  hypo
agtctcaactccacccgggggcccgggggctccacagttaaaaactccacgccacggagatcgcaggtaagctgctggctcaacgaggtgtgctaaat

SEQ ID NO: 88783 - DNA, 35 bp, Homo sapiens
  chr21:45140241-45140276
  hypo
gcacggcggggcctgcggtgcgggctggcctggga

SEQ ID NO: 88784 - DNA, 111 bp, Homo sapiens
  chr21:45140489-45140600
  hypo
acagtcagggtgcaccggttctgtggctccggctcttaagcactgctctggaccactcctagcttgagggggttgggggaggtcaccacaggctggcggattgcttgggca

SEQ ID NO: 88785 - DNA, 97 bp, Homo sapiens
  chr21:45140831-45140928
  hypo
gaactcccagtgactcgaggggtgtcctctgattgctcacctcaggtggagcctcgaaaggatggcgctgctgttcctacctcgggtctccccagtg

SEQ ID NO: 88786 - DNA, 749 bp, Homo sapiens
  chr21:45148278-45149027
  hyper
ctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttgg

SEQ ID NO: 88787 - DNA, 189 bp, Homo sapiens
  chr21:45170219-45170408
  hypo
atgttgcaggggccccggcccagggtggccagtggacgaagagttagctgcctgtggggatggggatttccagagccgctgcggtttggggaatgtcaacacacaacccggagaggagaggctcacctgtccccacccgcctgtccccgcctgtcttccaggttactgagtggccggaagatccacagc

SEQ ID NO: 88788 - DNA, 80 bp, Homo sapiens
  chr21:45186755-45186835
  hypo
gagggcctgggggtgcgagcaggctcacgcccagtgtgcactgggcatgctcaggtgtcagcagccgagccagcaacact

SEQ ID NO: 88789 - DNA, 30 bp, Homo sapiens
  chr21:45187186-45187216
  hypo
acacatgcgtacatgcgggcgcacacacac

SEQ ID NO: 88790 - DNA, 30 bp, Homo sapiens
  chr21:45187276-45187306
  hypo
gcacgcacacgcaaacgcacccacatatac

SEQ ID NO: 88791 - DNA, 215 bp, Homo sapiens
  chr21:45195149-45195364
  hypo
ttgcttggggcatcccgtcggtcaccaaccatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaaggttgccatctgcaacccagcccggtttttatcttgt

SEQ ID NO: 88792 - DNA, 41 bp, Homo sapiens
  chr21:45198310-45198351
  hypo
agaaagggatgttcccgctgcttgtacggttcctgcagctc

SEQ ID NO: 88793 - DNA, 30 bp, Homo sapiens
  chr21:45198576-45198606
  hypo
agattcctcagcaggcgggggcagagccgg

SEQ ID NO: 88794 - DNA, 102 bp, Homo sapiens
  chr21:45201249-45201351
  hypo
ataggtgtgagccaccgtgcctgacaattaactttcttttcttcagtgccgtggcctttgtacagcaggcaggaagaacctgttgggcggtcccaccttggc

SEQ ID NO: 88795 - DNA, 79 bp, Homo sapiens
  chr21:45232923-45233002
  hypo
ggtcaggtcaggccccgcactcgggcaggcacagcagggcgcaccccatgacgcacccagaacccgcccccacagcccc

SEQ ID NO: 88796 - DNA, 30 bp, Homo sapiens
  chr21:45245930-45245960
  hypo
tgggtctccaggccccgccatggggagatc

SEQ ID NO: 88797 - DNA, 30 bp, Homo sapiens; identical to SEQ ID NO: 16719
  chr21:45247147-45247177
  hypo

SEQ ID NO: 88798 - DNA, 101 bp, Homo sapiens
  chr21:45249923-45250024
  hypo
gaaccccagtgtcagcggtgcctgtgaccctcaggcaacgtgaaacgcagctgcttccacatgccaggaaggctgttagaaaatcctgcatgtctgccggg

SEQ ID NO: 88799 - DNA, 40 bp, Homo sapiens
  chr21:45250324-45250364
  hypo
aaaccccgcttgtcactgccgtcgccgccaggagtcactc

SEQ ID NO: 88800 - DNA, 30 bp, Homo sapiens
  chr21:45256017-45256047
  hypo
ccctgacgggggtggcggtcaccagacatc

SEQ ID NO: 88801 - DNA, 181 bp, Homo sapiens
  chr21:45268768-45268949
  hypo
ggatcagctgggctccgctaggcagttcttcctctggttttgtctgaagtcagctggaggccggtggcctcactctcgtgcccggtggctggctggcagtcacctggtcacagggtaggctgtgcctctcgtcacccagcaggttagcctaggcttgttcacagggcgggataacagggtt

SEQ ID NO: 88802 - DNA, 92 bp, Homo sapiens
  chr21:45272579-45272671
  hypo
ggacctcctacctgccggggacttccactcctattccctcccaagcagctctctgctcacagtctctgtgtaagcaacggtccctgacagct

SEQ ID NO: 88803 - DNA, 30 bp, Homo sapiens; identical to SEQ ID NO: 46501
  chr21:45273343-45273373
  hypo

SEQ ID NO: 88804 - DNA, 334 bp, Homo sapiens; identical to SEQ ID NO: 46502
  chr21:45273579-45273913
  hypo

SEQ ID NO: 88805 - DNA, 99 bp, Homo sapiens; identical to SEQ ID NO: 46503
  chr21:45276620-45276719
  hypo

SEQ ID NO: 88806 - DNA, 30 bp, Homo sapiens; identical to SEQ ID NO: 46504
  chr21:45299990-45300020
  hypo

SEQ ID NO: 88807 - DNA, 30 bp, Homo sapiens
  chr21:45349806-45349836
  hypo
acctcataaatgcagcggacactgggctgc

SEQ ID NO: 88808 - DNA, 56 bp, Homo sapiens
  chr21:45352946-45353002
  hypo
aacacctgttacattcgtctttttgataatagccaactgaacggcatgaaatgaca

SEQ ID NO: 88809 - DNA, 62 bp, Homo sapiens
  chr21:45353502-45353564
  hypo
ggcacagcttggaagcggttggcactggggttaggctccagtagtctcggcatgtagcagca

SEQ ID NO: 88810 - DNA, 220 bp, Homo sapiens
  chr21:45365737-45365957
  hypo
atgcttgcacaggagcgtggctttgtcagaactcatccccaggcagccctgtgggcacctggtgggggctggacaggggtcacgaggagaagccagcaggagggtggtgggccctccaccttgtccccgcaggactcccctctctgcccagacacactcagcctccaccaggactcaggggttccagccaagctcctcttaccaacgatgccccgtgact

SEQ ID NO: 88811 - DNA, 83 bp, Homo sapiens
  chr21:45375005-45375088
  hypo
gtcactcagcagccacggatgcgccctgggtgctgtcccggggccgtctcagaagcaccgcgctggaccggctgggccagatg

SEQ ID NO: 88812 - DNA, 90 bp, Homo sapiens
  chr21:45387435-45387525
  hypo
tgttctgcagacatacgatggttgttttctgcttcctaatcatctagtgacatttttcatcttctgcacctctcacggggcgtggctgtg

SEQ ID NO: 88813 - DNA, 30 bp, Homo sapiens
  chr21:45400824-45400854
  hypo
tgtaaagaagcctcacgcttcctttttctc

SEQ ID NO: 88814 - DNA, 72 bp, Homo sapiens
  chr21:45406862-45406934
  hypo
gtttgccgtgctgtgcgaggacctgtgtacacaggcaggtgtgcgcctgcccgagcgcgagtagctcttgtg

SEQ ID NO: 88815 - DNA, 30 bp, Homo sapiens
  chr21:45411378-45411408
  hypo
gggcgggctcctgaccggcctcagcaggac

SEQ ID NO: 88816 - DNA, 73 bp, Homo sapiens
  chr21:45411841-45411914
  hypo
ggccttggccaggctcggcttgtggagtgcagagcaagggctggtggagctcctcgggcgcttggagccaggg

SEQ ID NO: 88817 - DNA, 19 bp, Homo sapiens
  chr21:45412668-45412687
  hypo
tcaccgtgcctggctcaag

SEQ ID NO: 88818 - DNA, 30 bp, Homo sapiens
  chr21:45435826-45435856
  hypo
aaacctcctgcctaacgggctcctgtgaag

SEQ ID NO: 88819 - DNA, 78 bp, Homo sapiens
  chr21:45508617-45508695
  hypo
cccgctcttccctggcgctggtggcacctgtgctgtgtgccgtgttatcccactcttccctggcgctggcggcacctg

SEQ ID NO: 88820 - DNA, 153 bp, Homo sapiens
  chr21:45516450-45516603
  hypo
tcccatctgtcatgacgatgctttcctccctgcagggtggccctggcccccttgccagattccagctggccgtcagtgctcgcgtgtctctctgaagaggctctgcggttctggtccctgtgcctgagctccaggtgccgccaggtgaggccc

SEQ ID NO: 88821 - DNA, 121 bp, Homo sapiens
  chr21:45583747-45583868
  hypo
atgaggctggacaagcgcctccgccagaagcagcacaggcctgacacaggcaaacctcccggagaccaccccacggaccccagcccctgctgaccctcccaggaggcgttgctggaaatcc

SEQ ID NO: 88822 - DNA, 44 bp, Homo sapiens
  chr21:45626242-45626286
  hypo
gaggacaaacatctgcggtttctaggccccgcctgtggtcctct

SEQ ID NO: 88823 - DNA, 30 bp, Homo sapiens; identical to SEQ ID NO: 46510
  chr21:45657028-45657058
  hypo

SEQ ID NO: 88824 - DNA, 131 bp, Homo sapiens; identical to SEQ ID NO: 46511
  chr21:45681620-45681751
  hypo

SEQ ID NO: 88825 - DNA, 110 bp, Homo sapiens
  chr21:45682528-45682638
  hypo
tgagggtgggcactccggggcagggctcagtggcgggggtcggggctcagggcaagggtagagacggggtgaaagtaggaatgggggtgtgaggccgaggatgggggttt

SEQ ID NO: 88826 - DNA, 30 bp, Homo sapiens
  chr21:45683130-45683160
  hypo
gacaattgtgctggtcgaaagtgggagaag

SEQ ID NO: 88827 - DNA, 30 bp, Homo sapiens; identical to SEQ ID NO: 46513
  chr21:45710106-45710136
  hypo

SEQ ID NO: 88828 - DNA, 314 bp, Homo sapiens
  chr21:45712867-45713181
  hypo
ggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggc

SEQ ID NO: 88829 - DNA, 54 bp, Homo sapiens
  chr21:45713401-45713455
  hypo
aaaggaggccaggcccgccaagcaggagagaggtgcgggcgccaggcttgcagg

SEQ ID NO: 88830 - DNA, 55 bp, Homo sapiens
  chr21:45727163-45727218
  hypo
ctcagccccagtccccgtgggagatttggggctcgccctccgtcctgggtattta

SEQ ID NO: 88831 - DNA, 30 bp, Homo sapiens
  chr21:45748750-45748780
  hypo
cgctggtgtaagccccgcatgtccacggca

SEQ ID NO: 88832 - DNA, 48 bp, Homo sapiens
  chr21:45749108-45749156
  hypo
agcggcctgcacacacggtcacgcatcaccgctcggcggaggatggga

SEQ ID NO: 88833 - DNA, 293 bp, Homo sapiens
  chr21:45749406-45749699
  hypo
ttcctgtgccaggcccggaccccagggcgaacaggcctgttcatccacaacctcacagctgagggccctcctgcagttcttcacaggagagagaaaggaaggcgcacctgcccagcccggccaagaaaacaaaactctctcccatgggtgcgggaggctgctgcctgcctgctgagcagctcagggcagatgtcgctatgggtgccagcattctcgaagtctcccttgcccaacagaaatctatccaaggaccaagggctggaatcggcaaagccatccgtgaagacctcctc

SEQ ID NO: 88834 - DNA, 196 bp, Homo sapiens
  chr21:45749930-45750126
  hypo
acccactcctgccctcggccgatgtggcaaaccggggaggcttttgtgtggggccggggctgcggccatggcagccaccctccagctcccgggggctggggaagacgctggggtccccgtggaggctggagcggcgttcaggtcctgcggtcactcggcgtgctcctgcacctcttccccacgcagggcctgcagc

SEQ ID NO: 88835 - DNA, 261 bp, Homo sapiens
  chr21:45750395-45750656
  hypo
gtggcacctcttccacgtgactcctgttgccctcagcccagcagggcccgggcccacattccacagaccaggacagcaggagaggctgaggggccaggacggctccgtgcggggcacgtgttacacgtgtgtgcgcattcacagacccgcacacgcagctccccctggggcacagctcttcaaggccctgtgaggctccatgctccctccccacggggccctgtgaggctccatgctccctccccacggtttctgtgcagt

SEQ ID NO: 88836 - DNA, 45 bp, Homo sapiens
  chr21:45751076-45751121
  hypo
agggtggggggcacccgaacacacaaatgccgggggagagctcct

SEQ ID NO: 88837 - DNA, 86 bp, Homo sapiens
  chr21:45752956-45753042
  hypo
acggtcatgcggtagcggtgggggctggtgccgcagcacgggttctcggccagccacagcacccgcagacgcggcagccccttcag

SEQ ID NO: 88838 - DNA, 282 bp, Homo sapiens
  chr21:45753623-45753905
  hypo
ttccattctacagaacgtggacgcgtcagagaagagaaacagcaggcctggagcggggacctgcaggctttaccctgcagcgtggggtccgtcccctccacaagcgaacacgcggagccgctcccgcaggccctcaaaggcgcggagccagggccccctgcctggagggctgcactcgcgtccggcaggcgcctcagaagggcggtcaccaggcccccatgggcagcctgccgtcctgagcccccctccccatgccatcccttcactcggggtttcccaggt

SEQ ID NO: 88839 - DNA, 300 bp, Homo sapiens
  chr21:45769972-45770272
  hyper
gctgcgggcgcgggacgcggcgcgggagacgctctccgggctgagtgacgcagagcgctgcgggcggctccactgcaccgggcacgcggcgcacgctcgggcgagatgtggatggccccgcggggccagggcggcggtgctgcgcggggacgcgggtgacgccggggcgcgggcggctccgagcaggtaggtgcccgccggggccggggcgagggcgcgagcccgggtgcggggactgaggcggccgtcccgggagcttgtgaaggttgaggcggggtgcaagggcgcggatcggggtgc

SEQ ID NO: 88840 - DNA, 242 bp, Homo sapiens
  chr21:45770304-45770546
  hyper
cgaggcggccggccccggtgctgctgcagggcgcggcggaatgcaggggcgcggtggggtgcaggggcgcaggcggggttcggggcgctggtgcagggcgcggtggggtgcaagggcgcaggcggggttcggggcgctggtgcagggcacggcggggtgcaggggcgcgggtggggctcgaggcgctggtgcagggcgcggtggggtgcaggggcgcgaaggggctccgggcactggtgcag

SEQ ID NO: 88841 - DNA, 301 bp, Homo sapiens
  chr21:45790866-45791167
  hypo
cttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctctgcctccgtgtcccgtggccgcctccctccagtg

SEQ ID NO: 88842 - DNA, 30 bp, Homo sapiens
  chr21:45799305-45799335
  hypo
cgcagcacaccagggcgggctgggaacgct

SEQ ID NO: 88843 - DNA, 30 bp, Homo sapiens
  chr21:45819379-45819409
  hypo
acacagcctcctgttcgtgcagttggcacg

SEQ ID NO: 88844 - DNA, 43 bp, Homo sapiens
  chr21:45824452-45824495
  hypo
atcagaaccaatgttcggatttgctgaccgtgatgatagtgat

SEQ ID NO: 88845 - DNA, 89 bp, Homo sapiens
  chr21:45825899-45825988
  hypo
atcatcattgtgaagcggatggtaagggggcgggggcaccggctccatcgcggcctgcagcccagggtgggcctcggggagggcaggcc

SEQ ID NO: 88846 - DNA, 72 bp, Homo sapiens
  chr21:45844751-45844823
  hypo
agccctgcactggatcgtgaggacgctgcgggccagcggcttcagctcggaggcggacgtccccactctggg

SEQ ID NO: 88847 - DNA, 30 bp, Homo sapiens
  chr21:45847614-45847644
  hypo
aggacggggggactgcgtggcaggcctttg

SEQ ID NO: 88848 - DNA, 30 bp, Homo sapiens
  chr21:45870052-45870082
  hypo
agtgcagctcctccacgccagtccccagcg

SEQ ID NO: 88849 - DNA, 51 bp, Homo sapiens; identical to SEQ ID NO: 14000
  chr21:45875681-45875732
  hyper

SEQ ID NO: 88850 - DNA, 32 bp, Homo sapiens
  chr21:45875956-45875988
  hyper
gtgcccagcttgacccgcgctccaggttcggg

SEQ ID NO: 88851 - DNA, 240 bp, Homo sapiens
  chr21:45918988-45919228
  hypo
ccctgtgggtggggccgtggggagggggtgcgacccaggccatgcccaggcttgtgatttctgacctcgcgctagtgcatttacgggtaaactgaggctgggagggaagcctctctctgtatggggaggtggtcctctgtccgtgtccgtggtgaggggctgtgcccacccgctgcctagagaggagcaccggtgcttttgtaaagagcagtataaatacacttccgttcagataaaaca

SEQ ID NO: 88852 - DNA, 259 bp, Homo sapiens
  chr21:45929112-45929371
  hypo
aggcctgcgcggtcacgttcagctcgtagatgacggagttgatgacataggaatcattctggacttgcatctccacatcgtagctgtgactgtttgccacagcgaggaagatcctctccccgatctggaagacctcccagtctgcagcaccgaacgtctaggaccaaaggagagcaggtgcagaggtgtgggggagcgggcgcagaggtgtgggggagcgggcgcagaggtgtgggggagcgggcgcagaggtgtgggg

SEQ ID NO: 88853 - DNA, 249 bp, Homo sapiens
  chr21:45939565-45939814
  hypo
tgctcagctctgtcccgtgccacatcaaaccaagtgacaggccgcattgcttggcttgatcccagttctgccacgggcaaagccctccaccgttctgagcctctgtgtccttgtggataacagggaccagtggcagcaagcccctctcaaggtgctgtgagggtgatgtgggcggatgcgggcagagctcttggcacaggtgctctacagagtcgaggctcagccagtgtgagccgctaccaccaccta

SEQ ID NO: 88854 - DNA, 30 bp, Homo sapiens
  chr21:45940440-45940470
  hypo
ttggtccctgtgagccgcggctcctggtcc

SEQ ID NO: 88855 - DNA, 30 bp, Homo sapiens
  chr21:45958213-45958243
  hypo
gagagatgagagtgtcgctgactgtgtgcc

SEQ ID NO: 88856 - DNA, 63 bp, Homo sapiens
  chr21:45959291-45959354
  hypo
caggcatacagcaggcgggccggcatacagggcggcagaggagggacacggaggaggagggtc

SEQ ID NO: 88857 - DNA, 172 bp, Homo sapiens
  chr21:45959901-45960073
  hypo
ggtcaggcagggggccggggcgcagcagctgagggcgcagcagtggggctcacagcagctctctgggcaggcatccacctgccaggagtcggagcaagcgctggagcagacggacatggtggacgcggccatgctggggtggggaggaggtgagctgcgggaggtgtgagtg

SEQ ID NO: 88858 - DNA, 194 bp, Homo sapiens
  chr21:45991563-45991757
  hypo
gcaccagggccaaaacgaaaggacttgagggccgaagttggaaccactgcaaccacaaaatacatagtgatcatattggattatagctcaagtaatagataaacattctttagtccacacatagataaataaataaggaagcaaatagacacacagaagagcgggacagctcctcctcccgggagaatttcaat

SEQ ID NO: 88859 - DNA, 46 bp, Homo sapiens
  chr21:46010155-46010201
  hypo
cggtatcgtggaccacgtctgagtgccagagcggagggtggcagac

SEQ ID NO: 88860 - DNA, 30 bp, Homo sapiens; identical to SEQ ID NO: 16724
  chr21:46015435-46015465
  hypo

SEQ ID NO: 88861 - DNA, 78 bp, Homo sapiens
  chr21:46021444-46021522
  hypo
cagaccctcctcctccgtgtccctcctctgccgccctgtgtgcaggcccacctgctgcgtgcccgtcccctcctgctg

SEQ ID NO: 88862 - DNA, 41 bp, Homo sapiens
  chr21:46022629-46022670
  hypo
gggcatccccaacatcgcacacgcagcgtcccagctgcttg

SEQ ID NO: 88863 - DNA, 141 bp, Homo sapiens
  chr21:46032641-46032782
  hypo
gtgtccctcctctgccgccctgtgtgccggcctgcctgctgtgtgcctgtcccctcctgttgtgtccctgcctcctcctgccagcccagctgctgccacccggcctcctgcctgtccttcctctgccgccccgcgtgctcc

SEQ ID NO: 88864 - DNA, 102 bp, Homo sapiens
  chr21:46035158-46035260
  hypo
gccagcgccgcaccacggggaggccctgcacgagggccgtgcgctcacccgacccgcacacacgcaggagcgcgagtgcccaggctgcggaagagagtccag

SEQ ID NO: 88865 - DNA, 255 bp, Homo sapiens; identical to SEQ ID NO: 46528
  chr21:46036572-46036827
  hypo

SEQ ID NO: 88866 - DNA, 30 bp, Homo sapiens
  chr21:46066733-46066763
  hypo
gtggggctgcttcttcgtgctgccggcagt

SEQ ID NO: 88867 - DNA, 58 bp, Homo sapiens; identical to SEQ ID NO: 46529
  chr21:46068645-46068703
  hypo

SEQ ID NO: 88868 - DNA, 74 bp, Homo sapiens
  chr21:46126354-46126428
  hyper
cgcacccacatgtacacacccacgtgcacacacccacgcgtacacacccacgcgcacacaccgctgtccccagc

SEQ ID NO: 88869 - DNA, 957 bp, Homo sapiens
  chr21:46126566-46127523
  hyper
cgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccctgacagtgcccaagctgcccatgggattggattcgccagagcctcctacgcagaccccacccagggccaaagccaaccccaagccccaccaccttggtggtgtgggatgaaaagtgagccatcgagagatggggtccccccacccccaacccctccaaggacaaaggcgggctgggaagcacccgctttcacgtccgcccctgcccggctttcctagcggaattggcgccggcatcagttgggggttgtgggatcagtgaggaatcccgtggggtcgcctccatttatcagttgtgtggggttgggcgagcacccctagccccagcccaggcgatcagggcgcgaagcccactggacgcggatttgggattaggacgggggtgacagccaggaggaccgcacctgccctccccactcctgccgctccacccctgcccccaccgcaacaccaaggtctccaccaggaagatgggggtggggaaaggacgcggggtgggggggggtgcggggagagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccct

SEQ ID NO: 88870 - DNA, 28 bp, Homo sapiens
  chr21:46127878-46127906
  hyper
ctagcctgtgccccccgattccccccct

SEQ ID NO: 88871 - DNA, 88 bp, Homo sapiens
  chr21:46128221-46128309
  hyper
ctttggtcatgcacacgcagccaagagaaggtgtcgctggcacacagccttccaggagcggacttggagacctcgccaaggaccagga

SEQ ID NO: 88872 - DNA, 212 bp, Homo sapiens; identical to SEQ ID NO: 38420
  chr21:46128884-46129096
  hyper

SEQ ID NO: 88873 - DNA, 326 bp, Homo sapiens
  chr21:46129376-46129702
  hyper
atgagtcctagaaagcgagagacgagaggggaatgagcgccgaaaatcaaagcaggttcccctcctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagccagcggggcccacgctaaggcggaatcccacagaagcctacagagcgagcgcgcgcctgtgcttccca

SEQ ID NO: 88874 - DNA, 39 bp, Homo sapiens
  chr21:46130020-46130059
  hyper
gtctctcagctgccccggggtcctcgagcaggggaggga

SEQ ID NO: 88875 - DNA, 48 bp, Homo sapiens
  chr21:46130394-46130442
  hyper
ccctggtcatgtcatcgggatctgagtgccatccgagcagagagctgt

SEQ ID NO: 88876 - DNA, 30 bp, Homo sapiens; identical to SEQ ID NO: 38423
  chr21:46132288-46132318
  hyper

SEQ ID NO: 88877 - DNA, 170 bp, Homo sapiens
  chr21:46143057-46143227
  hyper
taccaacatctgcatcggtgcaagcattcgaccgagttttcttagctcgttagggaaaggaagccgacgttcagttggcgaggctttctggtctaaaggcacaggcaagggagtgttggccatttgtctcctagacgaccaggcggcctcagccacggtggaggccaccg

SEQ ID NO: 88878 - DNA, 90 bp, Homo sapiens
  chr21:46143579-46143669
  hyper
cctgctcacgcctcgcggcctccgaggagcaaggaaaggcccgcgtgggagcgaagagccagggaggaacaaagacgcctcctgtttgat

SEQ ID NO: 88879 - DNA, 30 bp, Homo sapiens; identical to SEQ ID NO: 46530
  chr21:46169786-46169816
  hypo

SEQ ID NO: 88880 - DNA, 62 bp, Homo sapiens
  chr21:46173291-46173353
  hypo
cagctacctgttctgcgtgtctgtggctgggctgtgtagtagaatcccgtgtcaaagcaccc

SEQ ID NO: 88881 - DNA, 120 bp, Homo sapiens
  chr21:46183961-46184081
  hypo
cacccagcacacctggggcacctacacacccggggcacctacacaaccggggcaccctgcacacccaggcacccagcacacccgggcatccagcacacccggggcatctacacactcaga

SEQ ID NO: 88882 - DNA, 208 bp, Homo sapiens
  chr21:46184437-46184645
  hypo
acacccagcacatgccgccccaggcccatggaactcgtgctctgatctgaaagttctcttcagactcagactggaatgttgaggatccgagatggtggccgcctggtagggacctggccctgcggtgggagggtgagcagctaggcccaggactctcagtgggtgacctcctggagggatgccacccagggtgcggctccatccaccc

SEQ ID NO: 88883 - DNA, 30 bp, Homo sapiens
  chr21:46205669-46205699
  hypo
aagtgcacttgtaaacggcctcttgtttgt

SEQ ID NO: 88884 - DNA, 154 bp, Homo sapiens
  chr21:46206072-46206226
  hypo
gcaggcgtgctgccccgctggcatgagtgcaggtgcgcctgcattaacacatgaaacaagcaggttacacatcagttcatgtatatgatctcctgcttctacagaaataaaaagagctgccccgatacaagtatacagccgcacagtccactaa

SEQ ID NO: 88885 - DNA, 286 bp, Homo sapiens
  chr21:46238788-46239074
  hypo
ctggggtgcctggcccgccccggcctccatgtctgtgatcccagggcctcggatggaacggacctgagggcggacacccctgcgtccctcaggagtgcccgggtggtgccagccggggcgtggcggaggtctcatctgatggtgagcccggccgaaggcgggggaggccgcacttcaggctcagctgggaaatggcagggcctggatttgaacctaagcgtctgagccgtttctgtcctgcctgggaaaggctcagccaactgagcaacgtcgcaaagccatggag

SEQ ID NO: 88886 - DNA, 41 bp, Homo sapiens
  chr21:46255003-46255044
  hypo
gtaaaaagaaacactcgtgccaggcccgcgaggtccatgcg

SEQ ID NO: 88887 - DNA, 440 bp, Homo sapiens
  chr21:46256907-46257347
  hypo
tggtgatgccagtcacgcgaggctccgaggcagcaggtttcaggggcacctccgtgcagtccccggcacccagggtgcagcccccagcacctccgtgtagcccccgacacccagggtgcagcccccggcacctccgtgtagcccccggcacccaggcagtccccggcacctccgtgtagctcccggcacccagggtgcagctcctggcccggcctctgctttgccggttgcttccagtcctagcagcaaagatcgcagagcctctgtcctcttggggtgcggggcagagcacgggcaccatctcctcagggctgggcccccgttcttgccctacgactctgcagagacaatcgtgtgactcgcagctcatgaattagcctggtagacaggaggccggagaagcccggatgcctggcctgggtgcccgtgtgtcccagggg

SEQ ID NO: 88888 - DNA, 330 bp, Homo sapiens
  chr21:46257708-46258038
  hypo
ctgggaacctgcctgcggtgcaggcgtctgcccttcctagaggaggcgctgggtgagaccctccagggtgtttggggccaagctgtgcgcacctctgatgccagctgttctcggtttggaaagcgctcactgtgcatgtggcgctgggggctgagctgcacgttccaggccccccccccaggccccccgcacacatcgtggcccacagccatgagcctcgcagcaccaccataaaggggaatcataaatagggaccaggtcccagaaggtgcacacagcgcgcagggcaccagcgcccgggtacgccccgcccaccgctcccagtctcac

SEQ ID NO: 88889 - DNA, 30 bp, Homo sapiens
  chr21:46263121-46263151
  hypo
tagccacctccacggcgagcctgggctccc

SEQ ID NO: 88890 - DNA, 78 bp, Homo sapiens; identical to SEQ ID NO: 46537
  chr21:46273062-46273140
  hypo

SEQ ID NO: 88891 - DNA, 33 bp, Homo sapiens
  chr21:46277581-46277614
  hypo
ccctggcaaggaggccgacggccaggcctctgg

SEQ ID NO: 88892 - DNA, 979 bp, Homo sapiens
  chr21:46308425-46309404
  hypo
tgggggtgaggggaccggcctctggcctccttgcaatgccaagggcatcccgcatggctcatccaccctgctgggcccacaacactggaggtgagatcctccttccgcaccaccctcgcctctgcggagaccccgcagccggagctctggagccggtccccgctgcaccccagcggcctcacctcggctctcatccacatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggggagccaggtgtgagcatcggtgccagggtgtgcgggggctccggcaacgggggctcgggcttgggtgtgtgtccaccagggggggcaggtggggttggggcgccctcaggccaaggagggggcccaagtggggcagatgcgggtgcagcgggtgaactggaagcctgatcccagggcccgcggcaggtgcgcacaggagggaggagggacacaggggcacggcggccgcggagggcccctcagtccagacgcacccgcagagaaccccgcggtgcagaggtgctcactggggtccccgagtgagcccggctgctgggtaggtggccggggagtggggatccctgcccgccctgcctgctccgcctgcactcacatgtacttgccacagggtgaggggcagccggggcactcctggcacagaggcagctggtagcctgaatggcactcgcatacgttgcagcggcaccggccacgaccactacactcaacacgccgcgggttcaggcagccctcagtggtcctctcgcactggcacgctgagccctcaaagcccgggtggcagcggcacttcccgcagaagcagagcc

SEQ ID NO: 88893 - DNA, 55 bp, Homo sapiens
  chr21:46309906-46309961
  hypo
acctggccgttgtagcgctcacagttgatggtgtcacactcgcagtactgcccgt

SEQ ID NO: 88894 - DNA, 395 bp, Homo sapiens
  chr21:46310422-46310817
  hypo
acatggcctgtgctgcgataccggtgctctgtgagtggctggtgtctgctcctgcgtgccccacatggtggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccctacagtcccgtgaagaggccgccccagggctgca

SEQ ID NO: 88895 - DNA, 149 bp, Homo sapiens
  chr21:46311753-46311902
  hypo
ccatggcagaggctgcggtctctgctctggtcccggcaccggcactcacactggggaagaacctgcacggtcactatgtccgtgaagcccagcgcccggatgacaaacgactgctcctggatgcactctgtggccgtgaccttcacctg

SEQ ID NO: 88896 - DNA, 30 bp, Homo sapiens
  chr21:46313354-46313384
  hypo
gggctggttcctgtgcgtcactccattgct

SEQ ID NO: 88897 - DNA, 30 bp, Homo sapiens
  chr21:46315995-46316025
  hypo
gagtgatcctgcctgcggtgtgactgctcc

SEQ ID NO: 88898 - DNA, 222 bp, Homo sapiens
  chr21:46317030-46317252
  hypo
ccatcccgtgtctcccgcagggtcctgctcccactccagagcccggggaacctatggcaggaaccgctggtctcgctgtcggccccaacacaccacgaggttgagcttgtagctgggatacgggcctgacaatggatccctgtagttcagcaaatgttcactttacaaaagcagcggccctcccgggcactttccttccccaaaccccgagtatgtctcctc

SEQ ID NO: 88899 - DNA, 160 bp, Homo sapiens
  chr21:46318183-46318343
  hypo
gctgggaggatggagcgccgcccacacccctgcagggaggggacactgggagctggtgcctggtttctctcctgtgcacctttgacctttgctgacttttgtctgtatcctcccacctcgggcagcggctggcacccaggagggtcggctctgcaataaa

SEQ ID NO: 88900 - DNA, 731 bp, Homo sapiens
  chr21:46318774-46319505
  hypo
aattcctcctcctatcgacacgcaggcgtcctgtccccgacgggaagcctcgggctcctcacctagggggatccaggacctgggccggctggttgctcacgtgcccagcatgcagaggtggcgctcagacctgcagtggcgctgggtctggcctgtggctgaaacatgcccccacccaatggatgctcgggacccaacagcactcacctcgtaggtcttcaccatcctactggtcaccgcgaagatgggctggatgttgttttcagccagcttgtgcgccagctggcccaccgatgggtagtcctggagagaggaggtcctgctcagttggccccgagtccaggacaaggcttccaggtacccgcccctgtctgccccgctcagcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtc

SEQ ID NO: 88901 - DNA, 135 bp, Homo sapiens
  chr21:46321513-46321648
  hypo
tggtcagcttcagcacgtgcctgaaggcaaacgggggctggcactctttctccttgttggggcatgggtttcgcagcttatcagggtgcgtgttcacgaacggcagcacggtcttgtccacgaaggacccgaagc

SEQ ID NO: 88902 - DNA, 30 bp, Homo sapiens
  chr21:46329001-46329031
  hypo
gatggcggcttcaggcggggacctccgcgg

SEQ ID NO: 88903 - DNA, 124 bp, Homo sapiens
  chr21:46351313-46351437
  hyper
tagcatcctggggcacggacaggcggaaccgggccatcagccgtccctgcgcacagaggcgcacagattggatccggcctcgcagtcccaggagccaagaggggaggcacgcgtgccggttctc

SEQ ID NO: 88904 - DNA, 626 bp, Homo sapiens
  chr21:46351653-46352279
  hyper
aggttgggagcccaccgcacccaagtgccgccgcatccacccggcgcaggcgacccccgacgggcagccgctcaccttctcctggccccgggcttcaggaaaactgcctggaggtggccggggtctccctagcggaggctgggcggcgggcttcgcgcctgcctcagtctcccaatccgtggcccgggggatggagcccgctgcgcgcagaggctgcggcaggtcccagccaggtgccctggaacgtggctcctccttccctgaggcgctcccctgggcacgaggatgggtctcgaagcaggaggaagccgccttccctcacccgctgtccggagctgctcagccggtgcgcggagcctcccccgccgcggacaccacgatccgacccccaccctgaccccgacccagacccccaccgcccgaccccggccgtattccgttgcgtttgctccctgccagctccggggccaccactgagcacgcgctgtgagtaggcgcttcctggagcttttcctgggggtcctcagaaaaacccctgccgtccccattatagagatggggaaactgaggctcaggaaggccagagcttgcccaaaacctgcggtccgcggcgggcagggattcca

SEQ ID NO: 88905 - DNA, 195 bp, Homo sapiens
  chr21:46352673-46352868
  hyper
cgagagcggaggccccggctccgcagaaacccggggcggccgcggggaagcagcgccctcaggcgtcggaggagcccccagaaggacctcgcgcctccccgccgggctccgaccgcctgggttcggtgcgggacggcccaggccgccaggacccccaagcgcagctcagtctgcggggcacgacccagaggccag

SEQ ID NO: 88906 - DNA, 340 bp, Homo sapiens
  chr21:46359019-46359359
  hypo
tccatagtttgttctcgatgtgtcagctttgtgttcccatgagaacaatgggctccttgaggacaggcattgcatcgtacctgtggtctcttccctaacgccccccagtacgcccagcatagacagcacagggtgcaagcagtcagatgagcagggctcccgttcccagcacgggacccagcccgttacctcgctgctatgtttcccacgtaaacggagcaatacccaattctaaagaactgttctgaggactaaatggaatagtgtaaaaaataaattgacatgaagtgaaggtcaattaaaatgcactagcttggccaggcgcagtgtggctcatgcc

SEQ ID NO: 88907 - DNA, 55 bp, Homo sapiens
  chr21:46402502-46402557
  hypo
gcaaggggtgtgttccgtgcagcattgccgtgggaggcggcgggaccctgtgctg

SEQ ID NO: 88908 - DNA, 60 bp, Homo sapiens
  chr21:46424460-46424520
  hypo
caccatccccacagccggcgctcctgtgccccctcctcccagccccgggcaggcctcgcc

SEQ ID NO: 88909 - DNA, 30 bp, Homo sapiens
  chr21:46424927-46424957
  hypo
tgtttaggtcacgggcgtgactccctcagg

SEQ ID NO: 88910 - DNA, 65 bp, Homo sapiens; identical to SEQ ID NO: 46549
  chr21:46431841-46431906
  hypo

SEQ ID NO: 88911 - DNA, 762 bp, Homo sapiens
  chr21:46438210-46438972
  hyper
acccccgccctcagccgttcgtgcacttggtccaggcgggacccggcaggacccccagcagccccgggaagcgcccggacgacggcacgggggccccagggcgccgcgaaggaagccccccgagggcgaggccgggcgaggccagggggccggggccagaggcggtcgcggcgggggtgggtgtcctggagcaggagcggcagcgggaaacgaagacacgcgcttcttcctactggggggatggctgggaagtaagaccggccgggccgccgagcccgctgcgaggggcttcgcgtggcggccgcacctgagcccgagcgcgcccttgagaggcggcgcccacgggggcagagacccacggtccacgcgcagacccggagaacccgcgatgtcgccgcacgcagcgccgctgtgaaggacggaggcggggcggggccctgggacagggagcgggtgggggcggggtggggggagggcccgtccgggcctgcgcgggaagccctgggttggccttggtgctctgtgatgcccacgctgggtgcaaatgttgctttggtaaaaataacaacaacgaaaggaaaagccaagccggaccagccccacccgcagggccccggccccggccccggccccgcccttggactcttccccgccccacccccacccgtgggcgagcgagcccggaccgtgaagggagggggcggggcgggggcccggaggggcggggaggggccgggtcctcccgcgcggggtcctggaggt

SEQ ID NO: 88912 - DNA, 100 bp, Homo sapiens
  chr21:46439007-46439107
  hyper
cgtctgtcccaggcccgggcaggacccccgcccgctggttgtctgcgcggctgccccgcgcccgccgcccccggccgctgtcgcgcgttcccagacattc

SEQ ID NO: 88913 - DNA, 73 bp, Homo sapiens
  chr21:46439283-46439356
  hypo
agcgtgggccgcacccgccgacctggggggccctggagggagcggctcggaggggcgccggtgcctgggcagg

SEQ ID NO: 88914 - DNA, 30 bp, Homo sapiens
  chr21:46441167-46441197
  hypo
gaggtccagtgatctcggacacacagggca

SEQ ID NO: 88915 - DNA, 356 bp, Homo sapiens
  chr21:46452216-46452572
  hypo
tgctctggaggacatcgaggtgccaggtgctgctgtccaatcacacctggagcctcccttgctgctggtcttggggaggcgggctccagctcgaaaggaggcacacaaaactgctgggaaacgggccgggcaggcaggggcggggccgggcgggtgaggacatggcttctgtgcgcacggcccggcgcgatggctggtgtggacccctacctttggaacacgtggggccaggccgagggggttccgccacgtctcctgggcagagcgccagcctcagtcaccgtgtcactgtgtgtccctccacaccccgagtcctggcaaaccaaggcagtgcaggaggacgcctggtgcccagg

SEQ ID NO: 88916 - DNA, 30 bp, Homo sapiens
  chr21:46462910-46462940
  hypo
ccaggtggccacaaacgcaggtctgaggct

SEQ ID NO: 88917 - DNA, 124 bp, Homo sapiens
  chr21:46492315-46492439
  hypo
caacccgcacctcagcgaaggcctgtggaagacttctgcagtgacagccccgatgaaccatgcttgccgtgcccgtcccctgtgcggtgcctcacgtccactcaggccccggccatctcaccct

SEQ ID NO: 88918 - DNA, 41 bp, Homo sapiens
  chr21:46495431-46495472
  hyper
ccagggaagttcctgcgggtgccgggcgtctgcagcgatcg

SEQ ID NO: 88919 - DNA, 34 bp, Homo sapiens; identical to SEQ ID NO: 46552
  chr21:46549475-46549509
  hypo

SEQ ID NO: 88920 - DNA, 159 bp, Homo sapiens
  chr21:46677734-46677893
  hypo
caaggagcacaagtccgcagtgcccatgagatcctcatgctggccggcgcaggagccatcctcggcctctgcaggtcctcgtgggaaaccgcgggggcacgtggggcggctgcagggtccgcaaagccggctgtttgcgaagggcgcagctccacctgg

SEQ ID NO: 88921 - DNA, 67 bp, Homo sapiens
  chr21:46678745-46678812
  hypo
aactgacaatcagcacgggtttgtaattaagggtttctgcccagccaatgaacggcctccagaaaca

SEQ ID NO: 88922 - DNA, 184 bp, Homo sapiens
  chr21:46706791-46706975
  hyper
cccacagccacagggcggccgcgaagctcgtcttggccctgagaattcactgcggagcgcccgcccggcactgactcccggctccgcacacccaggcctggacccgtgtcacttgcaggggcctccggagccagcccacgctcagcctgagcaacccggcccccttcctgggctcccgaggctg

SEQ ID NO: 88923 - DNA, 37 bp, Homo sapiens
  chr21:46713325-46713362
  hypo
agagagtggactggccgaggaccgctgagctcaggac

SEQ ID NO: 88924 - DNA, 30 bp, Homo sapiens
  chr21:46723304-46723334
  hypo
tgccaggggtgttcccggcagagggaggag

SEQ ID NO: 88925 - DNA, 30 bp, Homo sapiens
  chr21:46754541-46754571
  hypo
agtgtggggcacccacgtgccttccctgga

SEQ ID NO: 88926 - DNA, 30 bp, Homo sapiens
  chr21:46764430-46764460
  hypo
ctcagctggcccaaccgatgcctcggccct

SEQ ID NO: 88927 - DNA, 167 bp, Homo sapiens
  chr21:46765675-46765842
  hypo
cctggcggggtgtgtcgcttcccactggattttcaacacagggaattggttagacgtccctggcggggtgtgtcgcttcccactggattttcaacgcagggaattggttacacgtccctggcggggtgtgtcgcttccagctggattttcaacgcagggaattggtt

SEQ ID NO: 88928 - DNA, 59 bp, Homo sapiens
  chr21:46766071-46766130
  hypo
gttagacgtccctggcggggtgtgtagcaggataagaggagccacgcagaaatatcggg

SEQ ID NO: 88929 - DNA, 30 bp, Homo sapiens
  chr21:46785365-46785395
  hypo
tcctggaggagcacacggtttacaccaggc

SEQ ID NO: 88930 - DNA, 102 bp, Homo sapiens
  chr21:46790661-46790763
  hypo
gaacgttccctggcccgtgctggagcgattcactggctcatgatacggagatcatctggacgggcccagcctgagcacgtgagccttcgagggcagagaacg

SEQ ID NO: 88931 - DNA, 30 bp, Homo sapiens
  chr21:46800750-46800780
  hypo
ctgtccgtgcacacacgctcacctcacaca

SEQ ID NO: 88932 - DNA, 30 bp, Homo sapiens
  chr21:46804073-46804103
  hypo
gggggtggtcagatgcggtggagcctgtgc

SEQ ID NO: 88933 - DNA, 64 bp, Homo sapiens
  chr21:46804718-46804782
  hypo
ccctgactggggtctcggggaggcgcggcgccgtcccactgcctagaaccggctggtgtgtgtt

SEQ ID NO: 88934 - DNA, 70 bp, Homo sapiens
  chr21:46805792-46805862
  hypo
gagccgcacgggcagcgtgctaggcctgcgtgcctcgccggagggagggctgagtcgcactggctgggac

SEQ ID NO: 88935 - DNA, 30 bp, Homo sapiens
  chr21:46808834-46808864
  hypo
gtcctccactgagcacggccactcctgtag

SEQ ID NO: 88936 - DNA, 30 bp, Homo sapiens
  chr21:46813076-46813106
  hypo
ccttcccggggttcacggcctctgacagcc

SEQ ID NO: 88937 - DNA, 30 bp, Homo sapiens
  chr21:46822823-46822853
  hypo
cgggaggaggtaaggcgaatggagagactt

SEQ ID NO: 88938 - DNA, 597 bp, Homo sapiens
  chr21:46825134-46825731
  hyper
ctggggagagcatggcgccgaggtgaggccggggctgcgggcaggggttgggggacgccaagatgcggctgcgggggtcgcgggggtcgcggggctcggccgggtcctgcgggggtcgcgggggtcctgcggggtctgacccgtgcctgtcccgcgcaggtgcccctggccatggccgcggcggcggcgcctcctggacgtgctcgcgcccctggtcctgctgctcggggtccgcgcggcctccgcggagccaggtaagacccgggcgggacgggaaggttcgcgccggtgcccgccggcctcgccgccctggctggggtccccgcccggctccctcacccccgccccggccgctctgggttcagccccggccctgcccacgcgcgcaggaggcgccggagccggacggagcggggcggggtggccggagtcccgcccattcattctccccgcggggtccgggccgggaggggtgcgcggtgcgagcggccggagtccccgcgcggggaccgaacctccgcggccggcggggtcgtcggtgccgggagggctcggggcggggccgcggggtctcgggagacgcggcctctgtcgccg

SEQ ID NO: 88939 - DNA, 210 bp, Homo sapiens
  chr21:46839039-46839249
  hypo
ctgggccctgacacacgatgccgtgtgtagtgacatgcaattccatgtagtgacgtgattccgtgtagtaaggcgatgccgtgtgtggtgacgtgcagttccgtgtagtgacgtgatgccgtgtgtggtgacatgcagttccgtgtagtgacgtgatgccgggtagtgacgtgatgccgtgtagtgacgcaatgccgtgtagttacatga

SEQ ID NO: 88940 - DNA, 135 bp, Homo sapiens
  chr21:46844628-46844763
  hypo
aaaccggctcccttccggggcagcccttggcccccactgaccctccctcagtcctaggtgtgcagtggcgtggggaccctgggaggcccgtggcgcagccccttcccgcctcctgcccgtcggtttccattgctc

SEQ ID NO: 88941 - DNA, 32 bp, Homo sapiens
  chr21:46845211-46845243
  hypo
tgagtgcagtgtgaccgcgtccacctgtctcc

SEQ ID NO: 88942 - DNA, 30 bp, Homo sapiens
  chr21:46846999-46847029
  hypo
tgcagtttaaaaagccgggctctctccgga

SEQ ID NO: 88943 - DNA, 15 bp, Homo sapiens
  chr21:46848190-46848205
  hypo
cgctctgaggaaggt

SEQ ID NO: 88944 - DNA, 190 bp, Homo sapiens
  chr21:46848572-46848762
  hypo
tttccacctctggatcggcggttctggacgttcatgcaggtggttcccgcagtgcgaggccttttgtttcgggctcctctcacaagcctcacgtttccaggtacgtcgtggtgttgtgcagacccacaattcatcccttttcatgggtgtgtaatagtccaccatagattctctacgttttaaagcatgt

SEQ ID NO: 88945 - DNA, 188 bp, Homo sapiens
  chr21:46853309-46853497
  hypo
ggtcgtctttgtgtgcgtctgtgcctgtgcctggtagtagttctgtctggaaggtgagcagggccacagagcaccaagaaaataccagggactttgcaggtctcgggtggattcaggttgatccaacagatgccggcccagggcctgcaaggaggctcctttcgcgtggctgtcgtggcccctgtgag

SEQ ID NO: 88946 - DNA, 49 bp, Homo sapiens
  chr21:46854204-46854253
  hypo
gccctcggggacaggcggcccgtgctgggacgggcgcaggagctcctga

SEQ ID NO: 88947 - DNA, 30 bp, Homo sapiens
  chr21:46855623-46855653
  hypo
gggtgaagggtctgccgtgggctgaggcat

SEQ ID NO: 88948 - DNA, 139 bp, Homo sapiens
  chr21:46859943-46860082
  hypo
cggaggctggcaggccgtgggccgcatgggcggaggggccggtcctccgatgatggggcaaacgtctccggcctagcccccgacgctcggggatgtaagggcaagggctgcggggtcggaacgtcggctgtggctgtgg

SEQ ID NO: 88949 - DNA, 83 bp, Homo sapiens; identical to SEQ ID NO: 46558
  chr21:46863752-46863835
  hypo

SEQ ID NO: 88950 - DNA, 321 bp, Homo sapiens
  chr21:46864130-46864451
  hypo
ggttttgttctccagcgcatcttcagtgctgcgagcaggctgggcttgcagcaggagcacgggtgtgcgtgtggagtgaatgaagggccgtgtgcccgagtaggtggcgtgcaggggtgtagtgaggtgcgtgcaggggtgtagtgaggtgtgggatgtgcagagtgaatgaaggacgttgtgctcgtgtgggtgatgtgcggggttgtggtgaggcgtagggctggggtcagctggtcgtccggacttttggttttctggctgtaaaatgcacatgccaggatagttgtgaggtgcacgctcactcgtgcatggagggtg

SEQ ID NO: 88951 - DNA, 139 bp, Homo sapiens
  chr21:46894771-46894910
  hypo
tttgcccaataagcccgttgtttttgcctggaacatgccagaagacgccagatcgttcacatggcggccatgacaaggctgcgccctgggacagcttgctgggtgcggggggtcgccgaggcgccgcacccctcccctg

SEQ ID NO: 88952 - DNA, 324 bp, Homo sapiens
  chr21:46895167-46895491
  hypo
cgacccgattggacacgacttactgaagctcagatggtgcctgggcagggaaggccagcgtgcccaccccagcggccccccggagagcaccagagagggctggacgaggcgagagggggcctggaggaggcgagagcagcgtcctttgcttcccaggcctgccgggctcggggcctggcctggctgccatctctccagcctttcccttttcaaactcctcaggcatccggagactctggcagcgggctcggggacgcccgggagcttctcagggaggagacggtgagtagccggacggggcccagcccacgctgcagggtcccg

SEQ ID NO: 88953 - DNA, 30 bp, Homo sapiens
  chr21:46895706-46895736
  hypo
acactccttggtcttcgaggcaaccttggc

SEQ ID NO: 88954 - DNA, 47 bp, Homo sapiens
  chr21:46901324-46901371
  hypo
gctgcactggcatcccgtggcctggggtcactcggtagcatgccatg

SEQ ID NO: 88955 - DNA, 644 bp, Homo sapiens
  chr21:46908900-46909544
  hypo
agccgcctttcaccccgctgcgtgctcatcaaagcgtcctctgctgcgtgcggggccaagggcgcacggggcccaccctggggctgcactctcacgcgtcaccagcccctgccatggcacctgctcctttgagctttgctttcatttgcaagacatcgggacactcaaaaggctgacttatgggaagggccgtgtgtttgctttcttaaattgtttgaatgaggccgtctcagcggggttcctcttgcagtctgcagtcctagtgatggaatatgtccccaggttccgcagccgtcccggccgggtgccttcagccagcctgggcccacggggtccctgcacaagttgctcagtgtccctgggacccctcggctctgggctgggggagggcggtgagatgcatcctgggtaactcacccttcccttcacccggggtggacgctgcctgaggactgggctggccccagcaggtgctcacggagccccttttttcacttagggggatcctggcgtgcctgggctgccgggggcgaaggtaagcgctgtgcccgggttcagggacgtggccaggcagaggcagggagggcccagccggacacctgcggagatcagctcggggcggccttccccgctcttcctgccac

SEQ ID NO: 88956 - DNA, 471 bp, Homo sapiens
  chr21:46912057-46912528
  hypo
caggcagacaggcatcgggaggcaggggcagcccgagaggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtatgtgcctgcccagcttctaagagacgggcctgcggggacctgggtac

SEQ ID NO: 88957 - DNA, 77 bp, Homo sapiens
  chr21:46913283-46913360
  hypo
cctgtggtcacctcccgtgaaaggacccagcctgcgaggcccagtcacagcggccctgccttcggggctctgggtga

SEQ ID NO: 88958 - DNA, 30 bp, Homo sapiens
  chr21:46919113-46919143
  hypo
ccgtggccttcagaacgaggatgacatgca

SEQ ID NO: 88959 - DNA, 163 bp, Homo sapiens; identical to SEQ ID NO: 46566
  chr21:46921470-46921633
  hypo

SEQ ID NO: 88960 - DNA, 30 bp, Homo sapiens
  chr21:46921992-46922022
  hypo
caggggctccacagccggtcacctccctct

SEQ ID NO: 88961 - DNA, 583 bp, Homo sapiens
  chr21:46925317-46925900
  hypo
ccctggaaccatgggcgcctcctcaggggtaagtgtctgggcagccggctgggcacctgcgtcccgtgccctggctggttctgcagcccctgcccctcagagacactctcccacggaccccacagggagatatacaggaggccaagatgcggtttccagggtggaagcggggccaggccatgggggaatcaggtggacccaggaggacgaccaccagccgggaagtgcccagggcctgtacattgtccacggaggcgcaggagctggcggcaggcaggggtccccatggtgctcatgggggcagccgcctcagtccacacctgtccaaagccctgcggcccctgcccagcaccctgaaacgggcattccttccttccgcccctgccccccgccctccccgccaagccccacacctctgcatttggtcccagcaggtgaggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgg

SEQ ID NO: 88962 - DNA, 145 bp, Homo sapiens; identical to SEQ ID NO: 46569
  chr21:46926439-46926584
  hypo

SEQ ID NO: 88963 - DNA, 89 bp, Homo sapiens; identical to SEQ ID NO: 46570
  chr21:46934071-46934160
  hypo

SEQ ID NO: 88964 - DNA, 154 bp, Homo sapiens
  chr21:46935829-46935983
  hypo
gtcttctggggaaagcggcgggctctgggctggctgcaggcctccgaggcccttgtcctgcacgctcagtgcctgtgctgccttctcctccgcggcactcctcaggccctgggccgggggctgccgcgggtggtggccccgctggcagtgccgc

SEQ ID NO: 88965 - DNA, 157 bp, Homo sapiens
  chr21:46946883-46947040
  hypo
ggacagaccaggtcacgggcgtctcaaaacattcagaaaatcatcatcaagagaacctctgggcacagacagaaaagtctagaatgaaagtctttcacggttaaatgtttgataaattagaagagcagtgaaaccacagagtcggtgaatgagcagc

SEQ ID NO: 88966 - DNA, 41 bp, Homo sapiens
  chr21:46961319-46961360
  hypo
cacctctttacagggcggccaacaggcgcctccaaggactt

SEQ ID NO: 88967 - DNA, 43 bp, Homo sapiens
  chr21:46978498-46978541
  hypo
tgtgtgagaggactgcgtttggtttgagcgagggcaggcacag

SEQ ID NO: 88968 - DNA, 117 bp, Homo sapiens
  chr21:46998723-46998840
  hypo
ggactccagctgccacgatgtgcattcccagccctggtccctccctgccctgacagggttccccccaccccgctcccaatccagacagggttccccccgccccgctcccaatccaga

SEQ ID NO: 88969 - DNA, 40 bp, Homo sapiens
  chr21:46999819-46999859
  hypo
ccgggatgcgggtgcccctgagatgcgggtgcacctggga

SEQ ID NO: 88970 - DNA, 63 bp, Homo sapiens; identical to SEQ ID NO: 38432
  chr21:47010090-47010153
  hyper

SEQ ID NO: 88971 - DNA, 374 bp, Homo sapiens
  chr21:47010408-47010782
  hyper
gccccgggagttcgaagggtgctggggccgaggggaaggctctggtcggcggcgtcagcggcagctcccagacgacctaggactgcaaagggcccaggacggggggcggggcggagacaggaggcggggcggaggcatgggggcggagacatgaaggggcggggctggggcggggctgaggcaggaggggcggggctgaggcaggaggggcggggctgaggcaggaggggcggggcagagcctgagacaccccgccccgccccccacctccacctcgagcccgcccctctcccaggctcctgctccagggcgaacccgggggtcctctcccatggctctgtgggggaccccggggaggtcgccctggcacggga

SEQ ID NO: 88972 - DNA, 77 bp, Homo sapiens; identical to SEQ ID NO: 46574
  chr21:47013235-47013312
  hypo

SEQ ID NO: 88973 - DNA, 156 bp, Homo sapiens
  chr21:47019157-47019313
  hypo
ccccagctggctgcacgctgggcctccgggaagccggcaagcccacctgattctggatcctccctccgagcctgggtgacgctgtcatgaaagaagctgccagaagcccacagcagggcagttaggcagggaatgcgagtccgtgtccagagcaag

SEQ ID NO: 88974 - DNA, 33 bp, Homo sapiens
  chr21:47026246-47026279
  hypo
cagtcacactctgcacgggcgtttagatacaca

SEQ ID NO: 88975 - DNA, 420 bp, Homo sapiens
  chr21:47026399-47026819
  hypo
cacgggcgtctggctacacaaatgccaccgcgttacagtcgcctgcagtattcagtgcagtcacacgctgcacgggtgtttagatacacaaatgccaccccgttacagtcgcctggagtattcagtgcagtcacactctgcacgggcgtttagctacacaaatgccacggcgtcacagtcgcctgcagtattcagtgcagtcacgctctgcacgggcatttagctacacaaatgccaccccgttacagtcgcctggagtattcagtgcagtcacactctgcacgggcgtttagctacacaaatgccatggcgtcacagtcgcctgcagtattcagtgcagtcacatgctgcacgggcgtttacacaaatgccaccgcgttacagttgcctgcagtattcagtgcagtcacacgctgcacg

SEQ ID NO: 88976 - DNA, 160 bp, Homo sapiens
  chr21:47027910-47028070
  hypo
ggagaaatcaaagtccgagccgcagctatccctgctattctcaaattaggagaaatcaccgtgtcctacttgacttcagggtgggtggcgggcgttcccgcggcagctgcagcctcgcagtgcctgcgtgagccgtgctccgctgcgccccgggcagctc

SEQ ID NO: 88977 - DNA, 16 bp, Homo sapiens
  chr21:47034414-47034430
  hypo
gcgtgagccaccgtgc

SEQ ID NO: 88978 - DNA, 30 bp, Homo sapiens
  chr21:47034932-47034962
  hypo
gtggtgtttgcagtacgtgcagccgtggag

SEQ ID NO: 88979 - DNA, 96 bp, Homo sapiens
  chr21:47036030-47036126
  hypo
ccttccacggatttgcgaaagccatggagcttcatggaacaccacagagcctcccccagtcaccccactcctgcactgtcccgaaatgaggacaat

SEQ ID NO: 88980 - DNA, 83 bp, Homo sapiens
  chr21:47036475-47036558
  hypo
ggctgcccaggagcccgcgtctgcctcacccacccagaggagccaagtctctgctgaaaatgccccctcgtcacctttcccac

SEQ ID NO: 88981 - DNA, 146 bp, Homo sapiens
  chr21:47062752-47062898
  hyper
gggcgctgcggccccagcctccgggccggggccaggcccacagagaacgggaagcgggcgctgcagggggaccttcggggttgcggcacggctgggaattcaacggccattcccgtcccgtcgggcccacccgcccgcccgccaaa

SEQ ID NO: 88982 - DNA, 1044 bp, Homo sapiens
  chr21:47063432-47064476
  hyper
ttccagagaactttccgggctcggattggccgcgccggttgatgttccgccctttcattggcccgcggcgcccgctttcgcgagcctgcccttgggcgggggcggggccggcggcggcgcgcggcgctagattggttagcggcgcagaggggcgggcccgcgccgcgcgcagcgctcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggtgagtgagcggtggcgggcggggtcggggtcgggcgcccttgcgggttacggggacccagtccccgacggaggccgagtgacggggcgaccccgggccgcggcaaacttcgcccgagccggggcgggcgggggtcccgggctgggtcgcgccgtccccgaccgccgccggcgcctgcggcggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagagcgcggcctcacccctcggtgaccctgcggagagccgcgcgcgggcggtggggcgcgcgcaggtctctcttgttgctcgctgtgttttattttaattttgggggtggttagaacgtgtttcttattgtccccacacgtgttctaattggaagtcttgtttcgtgaaagagtttttttcttttttttgcctggtgatgttttccaattccctccgcgccactctgaag

SEQ ID NO: 88983 - DNA, 30 bp, Homo sapiens
  chr21:47167443-47167473
  hypo
aagacccagggcctgcggggatgggcagca

SEQ ID NO: 88984 - DNA, 30 bp, Homo sapiens
  chr21:47168125-47168155
  hypo
actcttgctcgtcagcgtgcatggtgagct

SEQ ID NO: 88985 - DNA, 151 bp, Homo sapiens
  chr21:47181649-47181800
  hypo
tgcttgtcctgtggacgtgagtgtcctgggccttgagggtgcagtgactgcctgaggcgctggccctcccttcccctctctgccagccttgacctggagcagacaccaccactgccaccgcaaccagggaggatgtcggaaggcccagctg

SEQ ID NO: 88986 - DNA, 30 bp, Homo sapiens
  chr21:47189452-47189482
  hypo
accgcctatccaggccggtcttgtgttccc

SEQ ID NO: 88987 - DNA, 131 bp, Homo sapiens
  chr21:47213449-47213580
  hypo
agaagatcgtctccccgagcacagagcgcatcacaggactgaccagtattgagtgggcgcggggaaaacatggctgccaggacctgtgaggaccgagtttcagatactgtggacagcggagactccacagg

SEQ ID NO: 88988 - DNA, 30 bp, Homo sapiens
  chr21:47254735-47254765
  hypo
acctggcacgcttttcggcagagcccagga

SEQ ID NO: 88989 - DNA, 30 bp, Homo sapiens
  chr21:47283366-47283396
  hypo
gccgggctgttgagtcgcccctgttggggg

SEQ ID NO: 88990 - DNA, 413 bp, Homo sapiens
  chr21:47287026-47287439
  hypo
cagcagccatagaagcgtgtgtggctgtttaacgtggtctttttggggagggcatcctaggcagagcaggcgtggaagggaaggcggcggacggaacaaaacgcgggcacgcaacggctgctgcgccggatctgaggcagggccagcctgtgggagcagcaacatcgctcgcaggacagcgatggagcccccacgaatccgcgtgaaagcagcaaccacctagaaatgaacgtacagctgcttagaaacagaatacggatgacccgaaagacttcccgatggtagtcaccagcatacaggacctgacacgggcgtgcgggcagggtgtgccgctacggggtccctggcgcacctgctacccctgctacccgcattcaccgcacgcggagggtgcgggccgtgaaggttataca

SEQ ID NO: 88991 - DNA, 30 bp, Homo sapiens
  chr21:47295773-47295803
  hypo
tccgatgttgattttcggctgtctggatcc

SEQ ID NO: 88992 - DNA, 30 bp, Homo sapiens
  chr21:47320229-47320259
  hypo
gtcaggtcagacctgcgccacccttgccag

SEQ ID NO: 88993 - DNA, 242 bp, Homo sapiens
  chr21:47328400-47328642
  hypo
gaagagggcacttttcgtggagagcaaatcctgttgccctgaatcgtaactcaggcataatggatccagagctgggggtgtcctgggggtgctgccctgtcactgcctctgccgcgctgtccgccacgctctgcagcgagctccggagctgccctgtcactgcctctgccgcgctgtctgccacgctctgcagcgagctccgggccacagcctggacacgccccatgcggctgacagaagcc

SEQ ID NO: 88994 - DNA, 30 bp, Homo sapiens
  chr21:47329348-47329378
  hypo
gtgtgggtccctgatcggcaaaggaggctc

SEQ ID NO: 88995 - DNA, 47 bp, Homo sapiens
  chr21:47333573-47333620
  hypo
gatgttcggggcaggcggtactctcaggaggccggtgtgtggcaaac

SEQ ID NO: 88996 - DNA, 43 bp, Homo sapiens
  chr21:47365144-47365187
  hypo
taccgtgacctcgagcggaggaatactgcgtcctctgcatcct

SEQ ID NO: 88997 - DNA, 295 bp, Homo sapiens
  chr21:47365639-47365934
  hypo
agccaacacctgaagcgctcactcctgcagctgcaaggaaatgaattctgccaacaacctgggtgggcccagaagtgggttctgccccagtccagcctctgcacgggaatgtgaccaccggctccccgatggcagcctgggagaccctgaagaacagaagccagctgagctgagccgactcctgacccaggaaccgtgagttaatacctgggtgccgcttcggcttctatgccttcggtcatttgatacacggctgcaaaagtaaggcagtggccagacacgtcactggcactcc

SEQ ID NO: 88998 - DNA, 157 bp, Homo sapiens
  chr21:47369368-47369525
  hypo
gtcggcttcgttcagcgtcacccagagaataacttctctttacctcccatggggattgtcttctaatttggagaagttggatatacctctattaagtgcagagctacacagtaataaaaaacacactctaggacattttgagaaaagcaaatgttcc

SEQ ID NO: 88999 - DNA, 399 bp, Homo sapiens
  chr21:47392726-47393125
  hyper
cggcaaccccacccgagggctcccactgctgcccacagacatctcagggtctcccgggccgggtcagcggcgccggaacagggtctcccgggccgggtcagcggcgccggaagtgattctcgtcagcaggaatgcgctggctgcccgggagccttcagggtgggctctgggggccaggtgcggcctcagcgccgtcccttcccgggaagcctcctccctggggtccacgccggctcctgctggctcccccattccgctgaaatctgaggaaaaggctctgggaacgcagccagactcccccacagctcagacggctgtaaagaaatattcctgccagatgttcagaggcggaggccagcatgaggtaacgggaaaggcttaacccgtccagccccgcag

SEQ ID NO: 89000 - DNA, 42 bp, Homo sapiens
  chr21:47393499-47393541
  hyper
ggcctctcaacccagcgagatcacagcgccatcgagacagtc

SEQ ID NO: 89001 - DNA, 222 bp, Homo sapiens
  chr21:47393601-47393823
  hyper
aaccagagcttctatggcggattctcaccagaaaatgaaattctcagcttacaggcaacggaacaaaatgaaatcaggccaatgcacgcggccccgggaagcaccagggggcctcagcgagctcctgagtttcacactcagtgcgggggtttccgcctcagcccctcttagcgggagtcactaaaggaaacgcagagagggcgggaacgcaaccccagcacc

SEQ ID NO: 89002 - DNA, 30 bp, Homo sapiens
  chr21:47394641-47394671
  hyper
acaggagccgagggccgcgtgcaccccttg

SEQ ID NO: 89003 - DNA, 99 bp, Homo sapiens
  chr21:47401911-47402010
  hyper
ggccagggccagatgcgcggggtcccctcccacgcgtggaactgcagactgggggcctggagcccctgaaccccactccccgctcggggcggctgcagc

SEQ ID NO: 89004 - DNA, 333 bp, Homo sapiens
  chr21:47403992-47404325
  hypo
cttgctggccacacccgcctgcacagccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgttcctggcaggtactaccgctgtgaccgaaacctggtgtggaacgcaggcgcgctgcactacagtgacgaggtggagatcatccaaggcctcacgcgcatgcctggcggccgcgacgcactcaaaagcagcgtggacgcggtcaagtactttg

SEQ ID NO: 89005 - DNA, 30 bp, Homo sapiens
  chr21:47407032-47407062
  hypo
tggaaagtaattctgcgtttccatttctct

SEQ ID NO: 89006 - DNA, 32 bp, Homo sapiens
  chr21:47414295-47414327
  hypo
ctgcagggggtgaggcgcggcctgggccgggc

SEQ ID NO: 89007 - DNA, 349 bp, Homo sapiens
  chr21:47417760-47418109
  hypo
cctggggtccctgaccgggccgggagtgcccgcagcatcactggctcctggccacagtcggcacctgagccagaggccgcctcggcagggcccctcctgccccgagatccgggtcccagggtccacggggaccagcagggtggccccaggggagggagccggcttctgggctgacggaggggccctgcgggtgaggtgctcccgggcctgtgccagccagtgggtatcccaggccaggccgattcgcacggtgacggctactctgctcccccagggagaagacggccccgctggaaatggcaccgagggcttccccggcttccccgtaagtgtccggaggctgagccca

SEQ ID NO: 89008 - DNA, 49 bp, Homo sapiens
  chr21:47418439-47418488
  hypo
tcccgagcaaacacacggggtacacaggcacccacggctgccccactgt

SEQ ID NO: 89009 - DNA, 144 bp, Homo sapiens
  chr21:47420442-47420586
  hypo
aggcccccgggtccccgcacaggctgagagtccccggtgcggtgcagagctgccacgtggggagggcggccggggaggcggggaggcggggcaggaggccggggaaggggggaggccggggaaggagggcggccggggaggcgg

SEQ ID NO: 89010 - DNA, 252 bp, Homo sapiens
  chr21:47421120-47421372
  hypo
actggaggggaggggcgtgctctgctgacaccgcccccgcctgcagaatgcaagtgcggccccatcgacctcctgttcgtgctggacagctcagagagcattggcctgcagaacttcgagattgccaaggacttcgtcgtcaaggtcatcgaccggctgagccgggacgagctggtcaaggtgaggcctcgccccgcccggctttctcaagcccaggtgcaccccgaccctgccggccgcccctgcccgcgc

SEQ ID NO: 89011 - DNA, 30 bp, Homo sapiens
  chr21:47421881-47421911
  hypo
cagggcagtcgtacgcgggtgtggtgcagt

SEQ ID NO: 89012 - DNA, 515 bp, Homo sapiens
  chr21:47422662-47423177
  hypo
aggtgcgcgcggggccgcccgggcagtcccagatctgcgtaggtgcacgcggggccgcccgggcagtcccagatctgcgtaggtgcacgcggggccgcccagggccgtcccagatctgtgtaggtgcgcgcaggcgcccagggctgtcccagaggcctcctcccagctcactgttacctccaggggcacggccaccctgtaggtgcgcacggggccgcctggggctgtcccacaggcatcctcctcccggctcgctgtgacttccgggggcacggccacccctgtgctcggccgggaggtcctgtgacatctccttgcggggttataggtggagcagtgggctcacactgcacggcttttctcttttacagacaagaagtgtccagattacacctgccccagtgagtacctcggcggccgggacacgtggggaggagggcaccgtggttggggcgagggctctgagaggacggggctctgggaggagggcctggcggtcacgagagtaggtgcat

SEQ ID NO: 89013 - DNA, 30 bp, Homo sapiens
  chr21:47423396-47423426
  hypo
aagcgcctggccgagcgcttcctcacagcg

SEQ ID NO: 89014 - DNA, 327 bp, Homo sapiens
  chr21:47425521-47425848
  hypo
ggctgttctgggggccgctaggggactaagaggatcggccgagggctgggctggaggagggcagcagggatgggcggcgagggtgagggtggggcttcctgaaggccttcacctgcggggaccccggcgagcccctcaggtgccacaggcagggacacgcctcgctcgatgcgtcacaccatgtggccaccagagctgcgggaaaatgctggggaccctgcatttccgtttcaggtggcgaacaagcgcccctcacagaactgcaggtagagacgggcccggggcagacgcagtgaggcggtgggcggggcccggggcagatgcagt

SEQ ID NO: 89015 - DNA, 286 bp, Homo sapiens
  chr21:47426447-47426733
  hypo
gaggcccacactctgcgtggagcctccccgtgcccaggctaccctgcaaggtcctcggagaggcttcctccagccccagcccccacacagctccggcccaggcccgctcttccccatcccagttgctttgcgctgtatacggccaggtgaccccgagccggccctgagccctcgtcccggcttcctcccctgtaagctgggtgaaggactccatggcacccacctgagagggttgtggcgaggcccaggcccctcgtgcccacacggccggcggcccatgcctggc

SEQ ID NO: 89016 - DNA, 73 bp, Homo sapiens
  chr21:47430142-47430215
  hypo
gactggcagcaccagcgccggtagtctgcaaggatgtggggtgactgcagccctcttgcgggctgtggggtgc

SEQ ID NO: 89017 - DNA, 30 bp, Homo sapiens
  chr21:47442780-47442810
  hypo
gggctgcttggtgaccgcctggcttgggcc

SEQ ID NO: 89018 - DNA, 65 bp, Homo sapiens
  chr21:47452998-47453063
  hypo
cccagtcccgggcctcggagagggcggctgacacccccagtcccgggcctcggagggggcggctg

SEQ ID NO: 89019 - DNA, 44 bp, Homo sapiens
  chr21:47457144-47457188
  hypo
gccaggccagacctccgtgggtggtccttcgtgtccacgtcagc

SEQ ID NO: 89020 - DNA, 72 bp, Homo sapiens
  chr21:47457442-47457514
  hypo
agtggctctctgtgccggggacgtcgcgtgctgggtcccggtctgaatgcttcctaacgatttacccagttc

SEQ ID NO: 89021 - DNA, 30 bp, Homo sapiens
  chr21:47457793-47457823
  hypo
cccgtttggaagggacgcggtgagacatga

SEQ ID NO: 89022 - DNA, 35 bp, Homo sapiens; identical to SEQ ID NO: 46592
  chr21:47459822-47459857
  hypo

SEQ ID NO: 89023 - DNA, 149 bp, Homo sapiens
  chr21:47461082-47461231
  hypo
ccacatgctgccgaccgacatcatctgtttaaagctgactccttgaaaatcagctgtgagtaaagggggcgttccaaactcaggcccttagagccagcgtgtgtggcccagtagccagagcacagtatgcctctcggccagtgggacca

SEQ ID NO: 89024 - DNA, 53 bp, Homo sapiens
  chr21:47470121-47470174
  hypo
atcctctgggcccaccgcagaactcactgtgcccacagcggggctctctgggg

SEQ ID NO: 89025 - DNA, 65 bp, Homo sapiens; identical to SEQ ID NO: 46593
  chr21:47471074-47471139
  hypo

SEQ ID NO: 89026 - DNA, 30 bp, Homo sapiens
  chr21:47472379-47472409
  hypo
gccggtgtactcaggcgcctgccagctggg

SEQ ID NO: 89027 - DNA, 133 bp, Homo sapiens
  chr21:47475230-47475363
  hypo
caggcagtgctaagccggccacactgaaggccaggaggcagcgcacggggacgctggaggagcacctggtgagctgggaggcgaggccctgggacgggacaagtagcagacgtctcagcgcacacaggctcct

SEQ ID NO: 89028 - DNA, 289 bp, Homo sapiens
  chr21:47487537-47487826
  hypo
ggccaacagtgttctcgagctcagctcagcactgcaaggggtcccgtgtgtcccaggaacggagctgggagcacgcggccaggcccactgaggtggaggagctgggagctgcccatcattccactccctgcgtaccgcactccccgctgtctcactcgctcccctgggcattggccagagccacttcgaggctctcaccggcctctcctccctgccaggggtctcggggccacaactgatgcacgtccctccctccattccgaatccccccacccgcagcagctatcac

SEQ ID NO: 89029 - DNA, 153 bp, Homo sapiens
  chr21:47489936-47490089
  hypo
gccgagctgagggggcggccagaggcgcttggcctgcagggagccgtggaggctggcggagcacggcaccctgggaaaggtggcaggggcaagagggtcacacaggtcataggccagcccagcgggcagggccctgcacgtccttctcactgg

SEQ ID NO: 89030 - DNA, 40 bp, Homo sapiens
  chr21:47501864-47501904
  hypo
aaccttcacaccacacggaggaacccgcaagacacgcatg

SEQ ID NO: 89031 - DNA, 34 bp, Homo sapiens; identical to SEQ ID NO: 16748
  chr21:47503061-47503095
  hypo

SEQ ID NO: 89032 - DNA, 43 bp, Homo sapiens
  chr21:47504852-47504895
  hypo
ctgggaggttcctcacgggcagctcgcccgacccaggtgcagt

SEQ ID NO: 89033 - DNA, 551 bp, Homo sapiens
  chr21:47517762-47518313
  hyper
acgggcggccgggcccgggacgcgaagtccgagcagcagcgggcaggggctggcgggggagctcggcccgggctgcaggggggtccccaccctctccacctcctccagcctcccgccctcgagggtccccgcttccctcccatccccctcccgtgcccccggccccctcctcccatccgcggggccgcagcgcttcctggcggcggggcgggtcaggccggcggggcggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcg

SEQ ID NO: 89034 - DNA, 517 bp, Homo sapiens
  chr21:47518349-47518866
  hyper
cggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagc

SEQ ID NO: 89035 - DNA, 181 bp, Homo sapiens
  chr21:47518887-47519068
  hyper
cgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggtgatta

SEQ ID NO: 89036 - DNA, 212 bp, Homo sapiens
  chr21:47531922-47532134
  hypo
tcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatc

SEQ ID NO: 89037 - DNA, 184 bp, Homo sapiens
  chr21:47537583-47537767
  hypo
atgcatcccaaacttcggtgtcactggacagctccatttccctgagcagcagatccaggcctggcctcttggtcactgagcctgggcctcacagtgagggtgggaggtgcgtcccgggctgggacaatggagcacttgggccctggctcatggggagaaccccacccgccgtgtgccgagctcc

SEQ ID NO: 89038 - DNA, 192 bp, Homo sapiens
  chr21:47538699-47538891
  hypo
tgggctctggggacacggggagggacaggaagaacaggccatgtgccctgagccaccagcccctctgacctgtgccctcctcacgaggctgaacaagttccaggggaccctgcagggcccccatgtgcctggcaagcagattccgctggaagataataggggctccacaccacacaccgcacaggcgtgacc

SEQ ID NO: 89039 - DNA, 36 bp, Homo sapiens
  chr21:47539603-47539639
  hypo
gtagagaaggagcatcggccccggcacagcccccac

SEQ ID NO: 89040 - DNA, 128 bp, Homo sapiens
  chr21:47545946-47546074
  hypo
gatgacctcaacttgcgggcgctgtgcgaccgcgacgtcacagtgacggccatcggcatcggggacatgttccacgagaagcacgagagtgaaaacctctactccatcgcctgcgacaagccacagca

SEQ ID NO: 89041 - DNA, 155 bp, Homo sapiens
  chr21:47548588-47548743
  hypo
aacctgagctccagtcggtggaaagaaaaggcagagacgttgcagaggccaggtctgctcaggggaagacagttctgggtgtagaggactcacatcccagagaggctgaggaagggtttaccaccgcaagctttctcaggcgggctcttgagggg

SEQ ID NO: 89042 - DNA, 94 bp, Homo sapiens
  chr21:47565176-47565270
  hypo
tcaaggtccagacagcggccagtggtgacgccctcaggcccctcctggtccccagcccctccccagccggaggctgacccgcttctcactgggg

SEQ ID NO: 89043 - DNA, 109 bp, Homo sapiens
  chr21:47570249-47570358
  hypo
cgggacagatcggctcgcccctcacagcagcagcggctgctcccgggctcacctgtgcttctcggcaggtctcctcgtagaccgtgtgcagtgccgtgacctcaaagtc

SEQ ID NO: 89044 - DNA, 246 bp, Homo sapiens
  chr21:47602459-47602705
  hypo
gccaccctcgactcccggggagcaggcgtcccgcgaccccctcatctaccaggccatctgagctgggcggcgcctcacctccgctcccgggggagccggcctcagggtaggcatgcgccctgggtgggagcaggtcgtggccgccgccctcctggcagctctggctgagcagccgccgcagcatctgattctccttcaggaggcgcacctgcttcttcaggtccgcgttctcgctcaggagccggc

SEQ ID NO: 89045 - DNA, 62 bp, Homo sapiens
  chr21:47689638-47689700
  hypo
gcagcagagtgtgtgcgaggtgaggtggcgctctgtgcggtgggccgcggtcctggtcacat

SEQ ID NO: 89046 - DNA, 175 bp, Homo sapiens
  chr21:47717212-47717387
  hyper
ctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggagg

SEQ ID NO: 89047 - DNA, 17 bp, Homo sapiens
  chr21:47717433-47717450
  hyper
cgcgcttccttccttcc

SEQ ID NO: 89048 - DNA, 70 bp, Homo sapiens
  chr21:47737895-47737965
  hypo
aaaacaggagcatcccgggctctgcctcacctgtcccaagagcttcagcgtcagtcgggtcacttgctct

SEQ ID NO: 89049 - DNA, 300 bp, Homo sapiens
  chr21:47746178-47746478
  hypo
gactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatgg

SEQ ID NO: 89050 - DNA, 349 bp, Homo sapiens
  chr21:47771760-47772109
  hypo
tttgcctcggaaggacggttgagtgctgtccaagtgcgggctcacctggtgtctggggtcacagggcagtgccccacatcctgctgccaggctcctgtggccccagctctccaggccacttgctgaaggcagctctgctccaggtgtccccttatagctgagcacctctggagaccccgaccccaggccccccattccgtgtcagagaggtctttgtgcagcaggcttggatggtgcctgagggcaggggctggccaagcccaattcaggcaccggcgcccaggtccacaggacaggagggtgagccactgcgtgtctcctggcattcatgtgccgacagagccttttg

SEQ ID NO: 89051 - DNA, 30 bp, Homo sapiens
  chr21:47798788-47798818
  hypo
ctatctttttgtgctcgttactttatgcac

SEQ ID NO: 89052 - DNA, 44 bp, Homo sapiens; identical to SEQ ID NO: 46610
  chr21:47799181-47799225
  hypo

SEQ ID NO: 89053 - DNA, 58 bp, Homo sapiens
  chr21:47799808-47799866
  hypo
catggtcactgcagccggcccaggacctcttgggcctttccagcgtgggcacagccct

SEQ ID NO: 89054 - DNA, 30 bp, Homo sapiens
  chr21:47808338-47808368
  hypo
gctgtgcggccacatcgcacacctgcggga

SEQ ID NO: 89055 - DNA, 33 bp, Homo sapiens
  chr21:47813009-47813042
  hypo
ctgccgggctcagggcggcgtcatctccccacg

SEQ ID NO: 89056 - DNA, 30 bp, Homo sapiens
  chr21:48068622-48068652
  hypo
ctgttgggggctcaccggtgactccatggt

SEQ ID NO: 89057 - DNA, 1088 bp, Homo sapiens
  chr21:48087199-48088287
  hyper
gcgcccgggaaggtgcggccaccctcacgcggaaggcggccagcggatcccggtgcgcgcagctcccagcgctggggttccagcgccccgcctcttcctatagcaaccagcgggacctgccgtcccccggggcaccccgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctgtaggttttcctctgggggtgggcggaggctccaaaccggacggttttctcctggaggactgtgttcagacagatactggtttccttatccgcaggtgtgcgcggcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggaccgcctccagccggaggtctgcgcccttctgaggaccctgcctgggggagcttattgcggttcttttgcaaatacccgctgcgcttggacggaggaagcgcccacgcgtcgaccccggaaacgaaggcctccctgatgggaacgcatgcgtccaggagcctttatttactcttaattctgcccgatgcttgtacgtgtgtgaaatgcttcagatgcttttgggagcgaggtgttacataaatcatggaaatgcctcctggtctcaccacacccagggtgacagctgagatgcggcttctccagggtggagcctcctcgttttccagagctg

SEQ ID NO: 89058 - DNA, 30 bp, Homo sapiens
  chr22:17076404-17076434
  hypo
gagcagggtctgcgtcggcgtggcagcgtg

SEQ ID NO: 89059 - DNA, 43 bp, Homo sapiens
  chr22:17081893-17081936
  hyper
ggcgttggattagaacgaagttgactccattccttttcctccc

SEQ ID NO: 89060 - DNA, 456 bp, Homo sapiens
  chr22:17082068-17082524
  hyper
cggctccctcccgccctcgcccgcagtcccccgatcccgatcccggatctctgggtccacagcttggctccctcccgagccggagccggagccggagccgaagtcgcggctgggcccggccgccccgtcacagggggagggaacccatggggagggggaggggcggtgaggtcagcggcggcggcgcgtccgcgggcggcgggagcttcgcatgcgcggagcgaggcccgtgagtggcagcggcggcgcgcggggggcgggcgaggggccgagagtgggggagcgggcgggggccgtcgaggaggcgttgtgtgggcgcgacggctgcgagttggggaggtctgtggtgcgggtcgccccgggggatccccggcgcgggcctcgcgcgacggccacggtcgcgcggcgtgtgtggggggtccacgcacacccgcaaaacttcctcctcccctgctc

SEQ ID NO: 89061 - DNA, 108 bp, Homo sapiens; identical to SEQ ID NO: 38446
  chr22:17082786-17082894
  hyper

SEQ ID NO: 89062 - DNA, 74 bp, Homo sapiens; identical to SEQ ID NO: 38447
  chr22:17082988-17083062
  hyper

SEQ ID NO: 89063 - DNA, 204 bp, Homo sapiens; identical to SEQ ID NO: 38448
  chr22:17083207-17083411
  hyper

SEQ ID NO: 89064 - DNA, 33 bp, Homo sapiens
  chr22:17083524-17083557
  hyper
cggagctgtcaaaacgcccgggccaggtggtct

SEQ ID NO: 89065 - DNA, 248 bp, Homo sapiens
  chr22:17083820-17084068
  hyper
cgtaaggcagaataccaagagcacttattcagagagagtgcagatgtaaatgtcgtttccctcgtaagtcttagctgtaaggggcttgggaatagggtcgcctgcctttgaccgaccgtactgtagggctggacaccggcttattagaggaccagaaatgtcttcttacagaacggttatttgacggctttgcttgtaaattaagacaccgttttagtgccagcgagctgctcggcttctgtggctct

SEQ ID NO: 89066 - DNA, 15 bp, Homo sapiens
  chr22:17090649-17090664
  hyper
ccgacgtcccccctc

SEQ ID NO: 89067 - DNA, 25 bp, Homo sapiens
  chr22:17090840-17090865
  hyper
cggccaagagcggatgcagcccggg

SEQ ID NO: 89068 - DNA, 79 bp, Homo sapiens
  chr22:17129959-17130038
  hypo
cctaaaggcacgcagcgggcaagagactactgggcggacccctgccagccttcagttccatgagcgtctggtgccagga

SEQ ID NO: 89069 - DNA, 37 bp, Homo sapiens; identical to SEQ ID NO: 46611
  chr22:17330739-17330776
  hypo

SEQ ID NO: 89070 - DNA, 37 bp, Homo sapiens
  chr22:17489436-17489473
  hypo
tggagaggacaagaacgaggggcgcagctcattcaga

SEQ ID NO: 89071 - DNA, 190 bp, Homo sapiens; identical to SEQ ID NO: 38452
  chr22:17600944-17601134
  hyper

SEQ ID NO: 89072 - DNA, 247 bp, Homo sapiens
  chr22:17601259-17601506
  hyper
cgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcaccacggacagcgcctggtagccccagcggcacctgggactgggggcgcagccgcggcgccgacctctgcggccggggcggtctgggcagccgcagcagcagcaac

SEQ ID NO: 89073 - DNA, 71 bp, Homo sapiens
  chr22:17601956-17602027
  hyper
gcggcgggaaggaaccggacgcggaggagaccgagcgagggtggccgagcgccgggcgcattgtcctccga

SEQ ID NO: 89074 - DNA, 321 bp, Homo sapiens
  chr22:17602324-17602645
  hyper
aaccaggactggattcgagggggagaggaagcagcgagaccagaggaggagaaagcgcggcgcgctggatcaacgggaagagaaggggcgggggtgcagtgcgtcacagtcgggtcgggagccctgtggcctggaggaagcgggaggaggcgcgggcagccgccagggcgaggcgacccggtgcggggggactcccatggagcgcggactcctaaggaagtcgctgggaatcccaccggctgtaccgcagggcgttagtacctagatggcttcggtgcccccaagcgatgggctcaagctacagggcgggctttgcacctg

SEQ ID NO: 89075 - DNA, 15 bp, Homo sapiens
  chr22:17849412-17849427
  hyper
ttagcagtactccac

SEQ ID NO: 89076 - DNA, 376 bp, Homo sapiens; identical to SEQ ID NO: 38456
  chr22:17849501-17849877
  hyper

SEQ ID NO: 89077 - DNA, 1039 bp, Homo sapiens
  chr22:17850114-17851153
  hyper
caaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaaggaaagtttgggactccgttattcttccacagcgtccttcctcccgtaatatccagcctctttatcgcggggctcgggagcccttggagttgatctcgccaccattatccccccgggcgagcgcggaggacgggctggccattctggccaggccggaggtgttttccagcccggggctttgtgataactgggccgaaacccgagggtcctggagcgcggcgggtggcgggagcttgcggagcgcggcgcactcggcggccaggcatcggccagcccagcggcagccccctttctcctatttttatttttatttttggaaggagctgagaattagtcgattggttggcaggttgaattgccttctcttctatggcaatatgtgtcgtgacttttcaccttttgcctttggacaaaggtgaatggcaactgcgttggtcagtttttgttttctgttctgcggatgggttcgccgacgcagtaatcaaaattagagccactcttttggaagagcaaatcgttgttgttgcctccccagccccacggatcttactttgtgccattttcgggttgattttaactcgtttatttcagagctctttgcctcacctttatttttagatttagtcgtgtttgctgaaatatcagttgcttcttctgtgaatgaagtgtgggaacttgctctcgtcgcagttaatgaaat

SEQ ID NO: 89078 - DNA, 120 bp, Homo sapiens; identical to SEQ ID NO: 46612
  chr22:18009965-18010085
  hypo

SEQ ID NO: 89079 - DNA, 97 bp, Homo sapiens; identical to SEQ ID NO: 46613
  chr22:18110592-18110689
  hypo

SEQ ID NO: 89080 - DNA, 47 bp, Homo sapiens
  chr22:18265476-18265523
  hypo
ggagccgctcccaggcgtgccgtgggcagggccgggtcagccttcag

SEQ ID NO: 89081 - DNA, 30 bp, Homo sapiens; identical to SEQ ID NO: 46614
  chr22:18265801-18265831
  hypo

SEQ ID NO: 89082 - DNA, 30 bp, Homo sapiens
  chr22:18272947-18272977
  hypo
attcaggagcctgcccgcacctccatgtct

SEQ ID NO: 89083 - DNA, 263 bp, Homo sapiens
  chr22:18328093-18328356
  hypo
gggtaacgtggggaacgcatactgtctggcaagaattctactaggaccacgggaaacaaagcagattaaaacactctctactctaaaagagcttcagtagcacctgggagagggccctgcaggaatcctttcggtacgacgtgtcaagtaccatgagccacgtatgcactcatgggagaacatagagagagtgagtcagcacacctggcagagtcaagaaaggtgttctggaggcatatggagttagccggctgcaaaaaaaa

SEQ ID NO: 89084 - DNA, 130 bp, Homo sapiens
  chr22:18355580-18355710
  hypo
ccaatgagctcactccgcccgtgtacatctttatatacttctatcggttgaagattacaaaatgaccagaatgaagggaaatgagaaggaaaaaaatacataaattaagaagacacggggaaaaaaagaa

SEQ ID NO: 89085 - DNA, 30 bp, Homo sapiens
  chr22:18422755-18422785
  hypo
tcaaagcaccacagccggcagtcctgtacc

SEQ ID NO: 89086 - DNA, 30 bp, Homo sapiens
  chr22:18432493-18432523
  hypo
ggtccaaacaaaagacggatctgtaaagca

SEQ ID NO: 89087 - DNA, 30 bp, Homo sapiens
  chr22:18470447-18470477
  hypo
cactgggaactttctcgatcactgtcctgt

SEQ ID NO: 89088 - DNA, 30 bp, Homo sapiens
  chr22:18553593-18553623
  hypo
cacctctgtcatgagcgattaggggaaggg

SEQ ID NO: 89089 - DNA, 121 bp, Homo sapiens
  chr22:18553829-18553950
  hypo
atcctcagtgagggacgataagagactggggctggggggatgggcagaatctttgctgttgccacaaactgggagtgtccgcagaaaactgaatgtgtctggacttcgccatcaaaaccca

SEQ ID NO: 89090 - DNA, 53 bp, Homo sapiens; identical to SEQ ID NO: 46618
  chr22:18634479-18634532
  hypo

SEQ ID NO: 89091 - DNA, 196 bp, Homo sapiens
  chr22:18923386-18923582
  hyper
agggactgcaggaaacgcctcccttcctggcttcccttgctccaggagatgcttgggaggcacccgtttcaggccaggaagctccgtaaaggctcccgggaccggcagaagcccccgcgcccccgcctgcaccccgcgcacctgctcgtggcgcgccagcagcgcgggccaggcgcacaagcgcagcaccagcagg

SEQ ID NO: 89092 - DNA, 116 bp, Homo sapiens
  chr22:18958033-18958149
  hyper
gggccggggctgggccggagcggcggcgcctggatgccggcccggggctgggccggagactggcgcccgccccgaagcgactttcggtccccgacccgctccgcctgacccctatg

SEQ ID NO: 89093 - DNA, 209 bp, Homo sapiens
  chr22:18986543-18986752
  hyper
tcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctcca

SEQ ID NO: 89094 - DNA, 30 bp, Homo sapiens
  chr22:19011932-19011962
  hypo
tgacacttgccaaagcgctgtagggaagac

SEQ ID NO: 89095 - DNA, 760 bp, Homo sapiens
  chr22:19016838-19017598
  hyper
gggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgc

SEQ ID NO: 89096 - DNA, 166 bp, Homo sapiens
  chr22:19020499-19020665
  hypo
gctctctctcacctccgtgggagcactccggccaccccaccttgttcccgagtctacctccatagcctggcgctgcctgtccaggctgtgctccgagtctgctcgcctcgggcccccccaccgccggcagttgaagtgcagctgcagtgcgcggtagacaggcaac

SEQ ID NO: 89097 - DNA, 42 bp, Homo sapiens
  chr22:19030399-19030441
  hypo
atggcagagaaaatgcgcatcccctgacgcacccagccctgg

SEQ ID NO: 89098 - DNA, 45 bp, Homo sapiens
  chr22:19048344-19048389
  hypo
agcgctccaccaaggcgcacaggaaccctgcggaaacgagctccc

SEQ ID NO: 89099 - DNA, 139 bp, Homo sapiens; identical to SEQ ID NO: 46619
  chr22:19117537-19117676
  hypo

SEQ ID NO: 89100 - DNA, 30 bp, Homo sapiens
  chr22:19125886-19125916
  hypo
gccggtgggcaaacacgtgggaacatgctg

SEQ ID NO: 89101 - DNA, 80 bp, Homo sapiens
  chr22:19132825-19132905
  hypo
ccaaaacaatcttttttttttttttatagttatctaacaaaaggtgaaagaacaagacagtggttcgattaagaaatgtc

SEQ ID NO: 89102 - DNA, 56 bp, Homo sapiens
  chr22:19444363-19444419
  hypo
gataacacttactgtcgactcctcatgctggacttgtctttcgggttctttgtagc

SEQ ID NO: 89103 - DNA, 198 bp, Homo sapiens
  chr22:19510749-19510947
  hyper
ctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctg

SEQ ID NO: 89104 - DNA, 315 bp, Homo sapiens; identical to SEQ ID NO: 1517
  chr22:19511141-19511456
  hyper

SEQ ID NO: 89105 - DNA, 335 bp, Homo sapiens; identical to SEQ ID NO: 1518
  chr22:19511541-19511876
  hyper

SEQ ID NO: 89106 - DNA, 67 bp, Homo sapiens; identical to SEQ ID NO: 1519
  chr22:19512252-19512319
  hyper

SEQ ID NO: 89107 - DNA, 51 bp, Homo sapiens
  chr22:19512376-19512427
  hyper
cgtagaggccctcgtaggggggctctccagaaagcccgccccggggtccaa

SEQ ID NO: 89108 - DNA, 167 bp, Homo sapiens
  chr22:19706198-19706365
  hyper
ctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaac

SEQ ID NO: 89109 - DNA, 331 bp, Homo sapiens; identical to SEQ ID NO: 38467
  chr22:19706366-19706697
  hyper

SEQ ID NO: 89110 - DNA, 50 bp, Homo sapiens
  chr22:19711690-19711740
  hyper
gagcgtgcgccctaccgcgacctgcgttgcgtggcgcccccagcgctgcg

SEQ ID NO: 89111 - DNA, 49 bp, Homo sapiens
  chr22:19723403-19723452
  hypo
cgtaaattgtgcagtcgacgacacatttatcccgcgggcggctggcggt

SEQ ID NO: 89112 - DNA, 30 bp, Homo sapiens
  chr22:19726569-19726599
  hypo
acaagatgcccctcccgctcctcaggggtc

SEQ ID NO: 89113 - DNA, 145 bp, Homo sapiens; identical to SEQ ID NO: 14032
  chr22:19742613-19742758
  hyper

SEQ ID NO: 89114 - DNA, 204 bp, Homo sapiens; identical to SEQ ID NO: 38470
  chr22:19742788-19742992
  hyper

SEQ ID NO: 89115 - DNA, 37 bp, Homo sapiens
  chr22:19748231-19748268
  hyper
gcgcctcctcggggccggcctgcggtgtggggctgca

SEQ ID NO: 89116 - DNA, 320 bp, Homo sapiens
  chr22:19748589-19748909
  hyper
cgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcg

SEQ ID NO: 89117 - DNA, 103 bp, Homo sapiens
  chr22:19748960-19749063
  hyper
cgccgtcccggctccggcgacagccgcccggcgctcccctcctaacacctatcctccgccggggcgggaggagacggcgcgggccgcacgggaacggcgagga

SEQ ID NO: 89118 - DNA, 219 bp, Homo sapiens
  chr22:19771670-19771889
  hypo
tttctaaagaacccccggagggttgtttttctttgtgcaaacactccttttgtgcagagggtgttctgtggcttcttggcagagacacaggtgggaaacacctgattgaacatcattgcctggggagtggagacacgcacagcacgtcaacatggagcgcccagcagcggcggcgggtcctgggctgtgctccggagcccttcccgggatcatctcccg

SEQ ID NO: 89119 - DNA, 30 bp, Homo sapiens
  chr22:19839985-19840015
  hypo
tcgcaggccatcatccgaggcaatctgtcc

SEQ ID NO: 89120 - DNA, 43 bp, Homo sapiens
  chr22:19856455-19856498
  hypo
gctgtctggtcctcacggcggccctccgcgggtggggtgggat

SEQ ID NO: 89121 - DNA, 47 bp, Homo sapiens
  chr22:19876172-19876219
  hypo
gggaggctccagggccggtgggcgatgcgaggcgggcacggcttcac

SEQ ID NO: 89122 - DNA, 30 bp, Homo sapiens
  chr22:19951604-19951634
  hypo
gtgggcactgacaggcgctgttgtataggt

SEQ ID NO: 89123 - DNA, 38 bp, Homo sapiens
  chr22:19961683-19961721
  hypo
agggtgttgaagttccggctctccgtgaggagggagag

SEQ ID NO: 89124 - DNA, 155 bp, Homo sapiens
  chr22:19964966-19965121
  hypo
gcatcatcccgcctccggcgctgggagcctacagcactgcccaggggcccgggctcggcctcctggtacctgtcggccccgggcacctccttgtgcacgtggtaggacaggttccgcatgatgcacacgcagttctccaccgactgcagggagag

SEQ ID NO: 89125 - DNA, 71 bp, Homo sapiens
  chr22:19970544-19970615
  hypo
aggcccaacccctgccgcgctgagtggcttgaggacctaagactcacagcctgccccgggcctctgactgc

SEQ ID NO: 89126 - DNA, 142 bp, Homo sapiens
  chr22:20027370-20027512
  hypo
aacacactcaccccccgagatgatgcacataccccccggacagtacacgcactcaccctgcctagcagcgtgggtgtcaggtggtgatggataattagtggtttcagttattggaacaaaataaagccgaggtgacttgcca

SEQ ID NO: 89127 - DNA, 121 bp, Homo sapiens
  chr22:20027900-20028021
  hypo
gtcagaatcagcacccgaagccaacagccccagcctggtttggggctggactgggatgaggtgtccctggctcccccgacccctgttcacctgcagggctgtgggacgtggaagcagagga

SEQ ID NO: 89128 - DNA, 30 bp, Homo sapiens
  chr22:20108065-20108095
  hypo
ggcagagagcagagtcgtctgagagaggca

SEQ ID NO: 89129 - DNA, 42 bp, Homo sapiens
  chr22:20137019-20137061
  hypo
gcacagcaggcccctcgccccgccctccgtggcctctcgccc

SEQ ID NO: 89130 - DNA, 151 bp, Homo sapiens; identical to SEQ ID NO: 46623
  chr22:20166058-20166209
  hypo

SEQ ID NO: 89131 - DNA, 44 bp, Homo sapiens
  chr22:20254350-20254394
  hypo
aggcacacatgatcacgcgcacagacacacgtgcagatgcatac

SEQ ID NO: 89132 - DNA, 217 bp, Homo sapiens
  chr22:20271994-20272211
  hypo
gggctggtgagagcccggtggggtgggtttcaggtgctgcttgtccagggctcagctctgttccttggggctccctcagcccaagggcccacctcccctctgggcagccccgatcggcgtgttctgcctcggccagctgtcagccacctgcagctcctccctcattgcaccaccctggagcatcacggtgcccagggcaggccgtggagacctggct

SEQ ID NO: 89133 - DNA, 30 bp, Homo sapiens
  chr22:20285993-20286023
  hypo
gaggcaaaggggccgcgagagggtaggtgc

SEQ ID NO: 89134 - DNA, 30 bp, Homo sapiens
  chr22:20287662-20287692
  hyper
agccaggaagggaggcgtttcctgcagtcc

SEQ ID NO: 89135 - DNA, 79 bp, Homo sapiens
  chr22:20295969-20296048
  hypo
ctcccctcctgcagccgctgtgcatgtcgtgccacagcgcacacatctccgccattgttgtttgcgctgtagcgtgtcc

SEQ ID NO: 89136 - DNA, 86 bp, Homo sapiens
  chr22:20308760-20308846
  hypo
ccagagctggtcatgcgccgggcaccctggcctccaggtccctcagaatggcaggagctggaggtgggactcgagattgtgggagc

SEQ ID NO: 89137 - DNA, 42 bp, Homo sapiens
  chr22:20749361-20749403
  hypo
gcgcccaatcatttgttcccactcagacgtgcttgattgggg

SEQ ID NO: 89138 - DNA, 23 bp, Homo sapiens
  chr22:20765466-20765489
  hypo
aacatgaacggctgggcacagcc

SEQ ID NO: 89139 - DNA, 1812 bp, Homo sapiens
  chr22:20790558-20792370
  hyper
gctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcc

SEQ ID NO: 89140 - DNA, 118 bp, Homo sapiens
  chr22:20792481-20792599
  hyper
cgcaagcccacccccgctcccagcgcctcggaaccggccaagggagtggggcccgcagacagcccaggtcgaggccgaaagccaactccacagcaccccaccgcgaagtccttgtagt

SEQ ID NO: 89141 - DNA, 40 bp, Homo sapiens
  chr22:20851270-20851310
  hypo
aaagaaaggtggggccgggcttggtggctggcgcctgtaa

SEQ ID NO: 89142 - DNA, 88 bp, Homo sapiens
  chr22:20864327-20864415
  hypo
gtgtttttctgttgccgctctaacaaattaccacaagtttagcatcttaaaacaacacacctttagccaggtgtggtggctcacgcct

SEQ ID NO: 89143 - DNA, 147 bp, Homo sapiens
  chr22:20864655-20864802
  hypo
agcgagactccatctcaaaaacaaacaaacaaaaaacacacatttatcatttggtagtttctgtaggtcagaggtccaagtaggttccactaggtctcctgctatcaaggcctatcaaggctgaaatcaagacgttggcagggtgca

SEQ ID NO: 89144 - DNA, 92 bp, Homo sapiens
  chr22:20933768-20933860
  hypo
ggacacactgagtgccggagccaggagcaaggaacggttcccagtatgtgggggcgggggtggggatcgcgcagtgccgccagccttgcctg

SEQ ID NO: 89145 - DNA, 30 bp, Homo sapiens
  chr22:21011807-21011837
  hypo
tgaagactgcagccccgcctgagcattaag

SEQ ID NO: 89146 - DNA, 46 bp, Homo sapiens
  chr22:21024902-21024948
  hypo
ggtccaccgcgttgccgtgcgagaagaagaccgtgtacctggcacc

SEQ ID NO: 89147 - DNA, 84 bp, Homo sapiens
  chr22:21058566-21058650
  hyper
cgccgcccacctgcccgcctttcgccctgcaggcgctgctgacgctgccgctcctcttcctggggctgtcgctgctctggacgg

SEQ ID NO: 89148 - DNA, 149 bp, Homo sapiens
  chr22:21105244-21105393
  hypo
aaaatcatgcttgtgcgacgcagactcgagaggctataaactggctggtagctgaagacctctttggcagctaaaccgagaacacagctgagtcaacatggctgaggtgggggagctgggcttggaagacagagcgacctgggggcagc

SEQ ID NO: 89149 - DNA, 30 bp, Homo sapiens; identical to SEQ ID NO: 46630
  chr22:21150528-21150558
  hypo

SEQ ID NO: 89150 - DNA, 30 bp, Homo sapiens; identical to SEQ ID NO: 46631
  chr22:21153993-21154023
  hypo

SEQ ID NO: 89151 - DNA, 91 bp, Homo sapiens; identical to SEQ ID NO: 46632
  chr22:21214252-21214343
  hypo

SEQ ID NO: 89152 - DNA, 29 bp, Homo sapiens
  chr22:21304978-21305007
  hypo
gccgtgagccgccgcgcctggcctagact

SEQ ID NO: 89153 - DNA, 592 bp, Homo sapiens
  chr22:21311370-21311962
  hyper
ctgtagcccatgtaccgcgtgacgtgagagcggagcccgggtctgcccgggcgcgggcccgcggccacggcgtttggatcccagatcccagcccccgcgctcagtccgggcttcctgaccggcgctctccgcgtcccttctcgcgcgcccttacctggggctggggaggtggggacagagccgggcgcagtcgggggcacagccctgaggcggggctgagggccaggccgccacgtccctggaccctgaaaacgggctcggacccccgctgcagcgtggactccggtgtggccgcggggcgtgcaacccggaccctggccagctccgtgtcctccagacctttactcatgtccccgcatcgccaggccgagctgcaccttcggtccccgcccgcggcagccgaggtagggcatctccagcgccgactccggggaaggtggacatcgcacggaagggggtgaagggcagggaggatcccagcttgggatgggggtagagggtggcggaccttgcgcggggcgggtgtggagggcggcccaactctcgtggcccctggtgcttccgggagctccgtcctcgctctcggatccca

SEQ ID NO: 89154 - DNA, 32 bp, Homo sapiens; identical to SEQ ID NO: 38476
  chr22:21319163-21319195
  hyper

SEQ ID NO: 89155 - DNA, 306 bp, Homo sapiens
  chr22:21319585-21319891
  hyper
tgcgctcccaagtctcggaccccggcccggcacgttaggggctgggggttggcaagcggggccagaggcactggccggggtccgaagctcacctcgtccttctctcgtcccacaacggccccttcccggctcgccgcggggccccactgtgtgccagtcccccttctcgggctgcaaggtctggcgggggcaacgggacggagccggcgaggctgctggcatcggcttcccagagagagggaactgcacgtgcagaggcggggagagtggacagaggcttgccctgagctccgtgggggaggggag

SEQ ID NO: 89156 - DNA, 276 bp, Homo sapiens
  chr22:21333740-21334016
  hyper
gggcagggctatgaccgcactaggaagaggccggtaagaactcgctggcggcaaggctacgaactacctaaaaggacgtatggagcagggcctgggcggggttaggaggggatcctgtgacgtctcgttccctcccccggctcacgtgggtgccacccacctgcccggcccacaggctacggagaaggcttcgacgacgtcatcatccagggggatctggaggagctgaagtttgtggctttttacactaagtgagagcaccggggtgcagcttgg

SEQ ID NO: 89157 - DNA, 260 bp, Homo sapiens
  chr22:21354214-21354474
  hypo
tccttcagagtctggcgggcatctgcctgtgcccgcttctcccgtgcccgctcctgctgcagcttggtcagtctcaaccgcagccgctgctcccgccgcttgcaggcctgcagctggcgctgggccttgtcaagggcatcaagggctgcctcggctcgccgcttccagagtaaggcgctgcccacctggtagctgtgttcattctggatgtaggctccggcgggtgggggcaggcgcagcatatacgctgagggggagac

SEQ ID NO: 89158 - DNA, 81 bp, Homo sapiens; identical to SEQ ID NO: 38479
  chr22:21368301-21368382
  hyper

SEQ ID NO: 89159 - DNA, 262 bp, Homo sapiens; identical to SEQ ID NO: 38480
  chr22:21368435-21368697
  hyper

SEQ ID NO: 89160 - DNA, 63 bp, Homo sapiens
  chr22:21380295-21380358
  hypo
tcaggcagggaagttcgggctcatccccacggccgtcacactgggcaccggggcagcttggct

SEQ ID NO: 89161 - DNA, 298 bp, Homo sapiens
  chr22:21386579-21386877
  hyper
acagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccgg

SEQ ID NO: 89162 - DNA, 120 bp, Homo sapiens
  chr22:21386893-21387013
  hyper
cgcccccatcccaggccccccgcgcggccccacccgctgccacacacccagatatttcaccctgcccactctgcccgacctcgcaaggtcgttaccggagctcaccggggtctagggaag

SEQ ID NO: 89163 - DNA, 240 bp, Homo sapiens
  chr22:21400043-21400283
  hyper
agcctcagcacaagccggccacagtttctacggcaaccgacaacaccgggttgccggggcgaccgccgcgggagagcgcgtcgctattggctgtggggggtgcctgttgctggacggcacattcggttggtcagcgcagccgcagactccgcccacaatcccgggccgcgctctgggcgcggggtcaagctgtctccgactcagtgtctgagactgcgagagggtcgtaaccatgagggg

SEQ ID NO: 89164 - DNA, 30 bp, Homo sapiens
  chr22:21805390-21805420
  hypo
cactggctcatttctcgcaaatacctcgaa

SEQ ID NO: 89165 - DNA, 30 bp, Homo sapiens
  chr22:21945402-21945432
  hypo
tggtccctcaggttccgtacctccttatgc

SEQ ID NO: 89166 - DNA, 45 bp, Homo sapiens
  chr22:21977345-21977390
  hypo
gtgtgtcaccaaccccgcttctgccactggcggcttcccttcttg

SEQ ID NO: 89167 - DNA, 36 bp, Homo sapiens
  chr22:21978264-21978300
  hypo
ctttctaagatgctgcgatcccgttctgctgcccgt

SEQ ID NO: 89168 - DNA, 249 bp, Homo sapiens
  chr22:21982792-21983041
  hypo
gggcgcaaagctgcacgccatcctgggcaagctgggcccgcagcgtgggcgcggtgaggacgcgcagctcatgcagccgctcccaagagcaagagaaagcgtcggggccttcaccgcagccgccggtgggaggcacactggggtagccggggtgcgccatcagctcggctgtcagggtgtggcccgctagggtaccttccaggacccgcgccagggccccggacacgcggtgagcggacatgtgccggc

SEQ ID NO: 89169 - DNA, 144 bp, Homo sapiens
  chr22:21986687-21986831
  hypo
ggaggcccagggctgcgcagcaaccaaggaggacacgaggaaggtgcttgtgccaccggtggaagacgtggctttggcttttaggctcccctcggggcaggagcagatcaaagagcctagccccagcttcggtggtgggtgggg

SEQ ID NO: 89170 - DNA, 20 bp, Homo sapiens
  chr22:21992966-21992986
  hypo
attaacggcatgagcaactg

SEQ ID NO: 89171 - DNA, 50 bp, Homo sapiens
  chr22:22006098-22006148
  hyper
ggcttggcgggggttcgggaatttccacagggtctcggcctcccccactg

SEQ ID NO: 89172 - DNA, 30 bp, Homo sapiens
  chr22:22036143-22036173
  hypo
tcctcttgggtgaggcggggcaggccccac

SEQ ID NO: 89173 - DNA, 333 bp, Homo sapiens
  chr22:22058076-22058409
  hypo
ggccgtcccagggcccgtgccgctccccccgggctgaaccagggtactcacacggaattgaagaggtaggcgcgtccctggctcccctgaaaggactgaaagaagaaggtcccgtgagattggctgcgagtgctttctggaacgaagcggtgctgcccagaaccaggggagtccagccccgcggctgttagctgcgccgggacgcgtcaccgggagcagacaccggcgtcccccctccagaactccacttctaataacagccacttaacggagctgcaagctgtttttcattgtagacaggagtggctgattctgctgcgtcaacattctgca

SEQ ID NO: 89174 - DNA, 30 bp, Homo sapiens
  chr22:22272279-22272309
  hypo
agaaggctctgaagccgtctccaagagcag

SEQ ID NO: 89175 - DNA, 30 bp, Homo sapiens; identical to SEQ ID NO: 46637
  chr22:22344036-22344066
  hypo

SEQ ID NO: 89176 - DNA, 255 bp, Homo sapiens
  chr22:22862608-22862863
  hyper
tttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctc

SEQ ID NO: 89177 - DNA, 88 bp, Homo sapiens; identical to SEQ ID NO: 4903
  chr22:22863219-22863307
  hyper

SEQ ID NO: 89178 - DNA, 379 bp, Homo sapiens
  chr22:22899599-22899978
  hypo
ttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagag

SEQ ID NO: 89179 - DNA, 350 bp, Homo sapiens
  chr22:22901105-22901455
  hypo
actgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcg

SEQ ID NO: 89180 - DNA, 30 bp, Homo sapiens
  chr22:23017536-23017566
  hypo
tagaccttgtaggcacgaattttggagcaa

SEQ ID NO: 89181 - DNA, 55 bp, Homo sapiens
  chr22:23437576-23437631
  hypo
cggacggcttcccaccgtcgccgaggacagggaatgactacggcaaatcaggcca

SEQ ID NO: 89182 - DNA, 170 bp, Homo sapiens
  chr22:23453131-23453301
  hypo
tccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatga

SEQ ID NO: 89183 - DNA, 104 bp, Homo sapiens
  chr22:23791402-23791506
  hypo
cttcaatgtgctctgcgctcctgctgccctcggggccagtccctgtcttttaacccacactcagccccttctccctccttctccatccccgccacctcctctaa

SEQ ID NO: 89184 - DNA, 30 bp, Homo sapiens
  chr22:23792721-23792751
  hypo
tgggactgtgccggccgccaaccccgcccg

SEQ ID NO: 89185 - DNA, 30 bp, Homo sapiens
  chr22:23800930-23800960
  hypo
tggatggagccaggccgccctgtggctcct

SEQ ID NO: 89186 - DNA, 30 bp, Homo sapiens
  chr22:23801462-23801492
  hypo
tctttgaggagccgccggctgtttgcagtg

SEQ ID NO: 89187 - DNA, 168 bp, Homo sapiens
  chr22:23860776-23860944
  hypo
cccttctcggagtggcggcttctccacctataaaacagggtcattaacgtgcttgtttgaggatttgctgagctaaagcatttacaacacctagcccaaagtaagcacttgttacatatcccaggatccctgggagccaggtccacggtggagcgctcatacacagca

SEQ ID NO: 89188 - DNA, 215 bp, Homo sapiens
  chr22:23908072-23908287
  hyper
gtgtgtccctggacacggcgtctcccctcgctgagttactttcctcatttgtaaaacggggatatgacccgtctcttagagtgactgggaagatcggtggtatcaacgcaaactacagcccggcagcttccaggcaaactcacttctcaggacgcctgtcctgctgtcttctcaaagaggtggatgaagccaccaccacccggtttacagatgag

SEQ ID NO: 89189 - DNA, 355 bp, Homo sapiens
  chr22:23908599-23908954
  hyper
gaggagggagaggcccgagcagggggcccgcccccgccgcccccctggtccccgccccgccgagcgtgcccggccgggtctgcagccgtcagcgccaagcgcggccccgcggctccgccgagagatcgataactaatttcaccgcggtagccgccccagtttttccccgataattgcgcgccggcagctgtgagcgaggcccccagcgcggcgcgaagcccctcccgcgccgatcaattgacaccgccaccgggcggcaggaaaactcatttttctttctctccccggctccgggtgggcgcgagctgagctctgccaagggccgggggctgcttggggccggggcggggaggga

SEQ ID NO: 89190 - DNA, 126 bp, Homo sapiens
  chr22:23915557-23915683
  hypo
caggtagctgctggccgcgtacttgttgttgctctgtttggagggcgtggtcatctccacgccctgggtgatgggggtaccatctgccttccaggtcaccgtcaagattcccggataaaagtcatt

SEQ ID NO: 89191 - DNA, 28 bp, Homo sapiens
  chr22:24091898-24091926
  hypo
gcgtgagccccctcgcccagccctaaag

SEQ ID NO: 89192 - DNA, 472 bp, Homo sapiens
  chr22:24180522-24180994
  hyper
cctgcgggaaggatacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 89193 - DNA, 673 bp, Homo sapiens
  chr22:24181054-24181727
  hyper
cgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaagacaggcccacctaacccacagcagggaggcattcgggaatgtgtccaa

SEQ ID NO: 89194 - DNA, 223 bp, Homo sapiens
  chr22:24209104-24209327
  hypo
tccccttgagaggatcgcagccaggctgaggcaacctcccagggagggagccagggaacagacactcctacttctctctcctgcctcctgatgtcctgctggtgctcaccattggccaagttggtcagtaagggagcctactgatgtgggctgcacaggtggctccctggggcaaaagcagggtgggaggggactgcagtggattcctcgggtatggtataat

SEQ ID NO: 89195 - DNA, 30 bp, Homo sapiens
  chr22:24224775-24224805
  hypo
acaggtgacaagcctcgtggttctgggcag

SEQ ID NO: 89196 - DNA, 155 bp, Homo sapiens
  chr22:24238113-24238268
  hypo
tcagttatgtttgggcgcagtggcacaagcctgtgatcccggcactttgggaggtggaggtgagtggagtgtgactcctctgcttctctcagtctccagccacatctcgtctccagtcccctgttcactcggtcatcccgcgcagtactggacag

SEQ ID NO: 89197 - DNA, 1280 bp, Homo sapiens
  chr22:24551644-24552924
  hyper
cacaactccagggggcgccattcacataggcaccgcctgcagaggggggatataaccctcacacacagttggccaatgccatcccggcctgccgcactcctggccacccctacaccatgctctctggggccccacagcttcctgcagtgagagctgcacccactttgcccggcagcggtccacagcccgccaccagcggccagtccagggaaccggagaggattggccggcaaaagtcagttgcgctcctgggcccgcttccagtagagtgccggcgccccgtccggccgcgcctgccccgccccggcccgccgcgagcgagagagcgaacgagcctccgcggccatggcccggcgctcgccctagctccactgcacagatgccacggcggagccggcgggtaggaacttggcgggggcgggggccgggactggggccgggactggggccggggctggggctgcgcaaccgcttcgcctccgctgcccgtctgggtctccactttgctggcgcttttgctcaatcgtcccctggtgggctctggcggccgccccccgcctcggcgcaccaggcgcagcaggaagcccgtgggctgtggtttccccggcgcccccgcggaggaaatcggccggcggcggggtgctgcgcccccatgcccagggcgggctggcacccggttcagcgtcaggtgggcggccaagccggcttgggcggcggcgcgcgggggcggcaggcgctggtgaagcccgcacacgcgccagcgcatccagccctaccaagccccgggctgggagctggctcgtgggggcgtgcgctgcgcgaaagcgaaagccgcccgccagagcaactttgcggcggaaggcgccgacgaggagctgtgccgtgccgctcttggggatggtgagctggccgcccggccgggtgggcagcgcgtccgggcgcggtgcttcgctagctataaataggtgctgtgcggggacaggaagatggttccagccctttacaagcaccggcccgttatgtgcgctgggctaggaccttgccccgcagcggagtgggaggagtgaggttaggggtaacggttgcatgggatggggggtgggcacatagagcctacagcagagttggcggcggggctctcccatgcacttggttgtttgtcgtttctgcttttcccgggagggggaagggaggaacagcccggcagttctggggaccttagcgctccacgtcttatttggcaggagaggctggaaacgagcgggcgccagctgcaggca

SEQ ID NO: 89198 - DNA, 34 bp, Homo sapiens; identical to SEQ ID NO: 46644
  chr22:24560385-24560419
  hypo

SEQ ID NO: 89199 - DNA, 110 bp, Homo sapiens
  chr22:24580134-24580244
  hypo
gagcgagttggtgaacgagacgcgttggcaatactacggcaccgccaacacctcaggcaacctcagcctgacctggcatgtcaagtcgctgcccacgcagaccatcacca

SEQ ID NO: 89200 - DNA, 84 bp, Homo sapiens
  chr22:24646515-24646599
  hypo
gacagaggatggacccgaaggccgaagaaaatgcctcaagggagtttcaacaccgggcgcggtggctcacgcctgtaatcccag

SEQ ID NO: 89201 - DNA, 30 bp, Homo sapiens
  chr22:24721228-24721258
  hyper
ctgctgttagaggttcgagagttgaagagt

SEQ ID NO: 89202 - DNA, 412 bp, Homo sapiens
  chr22:24820074-24820486
  hyper
tcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattcccc

SEQ ID NO: 89203 - DNA, 30 bp, Homo sapiens
  chr22:24985165-24985195
  hypo
atcctggggctgtgtcgatgctcatggcag

SEQ ID NO: 89204 - DNA, 30 bp, Homo sapiens; identical to SEQ ID NO: 46646
  chr22:25091239-25091269
  hypo

SEQ ID NO: 89205 - DNA, 21 bp, Homo sapiens
  chr22:25171155-25171176
  hypo
tcctcacgtggaagagtggaa

SEQ ID NO: 89206 - DNA, 30 bp, Homo sapiens
  chr22:25297771-25297801
  hypo
ccctaccccctgccccgatggcctatagcc

SEQ ID NO: 89207 - DNA, 30 bp, Homo sapiens
  chr22:25339267-25339297
  hypo
cacctgggaaaatcacgtcaaccgtccagg

SEQ ID NO: 89208 - DNA, 43 bp, Homo sapiens
  chr22:25348442-25348485
  hyper
agcggggtcgggcctcgaggggcgggagcgcttccggcagggg

SEQ ID NO: 89209 - DNA, 76 bp, Homo sapiens
  chr22:25349272-25349348
  hyper
gtctggacatttgtgcgggttggaggccccggaggtggaagtgggaagcaagggcggcgagcgagacggaaccctg

SEQ ID NO: 89210 - DNA, 36 bp, Homo sapiens
  chr22:25458444-25458480
  hyper
cccctggcagccactcgtctgcggcctgtctctgca

SEQ ID NO: 89211 - DNA, 369 bp, Homo sapiens; identical to SEQ ID NO: 38493
  chr22:25678246-25678615
  hyper

SEQ ID NO: 89212 - DNA, 253 bp, Homo sapiens; identical to SEQ ID NO: 4905
  chr22:25678616-25678869
  hyper

SEQ ID NO: 89213 - DNA, 208 bp, Homo sapiens; identical to SEQ ID NO: 4906
  chr22:25679042-25679250
  hyper

SEQ ID NO: 89214 - DNA, 198 bp, Homo sapiens; identical to SEQ ID NO: 4907
  chr22:25679267-25679465
  hyper

SEQ ID NO: 89215 - DNA, 867 bp, Homo sapiens
  chr22:25816871-25817738
  hyper
tcctttgtggccacccggaggggagagacttggttgggaggcgccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggcgcggcgggcggcggccgcgggcgcgcgtcccatccgggtcccgagtaaccgccaccgccgctgccaaagctcgccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtctctgaaatggggcatcggagggcgggtggggggcactccgggagagagcgctccaaagtgcctggcgccgcgccctgcgcgcagctagcaccccagcaaggggctggttatgacttggctggaccagttccatccctgtcgccccctcccccagccctgtcctctcctgtcccatccccgtggttctacctgttgcattggtgtggtccctttgggctccttgcctgtcactcgtttgcgctccatcctggtcgctccttcttcccgggctctgtggttc

SEQ ID NO: 89216 - DNA, 210 bp, Homo sapiens
  chr22:26124910-26125120
  hypo
ttgaagaaagaaatccgttttctattgtgcattgctatacgaagtgaagccagtaaactagatactgtaaatctagatattgtacctagacaaaatatcattggttctatctctttttgtatctgttgtgccagggaaggtttataatcccttctcagtatacactcactagtgcacgtctgaaatagtatcccacgggagatgctgctc

SEQ ID NO: 89217 - DNA, 158 bp, Homo sapiens
  chr22:26161975-26162133
  hypo
aacctcgtaatcacccgggcagtcacaacccaggcagactcaatcagagtctctgggaataaggccaaggagttaaggtttttaaaagtgccccaggagattccagagagccctagagagaaaaggaagggcatctaatatgccgcagttcaaggcac

SEQ ID NO: 89218 - DNA, 30 bp, Homo sapiens
  chr22:26238111-26238141
  hypo
aaggctcacgaaagccgcagactctcacac

SEQ ID NO: 89219 - DNA, 30 bp, Homo sapiens
  chr22:26268171-26268201
  hypo
atagtgcaggatggtcggagatgagtggtc

SEQ ID NO: 89220 - DNA, 141 bp, Homo sapiens
  chr22:26564752-26564893
  hyper
gcgctagtgccctgccggcagtggggttatgggagacagggctcagattaaaaagtggaggtggatcttaatttagagttcgtgattgggcttcagaggggtccagaccccctcgtgttagatgcacgattttgtggctat

SEQ ID NO: 89221 - DNA, 196 bp, Homo sapiens
  chr22:26565165-26565361
  hyper
cagagctgctgggagcgtcagcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagact

SEQ ID NO: 89222 - DNA, 149 bp, Homo sapiens
  chr22:26565502-26565651
  hyper
ggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggc

SEQ ID NO: 89223 - DNA, 265 bp, Homo sapiens
  chr22:26565734-26565999
  hyper
cgccccgaggggcggggcgggcagggggcaaagttgccgggagagcggggcagccaggggtcggggctgaccagggcgactcaggcaccacccgccgggatgggaagcggtggtggctgtccaaaatcggggctaggaaccgcacgtccccttggcccgggctgatgggagtgtggaggcggggatgtgttgaaggactcgggcgcttccctgcttcggctgcgggctccctttcggtcttccccggctgcggggctgattctcc

SEQ ID NO: 89224 - DNA, 32 bp, Homo sapiens
  chr22:26738332-26738364
  hypo
ttggttctttctccccgttcacttaaagaatt

SEQ ID NO: 89225 - DNA, 30 bp, Homo sapiens; identical to SEQ ID NO: 46648
  chr22:26763231-26763261
  hypo

SEQ ID NO: 89226 - DNA, 46 bp, Homo sapiens
  chr22:26848744-26848790
  hypo
acagatccggcacctcgctgtgcagtcacaccgcctaccaccacct

SEQ ID NO: 89227 - DNA, 192 bp, Homo sapiens
  chr22:26930338-26930530
  hypo
ccaagacttgttgaccgccccagggaagaaatctctttggatgaaaatgagagacagcttccattttaaataaacaaacacaaaaagctccaaagagttgatgttaaccaccagtgctcatgaaaattatttgtgttttataaaatacataaagtcaggctttactccaggaacgtccgacccatagcctgg

SEQ ID NO: 89228 - DNA, 38 bp, Homo sapiens; identical to SEQ ID NO: 46649
  chr22:26932483-26932521
  hypo

SEQ ID NO: 89229 - DNA, 28 bp, Homo sapiens
  chr22:26965177-26965205
  hypo
tggatcgggaccccgttccagtaacagt

SEQ ID NO: 89230 - DNA, 21 bp, Homo sapiens
  chr22:26991250-26991271
  hypo
gcctgtgaggccaggcgcagt

SEQ ID NO: 89231 - DNA, 30 bp, Homo sapiens
  chr22:26997870-26997900
  hypo
cgcggtcactgaagccgtagacccagagac

SEQ ID NO: 89232 - DNA, 78 bp, Homo sapiens
  chr22:26998743-26998821
  hypo
acaaaccaggtgaaacgtggaacattggtggaacacagatctaggttcaaatcctgcctctaggccgggtgcgatggc

SEQ ID NO: 89233 - DNA, 50 bp, Homo sapiens
  chr22:27007819-27007869
  hypo
attggatcacctctccgagcctcagtttcctcatccgtaaaatgagattg

SEQ ID NO: 89234 - DNA, 20 bp, Homo sapiens
  chr22:27010657-27010677
  hypo
taaaaacaagtaaatcggcc

SEQ ID NO: 89235 - DNA, 80 bp, Homo sapiens
  chr22:27019215-27019295
  hypo
gacggcttccagggccggcggcacgagttcacggccgagtgccccagcgtgctggagcttggcttcgagactgtgcgatc

SEQ ID NO: 89236 - DNA, 154 bp, Homo sapiens
  chr22:27045844-27045998
  hypo
ccagcctggcaacagagcgagactccgtctcaaaaaaaaaagtgagtggaggagttccacgacatcctcgacctggggtaggacatgtcgggtgtgtccgacagtctcccagaagacctcagcaggactgagttctagtcgctaacaacttgct

SEQ ID NO: 89237 - DNA, 511 bp, Homo sapiens
  chr22:27053517-27054028
  hyper
gtttgagatgggaggcgcttgcaggggctcccccagttctgcgctgtgagccggggcacaaagagccctctgcactagcgccgcaggaccgcggacccgaggtaagacgtcgccccatcctagaagccttccttcccaagtgtccttgtcccctaacggggaacagcctaattccccaaggctggggtcgagggtaggtcccagagtcccagggctgggttcagggatgcaacgccgcctgaagtgtcccgcattggatggatgaagaggctttacagcctgtaattctcaaacacagccaagactctggctgggatggggggtgaggtcaggcaaggggaggatgctttaggagtccagtgcgaatggggatcttgcaatcatgattatgagggggaacaaagaccctttccttccgacgacacaagacacaatttgggaggtggacccgcggaccttctcggtccaccaggttagcaattaactggccaagccacgggcagagccagag

SEQ ID NO: 89238 - DNA, 317 bp, Homo sapiens
  chr22:27068921-27069238
  hyper
ggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagc

SEQ ID NO: 89239 - DNA, 30 bp, Homo sapiens
  chr22:27299019-27299049
  hyper
tccttcagcaagggccggcccttgctcctt

SEQ ID NO: 89240 - DNA, 33 bp, Homo sapiens
  chr22:27299656-27299689
  hyper
gacccgctcctccttcgccgcttcacctctccc

SEQ ID NO: 89241 - DNA, 287 bp, Homo sapiens
  chr22:27695150-27695437
  hyper
agagaggaagggggccgagctggggagggggaggccgcgcagacgacgctgccgggagggctggtggaggagcaggaagtctgggggctcagatgcgcgccctcggtccaccccctctctcccctgtaatgtggggagggtttatctcaccaggagcagcaggctcagtcactgatctaatcaaattattcagcattaaaaaactgccaagacattccagtacttcagctcccagagacccagctgggatcaaatgctaatcaacatcgccacgatatttattccca

SEQ ID NO: 89242 - DNA, 30 bp, Homo sapiens
  chr22:27728029-27728059
  hyper
ggcactgcacagacacggggcatgggtttg

SEQ ID NO: 89243 - DNA, 112 bp, Homo sapiens
  chr22:28007163-28007275
  hypo
ccgcactgcgtctcgcgcgagattaacccgtcccgcactgcgtctcacgcgagattaacccgtcccgcactgcgtctcacgcgagattaacccgtcccgcactgtgtctcac

SEQ ID NO: 89244 - DNA, 30 bp, Homo sapiens
  chr22:28017941-28017971
  hypo
gtgccctgggctaagcggagactcctttct

SEQ ID NO: 89245 - DNA, 30 bp, Homo sapiens
  chr22:28035016-28035046
  hypo
ggcactgagaatgtgcggagaccagcatga

SEQ ID NO: 89246 - DNA, 30 bp, Homo sapiens; identical to SEQ ID NO: 38505
  chr22:28196522-28196552
  hyper

SEQ ID NO: 89247 - DNA, 83 bp, Homo sapiens
  chr22:28196966-28197049
  hyper
ccgcccgcagcctcccggagtccgtggcagagctgctaagggcaggggagggagacccttcaaagccgcggctggcgccgggc

SEQ ID NO: 89248 - DNA, 1244 bp, Homo sapiens
  chr22:28197259-28198503
  hyper
gccgggggctggagccgagggtcggggaaaggcgcggctcctctgctcggcagcgggtgcgctgcgttcggcgcgcagcttcgcggccacgtccgccgcctgccgcttctgttctccgccgttgggtgtctgagttcgccggagtctccgcgcaccgttgcaggcgcgggagggcagcgagacgaggggttgggtcgctccaaggctccggttccctgcctccgcgctgaggtgcttcgcgagtccctctcggacctgagggaggggggcgtacgcgggtcggggggccacgccgggcgagcaggctaaggcgttcccgctgcgctctcagagcccggaatggggggaggggggcgcgggggcagctctggggggtctgcgcacccctctcccgactagcgggggggctctgcgtggggcgttccgagggtctcggctcccctctctgtgtctgcctctcgcccagcgccgggagaagcagcaacaagttttgcatttcagcaatcaatttcagccattacatttgcaccaatcagcgccgcccaagttccgggctcggggcggggctcgctcttaaggtggtccggggtcctggctgccgaagcccccgccacgaacccgcactaccccagctctggggtcccctgcgcccgcctctcctcggggtccggcgtcagtgcgctgggggcgcgccccggcctccgggcgcatcgagctggagagggtgcaggcggaggagaatggcgggagcttggctttgttcacccccttcccattcacactgttcccaactccccacccccaactggagcgagacccaccgggtgggcagggggcggggaggtgggcggtgagcggtacggggcgctcagacaatgaggtcgccaggcaaagaccctagactcgccacggaaagtcgctaagtgtctactgcacttcggctccggggtgaacactccgttctccgctagcggcgcccaagttagccggccctgggattttcttggagggtaaagcagacggggaacctcgaagttagggttctcctcgagagacctgggcgcttgctcactcctccgtcactagggcgttcacaattgttccccttccccactgcctggggttcccggttctcaccggccggcgtgggctccaaggagtcacagtcactcagccactttatgggggagcacatcggttgagcccagtaaccggagcgacttgcgaggcggctgggaaccccg

SEQ ID NO: 89249 - DNA, 220 bp, Homo sapiens
  chr22:28371504-28371724
  hypo
agtcacagtgctttgcggttgaagtcgcccacataccgctcctgacgctaattccaccgccttgcctcccgcacgacagtaccactcccgcgtgtgagagccctcattcccagcatttctagatacctccactgcatgtatgcacctggaccctgaaaggcgttattttgtattttcatatatagtggcataaaatcgtttgtagcgttttcttattctt

SEQ ID NO: 89250 - DNA, 270 bp, Homo sapiens
  chr22:28838179-28838449
  hyper
ccttttccccatgatcgattcacacacgctggtgcacgctgacacgcacagacacacgcccgtgcacaatggccagcgcaggcaatcgcacgggcccacgaggcctcaggagccccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggctcagagccttt

SEQ ID NO: 89251 - DNA, 50 bp, Homo sapiens; identical to SEQ ID NO: 38510
  chr22:28838794-28838844
  hyper

SEQ ID NO: 89252 - DNA, 813 bp, Homo sapiens; identical to SEQ ID NO: 38511
  chr22:29075406-29076219
  hyper

SEQ ID NO: 89253 - DNA, 18 bp, Homo sapiens
  chr22:29167152-29167170
  hypo
ccacggagcccagccaaa

SEQ ID NO: 89254 - DNA, 120 bp, Homo sapiens
  chr22:29167697-29167817
  hypo
tgggctaattgttatttttttgttgttgagatagggtcaagctagacctaggatggactcctggcctcaagcgattctcccacctcccacctccgacctcccaaagtgatgggatcacag

SEQ ID NO: 89255 - DNA, 30 bp, Homo sapiens; identical to SEQ ID NO: 46657
  chr22:29168256-29168286
  hypo

SEQ ID NO: 89256 - DNA, 94 bp, Homo sapiens
  chr22:29426559-29426653
  hyper
tgactttaattatggcgagaaatatcttctcccggtggggaggggcgcggccggtggcgaggagggcactttcccgggtcggagaaggccggat

SEQ ID NO: 89257 - DNA, 1051 bp, Homo sapiens
  chr22:29445592-29446643
  hypo
agggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacct

SEQ ID NO: 89258 - DNA, 30 bp, Homo sapiens
  chr22:29467712-29467742
  hyper
gaccgaccccgggtgcggcaggggaagacc

SEQ ID NO: 89259 - DNA, 106 bp, Homo sapiens
  chr22:29469954-29470060
  hyper
ccctgagcctcactgcgacgcccccgcgtcccccagtcctctcctcccgcctacaccggtggaacccggcgcctccccgcgcagagcagagcggaggcgggaggag

SEQ ID NO: 89260 - DNA, 34 bp, Homo sapiens
  chr22:29540984-29541018
  hypo
tctggctcaggacagcgtacgggcaggagggctg

SEQ ID NO: 89261 - DNA, 28 bp, Homo sapiens
  chr22:29550679-29550707
  hyper
tccattacagttacacggattttttgcc

SEQ ID NO: 89262 - DNA, 45 bp, Homo sapiens
  chr22:29610336-29610381
  hypo
tttgaaggtaggaggcgccatggggagaagcggaggaagggtact

SEQ ID NO: 89263 - DNA, 156 bp, Homo sapiens
  chr22:29611127-29611283
  hypo
ggaccccagggtgggcggagcaaaggtagcatcagccgacaccattctcagcctatcccctgtgctgttgaagcaccctggagggcttcctgagggatggatacaccatttgcctgcattcctttactcagtgagtattcacgctgggctcaggcc

SEQ ID NO: 89264 - DNA, 167 bp, Homo sapiens
  chr22:29616031-29616198
  hypo
ccagcccatcctgcacgcccagccaacatggctgcctcctccactctctcagcccctgcctgcatcccctgaacctcaccctccttctgtttgaaccccctgcccacactggctttgtctcccatacacggccttggcagtggccggcaagtcgctgctctgcctgc

SEQ ID NO: 89265 - DNA, 22 bp, Homo sapiens
  chr22:29617650-29617672
  hypo
ccacgcccggccaggatatgac

SEQ ID NO: 89266 - DNA, 24 bp, Homo sapiens
  chr22:29701029-29701053
  hypo
gcgcccggccgggaatgttaagac

SEQ ID NO: 89267 - DNA, 100 bp, Homo sapiens
  chr22:29709200-29709300
  hyper
cccagtgaagttgggcgatcccgtccaatccaggtccctgattgtcccagtcacaaggtggggcccatggatggcactgtccgatcgggtcacatgaggc

SEQ ID NO: 89268 - DNA, 37 bp, Homo sapiens
  chr22:29710305-29710342
  hyper
ccaaagcccttggcccgagtcccgtggtccaccacgc

SEQ ID NO: 89269 - DNA, 467 bp, Homo sapiens
  chr22:29711155-29711622
  hyper
ccgaacaggaactggcggatgatggccgtcttgcccacgcccggggcgcctagaacggccacccgcaggctaccccccatggccggccggcgctgtcgctccccgcgctggaaagcctcatgggccggcgccgcaccgtgcgcccccaggccgtgcgccccgcgcgccctgcccggtgcgccacggccccgtcgcgcttctcgtcgcccctcggagcaccgagaccggagagggcaggcccgaggcaggagctggcggcgggagggcagacagacagccgagtgggcagacaggtggcgggcgcgcgagcggctcgggcgggtgccgaagctcgagagagagcagagccggagcggcgctcagacaccgcctccgccccgcagcgccaacccaggcgccggcggacgcgcgaggcgccgaagtccgcccctctcgcggcgcgggtcccgcagcggtgcggggcgcgg

SEQ ID NO: 89270 - DNA, 34 bp, Homo sapiens
  chr22:29736031-29736065
  hypo
cccccgtgctgccaccgtgcggacctgagccgag

SEQ ID NO: 89271 - DNA, 149 bp, Homo sapiens
  chr22:29773804-29773953
  hypo
aaaaaaaaaaaagttagtcttcacgataatccatgaaggttttaatattatcacaagtttacagatgaggaaactgaagtaccagggaggtcaaggcatttgtttggagttacacagctagaaaatggcagtgccggcactctccactg

SEQ ID NO: 89272 - DNA, 71 bp, Homo sapiens; identical to SEQ ID NO: 38514
  chr22:29875904-29875975
  hyper

SEQ ID NO: 89273 - DNA, 109 bp, Homo sapiens; identical to SEQ ID NO: 38515
  chr22:29876004-29876113
  hyper

SEQ ID NO: 89274 - DNA, 669 bp, Homo sapiens; identical to SEQ ID NO: 38516
  chr22:29876916-29877585
  hyper

SEQ ID NO: 89275 - DNA, 120 bp, Homo sapiens
  chr22:29977635-29977755
  hypo
ccaccatgcccagcctaccaagggttcttaacaaggctgtccgggatgtgcagcagagggtcagtgtaaccaccccatgggttcattttgcccgtttcccagacagcggatttatcaaga

SEQ ID NO: 89276 - DNA, 81 bp, Homo sapiens
  chr22:29977935-29978016
  hypo
agggagtggaagccgtcctcttgtgctgagtggatctctgggtgggggccacaaaaccggatgatccggtttcttaatctg

SEQ ID NO: 89277 - DNA, 24 bp, Homo sapiens
  chr22:29997189-29997213
  hypo
cctttttttttgagacggagtctc

SEQ ID NO: 89278 - DNA, 36 bp, Homo sapiens; identical to SEQ ID NO: 46664
  chr22:29998650-29998686
  hypo

SEQ ID NO: 89279 - DNA, 30 bp, Homo sapiens
  chr22:30023357-30023387
  hypo
ttccaaagatattgtcgtgtttgcttttgt

SEQ ID NO: 89280 - DNA, 128 bp, Homo sapiens
  chr22:30087744-30087872
  hypo
gctgtttgcatgctccgcggggtggcttcccaagctctctgtagaaaaactgcctgagggcaaatggctccactgagctgctacctgcaggaaagaagctcaagggctctcctcgtctcactgcctgc

SEQ ID NO: 89281 - DNA, 191 bp, Homo sapiens
  chr22:30091110-30091301
  hypo
agagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttct

SEQ ID NO: 89282 - DNA, 1178 bp, Homo sapiens
  chr22:30115961-30117139
  hyper
gggggaggcggggagcgcagccagcgcggcacagaacgagcgagcgagcgagcggagaggcggctacagcctgagcgccgggccggtagcggccgcgccggcgagcggactagcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgtaccggggcatctacaccgtgcccaacctgctgtcggagcagcgcccggtggacatcccggaggacgagctggagggtgagtgtccgccgggatccccgccccggcggccctcctacctgtgcgcccaggtgaagcgcgggccaggggcgcgggggcggggggcggggggcggtccgcaggtgccggttgccaggtgggcgccccagctagcagctgtgccccgcggcaagacctgtccgcaccccggggcgccgcggtgggggtcgctcaggcggagagcggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctccgcggcgcccgcccgcggctctctgctcgcattgacattccgctcgtgtcgctttaaaaattcaatctgctcgggcagcagcagaaggggagagggcgactgccctgctcttgcccgctgcggggccgcccccgtccccacctgcggccgtagccccttccctgcagccctgcggggacccccagcccggcgcgccgggaaggcggcccgggaggcggtggcgacaacaagtggcc

SEQ ID NO: 89283 - DNA, 35 bp, Homo sapiens
  chr22:30158330-30158365
  hypo
ccaacccccaggccccggaacggtacgggtccatg

SEQ ID NO: 89284 - DNA, 30 bp, Homo sapiens
  chr22:30198046-30198076
  hypo
tcacctgctctgggtcgtagtggtagtact

SEQ ID NO: 89285 - DNA, 44 bp, Homo sapiens
  chr22:30233100-30233144
  hypo
tttttgtctaaagcacgggtacaaattaagtaggcagggctggg

SEQ ID NO: 89286 - DNA, 24 bp, Homo sapiens
  chr22:30375203-30375227
  hypo
aggcgcggtggctcacgcctgtaa

SEQ ID NO: 89287 - DNA, 30 bp, Homo sapiens
  chr22:30606857-30606887
  hypo
cccactgatgcaccccgtctgaaatccacg

SEQ ID NO: 89288 - DNA, 30 bp, Homo sapiens
  chr22:30634326-30634356
  hypo
gactgcatcggggagcgccaggcccaggat

SEQ ID NO: 89289 - DNA, 99 bp, Homo sapiens
  chr22:30642585-30642684
  hyper
gctcgcgctgccaagcgccccaagttgccgccgcgccccgcagcggggacgcgaagccggcgcggggcgggtgtatttacctgccgccaagaccttcat

SEQ ID NO: 89290 - DNA, 54 bp, Homo sapiens
  chr22:30767980-30768034
  hypo
tgggatgtgagctcccgtcctaggtctgaggtagtacagcgctcccctgcccta

SEQ ID NO: 89291 - DNA, 30 bp, Homo sapiens
  chr22:30769627-30769657
  hypo
agcctggaccaggaacgtgaggagctgcgg

SEQ ID NO: 89292 - DNA, 102 bp, Homo sapiens; identical to SEQ ID NO: 46669
  chr22:30783894-30783996
  hypo

SEQ ID NO: 89293 - DNA, 30 bp, Homo sapiens
  chr22:30836081-30836111
  hypo
acacttctaggcatccggctgggtgcggct

SEQ ID NO: 89294 - DNA, 443 bp, Homo sapiens
  chr22:30857284-30857727
  hypo
gggcagacttacagacgccggcctctgagcaggtgaggttcccatcctcgggcaccatgtgggcgttatagcgctggctgggtagaacatctgtcatctcccctgcccgctgtcgctcccccatcttggtcttcaggaaaactccgaagccgatgtccgcaccatcagatgagaactgccacctgtcagggggagggggaggagacaggttgctgctcagcctgatgggtctctgaggggttagggcctgcccctacctgagaacgcagcctggaaataggatctcgtattccacttggtgtgatgagccgcggttgatctgcaccgagtgctcgtactgagtcttcacctggtcccgcacgtacatggacttggggatctccccgccatagttaatctgcggacatgggatgagatgggcttgcttccgtctcctggccatt

SEQ ID NO: 89295 - DNA, 30 bp, Homo sapiens
  chr22:30899622-30899652
  hypo
ttccctccctttctgcgtcccctgacccct

SEQ ID NO: 89296 - DNA, 30 bp, Homo sapiens; identical to SEQ ID NO: 46671
  chr22:30924831-30924861
  hypo

SEQ ID NO: 89297 - DNA, 142 bp, Homo sapiens
  chr22:30926975-30927117
  hypo
ggcaggtcagggaatcgggccctgttgtgacctgctgaacatgagatggtgacctgggggtgccacgcccaacttagcacagccccgagaagctgtgggtatgaaaatatccctgccaacaaaagtaaggaactgtaggcca

SEQ ID NO: 89298 - DNA, 479 bp, Homo sapiens
  chr22:30938028-30938507
  hyper
cgcgaaagggcaggccggtgggcggggacgcccggctcagaccccgtccccagcctggacctgggccccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggagggttaaaaggcagacacccccccacccccgcgcctccactccccgactccttcgccgcctccagcctctcgccagtgggaagcgggagtagccgcgcggccggagtccggaggcgaggggaggtcggccgcaacttccccaggccaccttaagaggacgatgtagccagctcgcagcgctgacctcagaaaaacaagtttgcgcaaagtggagcggggacccggcctctgggcagccc

SEQ ID NO: 89299 - DNA, 116 bp, Homo sapiens; identical to SEQ ID NO: 38520
  chr22:30938542-30938658
  hyper

SEQ ID NO: 89300 - DNA, 30 bp, Homo sapiens; identical to SEQ ID NO: 46672
  chr22:30940902-30940932
  hypo

SEQ ID NO: 89301 - DNA, 19 bp, Homo sapiens
  chr22:30962611-30962630
  hypo
cttgagacagagtctcgct

SEQ ID NO: 89302 - DNA, 55 bp, Homo sapiens
  chr22:31003131-31003186
  hyper
ccacagaccttcccccgccccacccctctgcagacttagccgtgcattgcaggca

SEQ ID NO: 89303 - DNA, 260 bp, Homo sapiens
  chr22:31198492-31198752
  hyper
ggccctctccagcctcgattggggcgcgatagcgcccttagtgtcgtgtcgggttccaggccacgctcgggcattttaagaggctgaggtgcgccttccgctgcccgcctgcgtcccgccacggagagctcgcctttatctagccctctgggcgagagaagaaggctaatcccagcctgggacaaggctggctgaggcgtgccggatcctccggggaccgatcggtggcctcgcgcggctctcatcgctctccgagcagt

SEQ ID NO: 89304 - DNA, 702 bp, Homo sapiens
  chr22:31218244-31218946
  hyper
aggggacagcactttcgctcggattttcgcattaaaatgtgacattgaagtggggagcctgcatgggcgtccgcggggtcgcacggaccagcaggcgacgcgcgggacgaggccgcgctcctggggcgggaggaagtggtaggcagcaccgccgctcaggctgggctcggctcccgcggcgcggacggggttaacgcgctcatgtaccgggtggcgggcggcagtggtgcattgtggtaacgcggcgccgggacccacgagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcctctgatgtcactccctcgcggcgtggggagcgcggggagcctcggggaacccctgtccccgcaccccgccggcgtgcgctcccggcttgcttcacgcgcggggcattttggagagggggctgcggctagagacttgtccgtctaattaaccta

SEQ ID NO: 89305 - DNA, 30 bp, Homo sapiens
  chr22:31280871-31280901
  hypo
agtcgctggagagaccgacccaatgggcag

SEQ ID NO: 89306 - DNA, 40 bp, Homo sapiens
  chr22:31317641-31317681
  hyper
ccaagaggcttcaggcgcttggcctcgggtcaaaagggag

SEQ ID NO: 89307 - DNA, 30 bp, Homo sapiens; identical to SEQ ID NO: 46673
  chr22:31460423-31460453
  hypo

SEQ ID NO: 89308 - DNA, 880 bp, Homo sapiens
  chr22:31480651-31481531
  hyper
tcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagtacacggagagccggctccccaggggg

SEQ ID NO: 89309 - DNA, 65 bp, Homo sapiens
  chr22:31494732-31494797
  hypo
aagagctgatgaaggcgcagagtctgcccaagacctcagcctcccaggcgcgcaaggccatgatt

SEQ ID NO: 89310 - DNA, 140 bp, Homo sapiens
  chr22:31639212-31639352
  hypo
ccttgttttagaaggatgactgctgctataatgtagaaagtgatttggaagaggggaggagtggggcacgaaagatggttagtagatgggggtggtaatgcttacctttcagtatttggaggcttcggagtcctcaaaaa

SEQ ID NO: 89311 - DNA, 30 bp, Homo sapiens
  chr22:32009388-32009418
  hypo
cgcggctgcagtgggcgctccaggcctacc

SEQ ID NO: 89312 - DNA, 140 bp, Homo sapiens
  chr22:32014233-32014373
  hypo
aggtgtccctggggacgccccgggctgtgctccctctcagccctgcctgtccctccatggccccaggtggaaatgcagatccagctgctggcagaggagctccaggctcagcgccagcccattggcgcctgcgttgcccg

SEQ ID NO: 89313 - DNA, 68 bp, Homo sapiens
  chr22:32019687-32019755
  hypo
tcccacccggctgagcggtctgagggcgccgaagggcaggaggtagtagaggacggtcaagggccagg

SEQ ID NO: 89314 - DNA, 91 bp, Homo sapiens
  chr22:32058932-32059023
  hypo
cagaatttgaacatacgtctctgactccaaaaaccatgtcctaaacatcttcttcttttttttttttttttgagacagagtctctcattgt

SEQ ID NO: 89315 - DNA, 30 bp, Homo sapiens
  chr22:32059263-32059293
  hypo
acaagcgtgagccaccgcacctggcctaaa

SEQ ID NO: 89316 - DNA, 39 bp, Homo sapiens
  chr22:32062176-32062215
  hypo
gtagtggcagagcttcgaggctttcgtgagccccaagca

SEQ ID NO: 89317 - DNA, 27 bp, Homo sapiens
  chr22:32356779-32356806
  hypo
aaactccgtccccgccccccccccccc

SEQ ID NO: 89318 - DNA, 30 bp, Homo sapiens
  chr22:32530895-32530925
  hypo
agcctctgtcgcacccgatggctaaagcag

SEQ ID NO: 89319 - DNA, 549 bp, Homo sapiens
  chr22:32571939-32572488
  hyper
cggggactagccctgcgcgcccggggagggggaggcgctggcgctgtgacggccgcggggagggccaccttcccagcacacgcacacatacgcccccggccctcagccgctccggctgccgctgcccgccgacagctgacctccaggcaccgcagcgcccgggaacagccatctgggaaccgcgaccgcgcactgacacacgcagtggccgccgccgccgccgctccgccaagcgctgcctgtagcacctgcacggtggtttggaggggaaggtctgggcaggcgaacgttccacgagggcgtcccagaggcatctgcagcctccgctctcctgttctgctctggcgcccaccagcccctgaccgagtccagagggtcaccgaagacgccccccagtgctcgaacgcccgttggtgccaggctgcccggccctgagggccttgcctgaggacacccctttcctcccctccggaaggggcgaccgccctttgccaaccccaggcaaagctggggccccaaccttatgtgcgctaccgccccctccaggca

SEQ ID NO: 89320 - DNA, 30 bp, Homo sapiens
  chr22:32601764-32601794
  hypo
gctggtggtgggggacgggttagggtcact

SEQ ID NO: 89321 - DNA, 69 bp, Homo sapiens
  chr22:32650981-32651050
  hypo
ctggctgtgtgcacacgatggggttattaggagaatacattagttcattgtaagcgttatttatgcaac

SEQ ID NO: 89322 - DNA, 127 bp, Homo sapiens
  chr22:32667536-32667663
  hypo
cacagaggagagggtcgggcccggggccgcgtggcgtgtttccactacttcgaggacatttatggctactcaggagtgttcatctgcggcccctcacctcactggctcctggcgacagactgagggg

SEQ ID NO: 89323 - DNA, 119 bp, Homo sapiens
  chr22:32701637-32701756
  hypo
atcaactgtgttcagcgtgagggacacacggtcccagtgtgagggacggtggcttttcaggagcacggtgctcattaaaggtggttactctgtccccttgcctacgagatgagaaacaa

SEQ ID NO: 89324 - DNA, 86 bp, Homo sapiens
  chr22:32748880-32748966
  hypo
tttagtctccatggccgccaccaaccacagcgaggcgagcggtggtgccacaagctccagcctccagcaggcggctcctcctcctg

SEQ ID NO: 89325 - DNA, 164 bp, Homo sapiens
  chr22:32958084-32958248
  hypo
caaaaagaagcaccccggttctgtcaaagagataacatcccccccaatacttaattctgaaaggcacatattcaatggttcgtcatgagactttgcacagtggataacaaatagcaccattgctggtggttttataaaagttgccgaaacgtctccagccgact

SEQ ID NO: 89326 - DNA, 24 bp, Homo sapiens
  chr22:33170623-33170647
  hypo
gctggagtgcaatggcgcacgatc

SEQ ID NO: 89327 - DNA, 988 bp, Homo sapiens
  chr22:33197384-33198372
  hyper
gggccagggcgcagacgagaaggggcacgagggctccgctccgaggacccagcggcaagcaccggtcccgggcgcgccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagcggcgcagagcgggcagcaggcaggcggcgggcgctcagacggcttctcctcctcctcttgctcctccagctcctgctccttcgccgggaggccgcccgccgagtcctgcgccagcgccgaggcagcctcgctgcgccccatcccgtcccgccgggcactcggagggcagcgcgccggaggccaaggttgccccgcacggcccggcgggcgagcgagctcgggctgcagcagccccgccggcggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcagccaggactgcagcgctgcttagggaggcagggcgagccccactcctttcctctgccccaggagaggggcagacggggttggggcggagtggagaaactcgatgtccttgggcgggggcgctggcatagctgagaggggaagatgccctgcagaggaaactcacagtggctgagggagcccctggccgcctttgctttcctaacttaggtcgtgaggttcctacc

SEQ ID NO: 89328 - DNA, 185 bp, Homo sapiens
  chr22:33255195-33255380
  hypo
tgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccc

SEQ ID NO: 89329 - DNA, 78 bp, Homo sapiens
  chr22:33286634-33286712
  hypo
ggattacaggtgtgagccaccgcgcccggccgatttagcacatttttaacctgttttttcacacgccacttcttcttt

SEQ ID NO: 89330 - DNA, 30 bp, Homo sapiens
  chr22:33355598-33355628
  hypo
tttctccttgagactcggttgctcaggctg

SEQ ID NO: 89331 - DNA, 198 bp, Homo sapiens; identical to SEQ ID NO: 1521
  chr22:33453877-33454075
  hyper

SEQ ID NO: 89332 - DNA, 66 bp, Homo sapiens; identical to SEQ ID NO: 1522
  chr22:33454193-33454259
  hyper

SEQ ID NO: 89333 - DNA, 146 bp, Homo sapiens; identical to SEQ ID NO: 38530
  chr22:33454345-33454491
  hyper

SEQ ID NO: 89334 - DNA, 13 bp, Homo sapiens
  chr22:33454492-33454505
  hyper
cctctccccaacg

SEQ ID NO: 89335 - DNA, 44 bp, Homo sapiens
  chr22:33492816-33492860
  hypo
ctgggattacaggcgtgagccaccgcgcccggcggatctggagc

SEQ ID NO: 89336 - DNA, 42 bp, Homo sapiens
  chr22:33716477-33716519
  hypo
actgaaattatttaacggcaactttcccggtgagactgtgac

SEQ ID NO: 89337 - DNA, 30 bp, Homo sapiens
  chr22:35292274-35292304
  hypo
gaaatccataaaattcgttccctggctttt

SEQ ID NO: 89338 - DNA, 30 bp, Homo sapiens
  chr22:35321014-35321044
  hypo
ggtattgaaatgctccgttaactacaggaa

SEQ ID NO: 89339 - DNA, 109 bp, Homo sapiens
  chr22:35420206-35420315
  hyper
cacagctccccctggcggtcagcgcgagcccgcaccgcggctctcctgtgctcacgcagccctgcgcggcggaggtggctggaaatgaatttagcgtcagcacagttat

SEQ ID NO: 89340 - DNA, 98 bp, Homo sapiens
  chr22:35652867-35652965
  hypo
gaaaaattgtgttctcgcctgtatatgacatctcttcctctctctctctgaagactgtttctaactaaaaaatgtagatgattcgccatgcaaattat

SEQ ID NO: 89341 - DNA, 42 bp, Homo sapiens
  chr22:35768487-35768529
  hypo
caaaaacttcaaggccgggcgcggtggctcacgcctgtaatc

SEQ ID NO: 89342 - DNA, 96 bp, Homo sapiens; identical to SEQ ID NO: 46682
  chr22:35822686-35822782
  hypo

SEQ ID NO: 89343 - DNA, 30 bp, Homo sapiens
  chr22:35827951-35827981
  hypo
tttccccagaaggaacgtggtggcatttgt

SEQ ID NO: 89344 - DNA, 64 bp, Homo sapiens; identical to SEQ ID NO: 46683
  chr22:35848324-35848388
  hypo

SEQ ID NO: 89345 - DNA, 27 bp, Homo sapiens
  chr22:35853047-35853074
  hypo
tttccagctgcccgtgctccttgagtt

SEQ ID NO: 89346 - DNA, 30 bp, Homo sapiens; identical to SEQ ID NO: 46684
  chr22:35964914-35964944
  hypo

SEQ ID NO: 89347 - DNA, 39 bp, Homo sapiens
  chr22:36246196-36246235
  hypo
atgtacccgtgtgcacgcatgcgcattctctgtctctct

SEQ ID NO: 89348 - DNA, 99 bp, Homo sapiens
  chr22:36246295-36246394
  hypo
tccggcagagacaggtgttaggattaacagtataaaacctttctgccacggaaaggaatgggagaaaaaagtcacactgatacacgcagtaaggggatc

SEQ ID NO: 89349 - DNA, 175 bp, Homo sapiens
  chr22:36553193-36553368
  hyper
aaatttctaaaaacacgcgagccagctaacctctgaatcatagccatggtttccaagcctcccctcccccacggcaatggcccaggcctgcatctgggcccagctccctccgggtccatgacactcttatgcagcaaccaactactgccagggacttttacgggaaagaggtcat

SEQ ID NO: 89350 - DNA, 42 bp, Homo sapiens
  chr22:36566759-36566801
  hypo
aaagacagcatgggccgggcatggcagctcatgactgtaatc

SEQ ID NO: 89351 - DNA, 42 bp, Homo sapiens
  chr22:36569398-36569440
  hypo
tgcctggccgtgatcatttccttaattcgttcattagtactt

SEQ ID NO: 89352 - DNA, 101 bp, Homo sapiens
  chr22:36585930-36586031
  hypo
ccataaactttacctcgccctctttattcccctaaaaaatgtctgcgttttgtcccggcctgtgtctggctcaccttccctggtggctgcactgctctggg

SEQ ID NO: 89353 - DNA, 30 bp, Homo sapiens
  chr22:36632925-36632955
  hypo
tcttgctgtaagggacggggtgacgggagg

SEQ ID NO: 89354 - DNA, 247 bp, Homo sapiens
  chr22:36684196-36684443
  hypo
accctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggccgagtcgatgtgcgcctccaggtccttcaggtccatctccagcttcttccgggcggccactgccatcgagcgctgcttcctctcgtcctccagctctg

SEQ ID NO: 89355 - DNA, 30 bp, Homo sapiens
  chr22:36707722-36707752
  hypo
gttaagtaactgacccgaagtcaaacagct

SEQ ID NO: 89356 - DNA, 30 bp, Homo sapiens
  chr22:36721819-36721849
  hypo
actaggtgtgaggcccgtccccattctgca

SEQ ID NO: 89357 - DNA, 30 bp, Homo sapiens; identical to SEQ ID NO: 38534
  chr22:36726916-36726946
  hyper

SEQ ID NO: 89358 - DNA, 30 bp, Homo sapiens
  chr22:36795040-36795070
  hypo
aataacgaaccttcccgcaggtgtacagca

SEQ ID NO: 89359 - DNA, 39 bp, Homo sapiens
  chr22:36848073-36848112
  hyper
agttatttcaaactccgcctctctcggcctgatgcccaa

SEQ ID NO: 89360 - DNA, 221 bp, Homo sapiens
  chr22:36851867-36852088
  hypo
aagctgccagcatgacgcagcccaccatattctccctccaagctctcttcatagcccgggtccttaaaaacccaaatctgtccaattgctacttgccgtccactcgttgacagttactccgcttcacagcctcccgatcacctgagtgtcctccctcggctcagtgcacagggctctgtgagcttacagttccctggttgccgttccgtgcctcccagccc

SEQ ID NO: 89361 - DNA, 30 bp, Homo sapiens
  chr22:36860909-36860939
  hypo
ctgcctgcaggtgagcgtgcctgcccagag

SEQ ID NO: 89362 - DNA, 30 bp, Homo sapiens; identical to SEQ ID NO: 16776
  chr22:36878964-36878994
  hypo

SEQ ID NO: 89363 - DNA, 764 bp, Homo sapiens
  chr22:36901801-36902565
  hypo
agtgagactccgtcttaaaaaaaaaaaaaagcgaaataccctttttcgtccattcctcccatacctactggccaatcaaggtgtgtggttcgtgtggggaaggtcccagcttccgcaggtgagctctggcaccggccttacctgcactgatgcacctggcccttctggtcagttaggatgaagtagtggccattccaggcctgtcggtccttgtccagagtgacgtgggcgatggtggtgttgtactggacacggagccccagcgtgtccgcgaagtcacccaggtagcgcaccatgtcgcgggcgtcggggaagtaggcacgcgagtagtgtctgaagagcagccgggggtcgtggctgagcagagagttccagtcgtggcggaggttgaactcggcgttagccttgcccgtgtaccgcttgttgatgctgatgagcttgcggtgccgcgggtagcgtgtgaagaagctgccgggccgcggggcccgctcgaacactgcgtagtcgcgtccagcgcgctgcaggaagtaggccatctgcaggcccgcgggcccagcgcccagcacgcagtagtcccggcgcgggggcaccgacagcgctgggtgcagggcgatggccaggagcagccccgggggaccccacaacggggccgcagcggagaggcccatcctgcagcagatcagaggggtaaggcctcgcacccggcccggcggctgggagacacgaggcccagaaagaggcggggcctgcgggaactctcactg

SEQ ID NO: 89364 - DNA, 41 bp, Homo sapiens; identical to SEQ ID NO: 46691
  chr22:36906156-36906197
  hypo

SEQ ID NO: 89365 - DNA, 637 bp, Homo sapiens
  chr22:37099142-37099779
  hyper
gaaaatcctttgcttcgccagttctcttccttggggggtctcggcgctttcgtttcagaccagacttcccagtattctgtaagcccttgagctcagctgcacaggtgcgggggtctcgctttccatggttttgcccgggcagcggcggcggcggcggcggcggcggcagggcgggcaggcgcggcggcggcggcggcagcaggacgagcagcggcggcggttattgttgttggtggcgggggtagtgttggcgaagtgggggagagagggggtttctcctggagaatcgaggcggatttccctccccctatctgcaaagctcctggaaacgagggagccggcgtcttgctgcagggtgggccgcgcgcctgccccccactcgctaccggctgggcgcccgcggaggcgctcccacctactgcattacgggtggtgctgaaccggacagctccctgcgccgcccgctccgcgcgctccccggctggctcccagggccgcccgccaggaggggggcgctggccagagtcctccctccccggggcagcaaggccagcgcagagcgggggccgcctttcctctttttacccctctcccaaatcctaaaatgagcgctctcctgggctcccggagcttagag

SEQ ID NO: 89366 - DNA, 30 bp, Homo sapiens
  chr22:37121549-37121579
  hypo
cctttctctcactctcgtgggccccctggc

SEQ ID NO: 89367 - DNA, 360 bp, Homo sapiens
  chr22:37212414-37212774
  hyper
gcactgaggatgccccgtgcgggcttaggcagagctgtgcgccggctccagaaggtcacctcgcccgcaggtccgttgctgaatctcagtaaaggaactaggacagtcagggggccaacaaaggctaccgcctggcgggaaaagtcctgtccagaatgagggtccaggaaaggggtctcttggagaggaggatgccccctgcagtcccctctaagtgccttaaagaggacgtccagagagctcgtacaaggaccctggaggtctctcctccgaccctggtcttcgcccttggtcccggaccctgagtcctcccagccaccgggccttcagcaccctcaagtttctgtaacttaggcgggg

SEQ ID NO: 89368 - DNA, 93 bp, Homo sapiens; identical to SEQ ID NO: 38538
  chr22:37212813-37212906
  hyper

SEQ ID NO: 89369 - DNA, 179 bp, Homo sapiens
  chr22:37213140-37213319
  hyper
tgcgcgccgggcgcacgcccgccgggcctggcatggcgccaggggcccggactctgagcgcagcgggagcggctcagtccagccgcgccgctgagcagcgccggccgccggcaagaaggcgcgcggacctgctaccactcctgcaccgccaggccaggggtccgcgggatcccaggggc

SEQ ID NO: 89370 - DNA, 26 bp, Homo sapiens
  chr22:37285265-37285291
  hypo
aagtactattcatgccgggcgcggtg

SEQ ID NO: 89371 - DNA, 30 bp, Homo sapiens
  chr22:37285909-37285939
  hypo
tggaggccccagccacgcagcatggcatta

SEQ ID NO: 89372 - DNA, 153 bp, Homo sapiens
  chr22:37321872-37322025
  hypo
ccaggatggcagctccgtgggcaggatttttgtgtgttttatcactgctggcccctgattctgaacagagccaggcatgtggtgagcactcgaggaacctttcgtgagtcagtgatacccatacaccctgggctaagccgtgtcctctcccaa

SEQ ID NO: 89373 - DNA, 173 bp, Homo sapiens
  chr22:37328730-37328903
  hypo
gtctagcatgagacacggggaatgttccgttggagggtgggtatgatgactctcctgaaagcttccctccctccagtccagatggcccctccatccctcaacgtgaccaaggatggagacagctacagcctgcgctgggaaacaatgaaaatgcgatacgaacacatagacca

SEQ ID NO: 89374 - DNA, 46 bp, Homo sapiens
  chr22:37329983-37330029
  hypo
caacgggatctggagcgagtggagtgaggcgcgctcctgggacacc

SEQ ID NO: 89375 - DNA, 239 bp, Homo sapiens
  chr22:37334157-37334396
  hypo
cctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaa

SEQ ID NO: 89376 - DNA, 50 bp, Homo sapiens; identical to SEQ ID NO: 46695
  chr22:37335158-37335208
  hypo

SEQ ID NO: 89377 - DNA, 115 bp, Homo sapiens
  chr22:37348877-37348992
  hypo
tacaccaccatcccacgccaggcagaggggacaccgtagcccctacccgtggcccctgcacccaacgtcacagactcattcacccggcgaatgagggtcacgttgacgagccgct

SEQ ID NO: 89378 - DNA, 83 bp, Homo sapiens
  chr22:37367478-37367561
  hypo
tggttttggtaagatattttacaggctaactgtgtatttcatctagcagccagcaagcgtttgcacatcgttataaattatgt

SEQ ID NO: 89379 - DNA, 30 bp, Homo sapiens; identical to SEQ ID NO: 46698
  chr22:37367799-37367829
  hypo

SEQ ID NO: 89380 - DNA, 30 bp, Homo sapiens
  chr22:37377170-37377200
  hypo
gtgcatcttctacagcgcaggagcggcctg

SEQ ID NO: 89381 - DNA, 20 bp, Homo sapiens
  chr22:37389811-37389831
  hypo
gaaaacgaaaaataagatca

SEQ ID NO: 89382 - DNA, 30 bp, Homo sapiens
  chr22:37395703-37395733
  hypo
gatgttcccagcactcgcaagctgacatag

SEQ ID NO: 89383 - DNA, 30 bp, Homo sapiens; identical to SEQ ID NO: 46699
  chr22:37395982-37396012
  hypo

SEQ ID NO: 89384 - DNA, 30 bp, Homo sapiens
  chr22:37411386-37411416
  hypo
caaagaaaattaagtcgataaagaaactgg

SEQ ID NO: 89385 - DNA, 164 bp, Homo sapiens
  chr22:37483725-37483889
  hypo
cctcccatacagccacgtcctttttggccttaccggctcatcttccctgggaggtgggagatacgatattaggatggaagagacctggaggtcacctttaatgggggctttagctttcattgttggggggttttattttatttacctagcggcagagcccttct

SEQ ID NO: 89386 - DNA, 30 bp, Homo sapiens
  chr22:37507640-37507670
  hypo
gagtggagtgtgcagcgggtgtgaagtgtg

SEQ ID NO: 89387 - DNA, 30 bp, Homo sapiens
  chr22:37578241-37578271
  hypo
ccttgatgaggtggccgctgaaggtgatgt

SEQ ID NO: 89388 - DNA, 30 bp, Homo sapiens
  chr22:37610830-37610860
  hypo
ccacagtcccgaccgcggcctagggacccc

SEQ ID NO: 89389 - DNA, 30 bp, Homo sapiens
  chr22:37646399-37646429
  hypo
accgtcagctcagcacggaattccttcctg

SEQ ID NO: 89390 - DNA, 413 bp, Homo sapiens
  chr22:37730457-37730870
  hyper
tacaggtgagcaaagcgcggctcgggaaggtagctcctgccggaatggagcagaaacgtctcggctgggaatcgaacccagggtcagtcagtagcggccgcgttttaggacccggcggtgcaccgaagacccggcggaacggcgcgcaccccgggcccagagctcattagccgggcgccgcgggggccttcattaaagctcagcgacgcggaggctgcccgcggcggccccgcctgggcgctccgggctggcccggacctgcggcgtcggcccaggagcatctggaaagggggcgcgggcggggatcggtaggaccgcctatgctcagggactgtcacccaccccctcccccaagccaaggagtagcggggaaggggggcgagtgcacccaggtattggggggagcatcaaat

SEQ ID NO: 89391 - DNA, 352 bp, Homo sapiens
  chr22:37730926-37731278
  hyper
cgagtcacccccgccccacccccacacactatgcacccatttcacagatggcaggtcctagctcagagggttagggcaggcccagaaccgcatcgccatcgcccgttcgcaggcctgattgagaggctggaaacgaggatgggcagggagtgaggacctgtaggctctgccggagaacttgggcgtgggcggagcggggcatccaggaagaagcccccaccccagccttggatagggtagtatacgatagggggcgtaaagaagggtcatgggctccggtggtcgcaggtcccaccggcaaccgccagggcgggggcagcaggagcaggaacctgctcgcctccgcatctcg

SEQ ID NO: 89392 - DNA, 30 bp, Homo sapiens
  chr22:37734363-37734393
  hypo
gttctttggcgcctccgggccatgttgcgt

SEQ ID NO: 89393 - DNA, 30 bp, Homo sapiens
  chr22:37742873-37742903
  hypo
ccctcagtgaaacaccgtggatgccaccag

SEQ ID NO: 89394 - DNA, 30 bp, Homo sapiens
  chr22:37769281-37769311
  hypo
tctcggatgagtactcggggctggaggagt

SEQ ID NO: 89395 - DNA, 78 bp, Homo sapiens
  chr22:37769566-37769644
  hypo
gggggctgcccttctcgatgtacttggagtcgcccttagccagccctgtggcggccggatggtcgggcacgtccaggc

SEQ ID NO: 89396 - DNA, 117 bp, Homo sapiens
  chr22:37769882-37769999
  hypo
tcccagaaaagaggccgagtccagcttgagagcatcgatgcagttgttaatgatctggttgaccttgtccacctccttggcaatggtggagatctctgcagccgagccctggccgtt

SEQ ID NO: 89397 - DNA, 30 bp, Homo sapiens; identical to SEQ ID NO: 46700
  chr22:37770782-37770812
  hypo

SEQ ID NO: 89398 - DNA, 318 bp, Homo sapiens
  chr22:37816014-37816332
  hyper
ctgcgaaattggctgcgagcgtcaggggctgcggctgcaaattctaaacacaggcaagtaaggaggaaagccgggccagccgggcgcaagttccggaggctggcggggtgggccgcgggggacgggggcctcgaagagccgcggacggcggaggacggtgcggaggtggggagcgcggcgaggtcgggggggagcagggtggcggtgcggccccggcggggctccgagcgcgcgctcccgtccccaccacgccaggtccgcggcagttcccgcccgccccctcctccggcccagcagccatcgcgcacccgccccgtg

SEQ ID NO: 89399 - DNA, 35 bp, Homo sapiens
  chr22:37816789-37816824
  hyper
tacagcagcagtcaacgaaacggaagatgattagc

SEQ ID NO: 89400 - DNA, 30 bp, Homo sapiens
  chr22:37823354-37823384
  hyper
gccaagcaccgcctccgggaagcggcggcc

SEQ ID NO: 89401 - DNA, 356 bp, Homo sapiens
  chr22:37823590-37823946
  hyper
gcgcgcgtcagggaccgcggcaggctgtgtccgtctgtccgtccccgtctgtccgtccgccagcccgcccgctcccggtgccctccgcaggcctttccgcagcaagcccgctcccgcccccgagccggccgcacgctccacggacacacgcgcgctcgcagacacacgcccgcggggctggggccgcgcctggcgccgccgctgcagctgcagcgcccggggaggcgaaggcggccccacggacccgagccccggcctggcggacccctgtcccggccgcggccccctgcgctgctcaccccgcgggatccgggtccgggtccgggtccggcctccgccagcgcattcaacagctg

SEQ ID NO: 89402 - DNA, 30 bp, Homo sapiens
  chr22:37845091-37845121
  hypo
atgcaggaatacagccgtaagaggcgaggg

SEQ ID NO: 89403 - DNA, 54 bp, Homo sapiens
  chr22:37914879-37914933
  hyper
gcagagccctagcttcgcgctacacggctgtgggcgctgcgccccagggcacgg

SEQ ID NO: 89404 - DNA, 97 bp, Homo sapiens
  chr22:38002842-38002939
  hypo
caaaaataaaataaaataaaaaaatatatataattcatttcagtagtaaaagacataaacaaaaagctataagtatacactacgttacagcttttgt

SEQ ID NO: 89405 - DNA, 30 bp, Homo sapiens
  chr22:38030040-38030070
  hyper
ccctgccactcgcagcggcagctctccccc

SEQ ID NO: 89406 - DNA, 40 bp, Homo sapiens
  chr22:38064571-38064611
  hypo
ctgggattataggcgtgagccaccgcgcctggctgtttgc

SEQ ID NO: 89407 - DNA, 82 bp, Homo sapiens
  chr22:38081717-38081799
  hypo
cttggagactaccaacgagttgacatcagcatctaaagtaggggccagcacggtggctcacgcctgtaatcccggcactttg

SEQ ID NO: 89408 - DNA, 144 bp, Homo sapiens
  chr22:38085121-38085265
  hypo
ggcagactggcttgtcggggttgctcagtgctggcccatgttgtgggtaccccactgctggggctccttccctttggacccttcattccctgcttccggggtgctgcaaagaccagccccactgctgagcggctgaggagcttg

SEQ ID NO: 89409 - DNA, 80 bp, Homo sapiens
  chr22:38122369-38122449
  hypo
gtacactgtgctggccgacctgcccccacccaggaggctggcccagagacagccagggccccaggcgcagtgcagcagcg

SEQ ID NO: 89410 - DNA, 30 bp, Homo sapiens
  chr22:38138874-38138904
  hypo
ccaggtgcagttagacgcctactgtccatt

SEQ ID NO: 89411 - DNA, 324 bp, Homo sapiens
  chr22:38199680-38200004
  hypo
gaccataccgggatgcgttcatcattttgaccagcaacaaactcccactcccagggtattgtttaagtgaacagtgaccggcctctatgcttagggaataaaagcggggttgtgggagaggggcccagggagcaaacgtcgcagaatctcagcccagggccgctgccaagcggacccggcacgtgagtaggaggtcggccgcagacaaggggtcctagggtctctgaggtctctcctgctggcctctgggcccctaaagcccctcgagcttcagaactccctacagacagtggcgccccgtgtccgcctcgtctacacctgcca

SEQ ID NO: 89412 - DNA, 33 bp, Homo sapiens
  chr22:38214652-38214685
  hyper
gcgagatccagacagcggcgcagaaagtgcgtc

SEQ ID NO: 89413 - DNA, 772 bp, Homo sapiens
  chr22:38220595-38221367
  hyper
cacacccttaatccccgccacgtcccccacggttcacaggaggcgcactgggccgcagggcccgggcgcgggacgtggcgcgggcccctgcgggagggcacctgcccgccccgctgaccaggcgccctccgcaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggccgccgtgggtcccgcgggcgcggcggcggccgaggcgcggcggagggcgacgggccgcgcggggcgcgccatgctggcggtggccgcgctctacgcgctctgctggggtccgcaccacgcgctcatcctgtgcttctggtacggccgcttcgccttcagcccggccacctacgcctgccgcctggcctcacactgcctggcctacgccaactcctgcctcaacccgctcgtctacgcgctcgcctcgcgccacttccgcgcgcgcttccgccgcctgtggccgtgcggccgccgacgccgccaccgtgcccgccgcgccttgcgtcgcgtccgccccgcgtcctcgggcccacccggct

SEQ ID NO: 89414 - DNA, 190 bp, Homo sapiens
  chr22:38339567-38339757
  hypo
gtggaattcagcacccgccacagcagccagccatggggtgcccaagaggttggttcccgttgccacttgaaatatgcaaacaggtagctagaaaccatctgggcttgacaaagtctaatgccttgaacaaataagcttatccctctgaaaacaaaatggtgcttgtaatgacccacgttaaatatgtttt

SEQ ID NO: 89415 - DNA, 116 bp, Homo sapiens
  chr22:38380321-38380437
  hypo
gggaggagcaggctgcgcactcacctcctcggacctctcctccagtctggggctcgtccttaggaagtggaaaaccgtgtcccaaggtgtgcggtccagctcggggctgggaggtg

SEQ ID NO: 89416 - DNA, 30 bp, Homo sapiens
  chr22:38434976-38435006
  hypo
tcgtgacccaccttgcgccccccagggagt

SEQ ID NO: 89417 - DNA, 199 bp, Homo sapiens
  chr22:38476933-38477132
  hyper
ccgccatgagcacctcgaactgcagcgcgcccaccatgccgtaggagaggccgaaggcgacgcagaaggcgacgagggcgccgtaggagcgcgcgcgtgcgctgctcaggtctgtgagcccattggccagcagggccaggctgaacagatacgggacgtgcggccgcagacgcgccaggcccgccagggcgccgcacgc

SEQ ID NO: 89418 - DNA, 520 bp, Homo sapiens
  chr22:38477296-38477816
  hyper
cggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctc

SEQ ID NO: 89419 - DNA, 67 bp, Homo sapiens
  chr22:38478409-38478476
  hyper
tgcctctacaatgggcgggtgtggtcttagaaggggccctctgagctcgcagggcagccccctgggc

SEQ ID NO: 89420 - DNA, 30 bp, Homo sapiens
  chr22:38482327-38482357
  hypo
gcacggcttggcacccggcttggggtgcgg

SEQ ID NO: 89421 - DNA, 47 bp, Homo sapiens
  chr22:38507636-38507683
  hypo
aggggcaaagtccaacgggcatcccactcctgcggcctgggctttcc

SEQ ID NO: 89422 - DNA, 131 bp, Homo sapiens
  chr22:38516843-38516974
  hypo
tagggcctggagccccggaacacctcatccttcatgcgaaagtacatgccgcgcatgtaggccatggacttacctaggaacaaaggggtcagaggcggggagatgcagcggccacacgcagggctcccgta

SEQ ID NO: 89423 - DNA, 176 bp, Homo sapiens
  chr22:38520276-38520452
  hypo
aggcaggagccactgcgcctactctctgtgcatatttttgagtgacggagggagtgtagctcagaggttaggtgacgggaaccaagtcatatggatgcggactggacctggacccaggtctgccgcctcctgagtcacatgctctccagcgcgccctgacacgtctccccacatcc

SEQ ID NO: 89424 - DNA, 84 bp, Homo sapiens; identical to SEQ ID NO: 46704
  chr22:38578330-38578414
  hypo

SEQ ID NO: 89425 - DNA, 24 bp, Homo sapiens
  chr22:38578714-38578738
  hypo
gcccggctccgaaatttttaacat

SEQ ID NO: 89426 - DNA, 96 bp, Homo sapiens
  chr22:38592952-38593048
  hypo
actccaatgccagtgctgatcctacaggaggcggagctcaggcggtgacgctcactcagcccgctggttcctaacaggccacggacaaacagtact

SEQ ID NO: 89427 - DNA, 30 bp, Homo sapiens
  chr22:38639203-38639233
  hypo
tggaggacctctccccgggcagggaggcag

SEQ ID NO: 89428 - DNA, 136 bp, Homo sapiens; identical to SEQ ID NO: 46706
  chr22:38679362-38679498
  hypo

SEQ ID NO: 89429 - DNA, 38 bp, Homo sapiens
  chr22:38687259-38687297
  hypo
gtagacacaggagaacgggaattcgggctggcaggcgg

SEQ ID NO: 89430 - DNA, 148 bp, Homo sapiens
  chr22:38694445-38694593
  hypo
acaggagcagcaggacggtgtaggcagcaatcagggcagcagggggcgccgccagcaccacccatgccctgctgcgggcacccaggagggaccccaggtgaagccagatcctccttgttccgacgggagacagcgccctgcctggccc

SEQ ID NO: 89431 - DNA, 33 bp, Homo sapiens
  chr22:38841842-38841875
  hypo
cggtgaaatgggatccggcgtgtgtcttgaagc

SEQ ID NO: 89432 - DNA, 91 bp, Homo sapiens
  chr22:38843208-38843299
  hypo
ccccagagggcagggcgaaggaaagagggagtcagggatcaattagcagaaccttccagacacgagtgggcttccccggagatggggagct

SEQ ID NO: 89433 - DNA, 547 bp, Homo sapiens
  chr22:38850751-38851298
  hyper
ggccacaacccagaccgcgacgctcccagacggacagacggacagagcccgcccgtggagcccgcccgctcccggggagtcacgggaccgcgcgcgcggcgccgggcagccgggacccggctccggatcaggtgcggagcgggcggggccggagcggcgggcccgggacacacagacacgcacgcggcgggacaaactgacggacagcgcccggggtgggcgagcgcggcttaccgctgggcggagggtccgacgagagtccgggaggcggcgagcgggcgctacatcccaaggcgcgatccggcgggcggcgtcccgggcgcggaaaggggagtcccggcgccccctgcccgcgaactcggccggccggcccgcgctcccctccccggctgccgctcggtctgcgcgtgggtcttggggtctccgcgcgtcccggccgtcccgcgccgctccccgcgggccgcccaactttcagcgctgccccgcgccgcgccctcggcgccgcctcggcgtcagcatcgtcgggcccggccgggctcacagcgcg

SEQ ID NO: 89434 - DNA, 148 bp, Homo sapiens
  chr22:38851520-38851668
  hyper
ccggccgggctctgtcgccacctccccgaccgctctcgcgtctctctcctgccgccggggtctccgccgcgctcgcgtcccggtccctctcccggcctccctgcctcctgcggccccgctcgccctctgcccgcggggtctccgtctc

SEQ ID NO: 89435 - DNA, 30 bp, Homo sapiens
  chr22:38864955-38864985
  hypo
acagatccagagccacgaaaggctgccaga

SEQ ID NO: 89436 - DNA, 138 bp, Homo sapiens
  chr22:38965908-38966046
  hyper
ttcctccccaaaggtcggagcggaacgctcaaagtcactagcccagggaccccaaaaaaggagcgagaaagggaagcgcgccttctcaaaacgagcgtcccctcagagtcttcgcacgctgttcgtttttgccactta

SEQ ID NO: 89437 - DNA, 17 bp, Homo sapiens
  chr22:39097903-39097920
  hypo
ttggagacggagtttcg

SEQ ID NO: 89438 - DNA, 39 bp, Homo sapiens
  chr22:39098887-39098926
  hypo
ttaaatttttgtggccgggcgtggtggctcacgcctgta

SEQ ID NO: 89439 - DNA, 30 bp, Homo sapiens
  chr22:39150522-39150552
  hyper
tgttggaaaagggaccgattggtagtagga

SEQ ID NO: 89440 - DNA, 30 bp, Homo sapiens
  chr22:39227742-39227772
  hypo
cctcagttctccacccgctctgtgccaagc

SEQ ID NO: 89441 - DNA, 30 bp, Homo sapiens; identical to SEQ ID NO: 46709
  chr22:39228205-39228235
  hypo

SEQ ID NO: 89442 - DNA, 66 bp, Homo sapiens
  chr22:39239346-39239412
  hyper
cggcgccctggaggccgcgcggcaggccgctctcgcagcggcccagcttgccggtgagctcacgga

SEQ ID NO: 89443 - DNA, 30 bp, Homo sapiens
  chr22:39256879-39256909
  hypo
agcttgcaggtggaacgccaggcacctggg

SEQ ID NO: 89444 - DNA, 30 bp, Homo sapiens
  chr22:39370509-39370539
  hypo
gttctgccctctggacgggcgctccgttga

SEQ ID NO: 89445 - DNA, 35 bp, Homo sapiens
  chr22:39413652-39413687
  hypo
gagtaaataaggaaacggcccggggctccaggccc

SEQ ID NO: 89446 - DNA, 30 bp, Homo sapiens
  chr22:39427969-39427999
  hypo
gctacaaaggtgagacgtggggggctgagg

SEQ ID NO: 89447 - DNA, 34 bp, Homo sapiens
  chr22:39435689-39435723
  hypo
tacattgtggccaggcgcggtggctcacacctgt

SEQ ID NO: 89448 - DNA, 168 bp, Homo sapiens
  chr22:39473204-39473372
  hyper
ggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaag

SEQ ID NO: 89449 - DNA, 40 bp, Homo sapiens
  chr22:39530973-39531013
  hypo
gccccacagagcactcgcgtcccagcgtttactcctttga

SEQ ID NO: 89450 - DNA, 30 bp, Homo sapiens
  chr22:39531766-39531796
  hypo
acccactcctcccagcgggctcacaggcca

SEQ ID NO: 89451 - DNA, 85 bp, Homo sapiens
  chr22:39549387-39549472
  hyper
agccttccccaaacccgcgtgtactgggcgctaggtgcttagtgggggctcaaccatttgtggcacgagacgaactcttgattcc

SEQ ID NO: 89452 - DNA, 19 bp, Homo sapiens
  chr22:39551428-39551447
  hypo
gccacggaagaggtacgtt

SEQ ID NO: 89453 - DNA, 66 bp, Homo sapiens
  chr22:39639644-39639710
  hyper
acacacaccctcccccgacacggaacggcttagggagccagattcgcccgccggttggaaagaaag

SEQ ID NO: 89454 - DNA, 110 bp, Homo sapiens
  chr22:39680042-39680152
  hypo
ctggcacacagggcacgcaccagtatgaaggcacacacatgtggacacacccatgcacaagaacactcctacaactgcacgagcatacacatgagcgtgaatgtgcagtg

SEQ ID NO: 89455 - DNA, 30 bp, Homo sapiens
  chr22:39690071-39690101
  hypo
gtgattttttgcaggcgtgggctttctgca

SEQ ID NO: 89456 - DNA, 31 bp, Homo sapiens
  chr22:39716831-39716862
  hypo
ggcctttgctcccaccgtcgtttgaaaagca

SEQ ID NO: 89457 - DNA, 30 bp, Homo sapiens
  chr22:39735204-39735234
  hypo
ctctattctctatcacgtgacccttcctta

SEQ ID NO: 89458 - DNA, 342 bp, Homo sapiens
  chr22:39745777-39746119
  hyper
cactggctgcgagcgcgccctgagccccgggccgcagcacgcgcgcccccgcgcccgaggtcgcgcgctgcccagccccccgcccgcgccccgcgagctgcgcccgccgcgcacgacgccccctcgcgggagccctgggccgccggccgcgcgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttgggtaag

SEQ ID NO: 89459 - DNA, 140 bp, Homo sapiens
  chr22:39746397-39746537
  hyper
ctgtgacctccaggccgcggctatgccgcgaaaggctcggattgtgcgcggccgccagggcggactggggaccgtggggacggagccagggtttaaggtggccttttttggggggtggatcagggcgtggaccatctcgg

SEQ ID NO: 89460 - DNA, 182 bp, Homo sapiens; identical to SEQ ID NO: 46711
  chr22:39756856-39757038
  hypo

SEQ ID NO: 89461 - DNA, 166 bp, Homo sapiens
  chr22:39770472-39770638
  hypo
gtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttc

SEQ ID NO: 89462 - DNA, 196 bp, Homo sapiens
  chr22:39784299-39784495
  hyper
gctctggagcccaggccgggtgggaggagcaagtgggcgtggcctgggcatggcccgtcggtcaaggtactggccctgcccacgcccgggagaggggcgggcgagagagatgctaagccaatcggattgcggtcatcgggggcgagcggagtctgcaagaggtccgaggagtagcgggtgccgagggaaggagcgc

SEQ ID NO: 89463 - DNA, 34 bp, Homo sapiens
  chr22:39830355-39830389
  hypo
ctagctcttgggcagcgggcgtggttctggcctc

SEQ ID NO: 89464 - DNA, 66 bp, Homo sapiens; identical to SEQ ID NO: 38552
  chr22:39853091-39853157
  hyper

SEQ ID NO: 89465 - DNA, 208 bp, Homo sapiens
  chr22:39853382-39853590
  hyper
gggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggtgagttgaccccggcgtcctggggggc

SEQ ID NO: 89466 - DNA, 35 bp, Homo sapiens
  chr22:39853591-39853626
  hyper
ccgcggcccctctatccccgcgctgcccgccctcc

SEQ ID NO: 89467 - DNA, 35 bp, Homo sapiens
  chr22:39853899-39853934
  hyper
gcaccccccagcctccggcgcggctcccccacaac

SEQ ID NO: 89468 - DNA, 151 bp, Homo sapiens
  chr22:39854212-39854363
  hyper
agtgagttctggaaccgggagtggggaggggagtgcgcctgggtgtgtgtatggtggggttcctgagctggggtgcagcaggaagggatgccgcgcggccagacctagtggtctgaggtcggatgacccccagccccggaagatgcccctg

SEQ ID NO: 89469 - DNA, 210 bp, Homo sapiens
  chr22:39877226-39877436
  hypo
aacattcttccctggcgccctctcctgcgtggagtctgctcacgtcgcctcctcggtgagcctgccctgcccactccattcatcactggacataatgacgcactcgctcctgcccgttacccgctttgtctttctccagagcacagcctctttgggcgcgcagttttctgagctgactagtgtgtttgtagtttacgcaggctccctacc

SEQ ID NO: 89470 - DNA, 30 bp, Homo sapiens; identical to SEQ ID NO: 46714
  chr22:39932533-39932563
  hypo

SEQ ID NO: 89471 - DNA, 48 bp, Homo sapiens
  chr22:39942097-39942145
  hyper
tgcagggagctggatcgggggtgctgatgatgtcggaggagctccttg

SEQ ID NO: 89472 - DNA, 336 bp, Homo sapiens
  chr22:39953464-39953800
  hyper
tgtctgtcgcctccacgcctcccccctccagcgtcccgcgcctgcagctttccccgaagacatttggtgtcagtataaggacggcttttcctcgcacgcagcgcggctcggtctcgccgccgccgcacgtccccgcaccgccaggcgctcgggctcctccgcagcccccgccgcgcgcagaccccgcgcttcgagccctgagccggaggcgcgagcagagccgaggcaggcgagagaccggcctcagccccgcgctccccgccgcgctggtctctcccgggcacttgccccgctgctcggtccccgcagcacccgcgcccccgccccggcccggag

SEQ ID NO: 89473 - DNA, 189 bp, Homo sapiens
  chr22:39953818-39954007
  hyper
cgcccgcccagagcctcgccgtccctccagcccgccgcctcctcctcctcccgccatggcccgggcccccgggcccgccgccccccgcccgccgccccccgcgccccgggggctcagctgatcctgaattggcggggggtcggctggcggggctgggggtccctctcgatcgccggcttcgggtgggga

SEQ ID NO: 89474 - DNA, 108 bp, Homo sapiens
  chr22:39954043-39954151
  hyper
cgcggccgggccacgtccatgccaaggtaggtgggggctgggtgggtggggggaaggaagggagggcttcgcttcgatgccagtttcttggcgcgttggcttctctct

SEQ ID NO: 89475 - DNA, 3 bp, Homo sapiens
  chr22:39954397-39954400
  hyper
gtc

SEQ ID NO: 89476 - DNA, 178 bp, Homo sapiens
  chr22:39954428-39954606
  hyper
cgggcagctgggccagagctggtgcccgtgtccggcgggctgagctgggagcgctggcctgggagcgcggcagcgggggccactggatgggggaatcccgggcagggtttaactttcccggaggcgggggtggcggagaccccccctttggctggcaccccagcggggcggaggcctc

SEQ ID NO: 89477 - DNA, 30 bp, Homo sapiens
  chr22:39994870-39994900
  hypo
agatgtggaaacactcggtgcaactccctg

SEQ ID NO: 89478 - DNA, 30 bp, Homo sapiens
  chr22:40014407-40014437
  hypo
ggttgtgtgcatgtacgtgactctgtgtat

SEQ ID NO: 89479 - DNA, 323 bp, Homo sapiens
  chr22:40014919-40015242
  hypo
tgtggggtgtggagccgtttggtgcaggagatgttcctcccactttcagaggctgctgtggaagctggggctgacatgggccacgggccaggaggatgcgctggggcaggagccacctggcacagcgctgggcacacagtgggagcccaacatctgtgctcccttcatgctctaagcccttgcccacatctgtcaccggcgccatttacagaggaggagacaagggccaccaaccccaggccacatgttggccaggtgtagctggagatccgactgctgtctttacttgccctgtccaggcagtagtgcgcaggtggctggag

SEQ ID NO: 89480 - DNA, 206 bp, Homo sapiens; identical to SEQ ID NO: 46715
  chr22:40018133-40018339
  hypo

SEQ ID NO: 89481 - DNA, 75 bp, Homo sapiens
  chr22:40037009-40037084
  hypo
ctgcctgtccaaggacgacgtctacgactttggggcggggcgccaggacctcaatgccagcggcctctgtgtcaa

SEQ ID NO: 89482 - DNA, 354 bp, Homo sapiens
  chr22:40042546-40042900
  hypo
cctgtcctctcctcccgttggtcacaggtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccgtaagtggccctgc

SEQ ID NO: 89483 - DNA, 68 bp, Homo sapiens
  chr22:40055020-40055088
  hypo
ttcatgcctgccctgcggcgccagctcgtggtgctcatgaagaccatggacaacgtggccaccttctg

SEQ ID NO: 89484 - DNA, 53 bp, Homo sapiens
  chr22:40055554-40055607
  hypo
ggtgagtggccgctgcgtgttcatgtttgctggggaagcgatgggacagtagg

SEQ ID NO: 89485 - DNA, 36 bp, Homo sapiens
  chr22:40060586-40060622
  hyper
ccctccccttcccttcggccccgccacttgcaggac

SEQ ID NO: 89486 - DNA, 36 bp, Homo sapiens
  chr22:40069714-40069750
  hypo
tccatgagtatgccccgtcctcgggggcttttctac

SEQ ID NO: 89487 - DNA, 148 bp, Homo sapiens
  chr22:40073967-40074115
  hypo
ggctgacctcctccccgcttccagtctgcaacgacgagaacccgtgcgagggcatgagccggcatgccaccttcgagaacttcggcatggccttcctcacactcttccaggtctccacgggtgacaactggaacgggatcatgaaggt

SEQ ID NO: 89488 - DNA, 39 bp, Homo sapiens
  chr22:40075188-40075227
  hypo
gagcttcgtgctcaccgcgcagttcgtgctcatcaacgt

SEQ ID NO: 89489 - DNA, 261 bp, Homo sapiens
  chr22:40081791-40082052
  hyper
cgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggaccc

SEQ ID NO: 89490 - DNA, 235 bp, Homo sapiens
  chr22:40095526-40095761
  hypo
atttggctgagcaaccgggcaccgtagcccagccagcctgacacataaatcagagggtacggctgggttcaaaccctggctccagcccgtgtgagtggtggcccatctgccgcacctgagccttggcagccggcaggctggtggcacttctcctggcgggctgctgagaggagcagagaaggctgcgtgcattgggttcccagctgggagtcctgacacccgtcctctggcctgc

SEQ ID NO: 89491 - DNA, 32 bp, Homo sapiens
  chr22:40111009-40111041
  hypo
ttcgtaaattcgtgacgtttatttaattttga

SEQ ID NO: 89492 - DNA, 30 bp, Homo sapiens; identical to SEQ ID NO: 46722
  chr22:40113507-40113537
  hypo

SEQ ID NO: 89493 - DNA, 75 bp, Homo sapiens
  chr22:40215378-40215453
  hypo
acaaaaacaaaaaaagaaaagaaacaaagaaaaaaaaaagacagaaaagagctatcaagccgtgaaaagatatgg

SEQ ID NO: 89494 - DNA, 137 bp, Homo sapiens
  chr22:40226362-40226499
  hypo
agccactgtgcccggcccctaaaataatctgtcttttcagtcagtgagctattacgaaattaaagaacagcgaaattttaattttatgtacctttctaagctgttagaaaaacaattgaatccgatacctaattggg

SEQ ID NO: 89495 - DNA, 171 bp, Homo sapiens
  chr22:40367623-40367794
  hypo
ccaagcgagtctgagcggggatgtgaaggcaggacggggttggagagaccctgcctgtgcaaggctggcctcctagtcaacacctagctgagacattcatctctgttcaaattaatattccttgggtctttcaaatgaatgtttcaatgtgaggagcgaagtactgggaaa

SEQ ID NO: 89496 - DNA, 30 bp, Homo sapiens
  chr22:40368168-40368198
  hypo
ccccaccatggctgtcgctctccatcccat

SEQ ID NO: 89497 - DNA, 226 bp, Homo sapiens
  chr22:40390429-40390655
  hyper
caagggtggggagctcgagctctcattagcatttcgcttttgcacaccccctgcccgctcctcagccgtcacaatcccgtcctgcagcaggcccccccaccaacaccggaccctcgacggggaaggggtcagctcggcggccccagaggccactgggccagaacacgtgctccggactccacgtgcgcggaaaatgaactcgtacccgcgacgcggccggcggggg

SEQ ID NO: 89498 - DNA, 172 bp, Homo sapiens
  chr22:40417456-40417628
  hypo
tcctccactgtggctcgaaagcttatcaaccccaagtacgccttggtgtcaggctgccgccacccgcctggggagatgatgcgctgggctgcccggcaacagcgggaggcgggcggcaacccggaggggcaggaggagggcgccagcggtggcgagtcggcctggcgcctgg

SEQ ID NO: 89499 - DNA, 78 bp, Homo sapiens
  chr22:40548259-40548337
  hypo
ggagctagaagacaacggagcatcaccctcaaaattttggacggaaaagtttactgacttcaacgtttttgtttgttt

SEQ ID NO: 89500 - DNA, 30 bp, Homo sapiens
  chr22:40815121-40815151
  hypo
cccactgctggccaccgtggccaccaccac

SEQ ID NO: 89501 - DNA, 37 bp, Homo sapiens
  chr22:40991442-40991479
  hypo
aaacataggcaatctctaccaccgtaggtgggttatc

SEQ ID NO: 89502 - DNA, 45 bp, Homo sapiens
  chr22:41034525-41034570
  hypo
aaacaggatgcaggccgggtgcggtggctcacgcctataatccca

SEQ ID NO: 89503 - DNA, 221 bp, Homo sapiens
  chr22:41048732-41048953
  hypo
ctgtgcagaaccacccggaagcttgagagttcaacgcggagaacctgctctgtgccaggcccccacctgggaggtgtgggcaaccttcctgccttccgggtgctcagagtctagtctggagacaataagaaaaatggttaatcaccatggaatgtgctagcgccttagcccgaagcaggggtctggttattgaggtttgttgaaggaagatgcctgtaagg

SEQ ID NO: 89504 - DNA, 35 bp, Homo sapiens
  chr22:41398391-41398426
  hypo
caggcatgagccacagcatccggcaaatctcccga

SEQ ID NO: 89505 - DNA, 82 bp, Homo sapiens
  chr22:41578498-41578580
  hypo
aaatagtgttatggaggtagaagatacggattaatccagagtcagcaatataataagatgatttcaacgtttgtagtttttt

SEQ ID NO: 89506 - DNA, 444 bp, Homo sapiens; identical to SEQ ID NO: 46727
  chr22:41634411-41634855
  hypo

SEQ ID NO: 89507 - DNA, 97 bp, Homo sapiens
  chr22:41637099-41637196
  hypo
cctgcctgccccagccgaggactgaggccccggcctgaatccttgggccagcccgacagggagggggcaccagcagctggcccgggagtcagcagtc

SEQ ID NO: 89508 - DNA, 101 bp, Homo sapiens; identical to SEQ ID NO: 46729
  chr22:41657315-41657416
  hypo

SEQ ID NO: 89509 - DNA, 71 bp, Homo sapiens
  chr22:41668097-41668168
  hypo
gggcaaggccacgtacggcaaacaaggtggtgctgttagggcttgatcccatgtgccgaaagcaagctcag

SEQ ID NO: 89510 - DNA, 22 bp, Homo sapiens
  chr22:41690045-41690067
  hypo
ctctccctctccccacggtctc

SEQ ID NO: 89511 - DNA, 30 bp, Homo sapiens
  chr22:41762483-41762513
  hypo
caagtctggctttgacgtgatgttggtctg

SEQ ID NO: 89512 - DNA, 33 bp, Homo sapiens
  chr22:41776124-41776157
  hypo
ttttcctccttaccccgccgcaaaattattttt

SEQ ID NO: 89513 - DNA, 81 bp, Homo sapiens; identical to SEQ ID NO: 46732
  chr22:41839301-41839382
  hypo

SEQ ID NO: 89514 - DNA, 21 bp, Homo sapiens
  chr22:41839922-41839943
  hypo
cccggccggaaggtttttcag

SEQ ID NO: 89515 - DNA, 39 bp, Homo sapiens
  chr22:41939338-41939377
  hypo
aacaatgcattgacccgaggcgatggcgcacacctgtaa

SEQ ID NO: 89516 - DNA, 83 bp, Homo sapiens
  chr22:41995514-41995597
  hypo
agtccctatcagaaacgattctaaattttcttgccaccttgattccacttcattattttatttttttgagatggagtctcact

SEQ ID NO: 89517 - DNA, 165 bp, Homo sapiens
  chr22:42096088-42096253
  hypo
gccatttcagcctcccgccatttcagcctccactcacctgcgggccaggggcgcatgcggcggccgctcctcattcccttcagctgtcggggtgtgaatcggaggaggggcagtctgggctccgaggggacaggagtgacaggttacagccgggcagaagtgggg

SEQ ID NO: 89518 - DNA, 42 bp, Homo sapiens; identical to SEQ ID NO: 46735
  chr22:42109080-42109122
  hypo

SEQ ID NO: 89519 - DNA, 575 bp, Homo sapiens
  chr22:42306066-42306641
  hyper
gatggtcgcggagcccgcgccgggggttgccgcggggacggctcgagggcggggaaacgctgacagaagtcccgcggggcggcctctgcggggacagggcagggaagagtgacgccgcgccgagcacccaagctcaggactggacaaggggtcccggccggggactgggacggggaccgggccggggcgggccgggggcggggcccgctggggcgagggagccgattggccgagcggcgggcgcgcggaactgggaatttggcgcttggagctgcggccccgcgcttcgcagtccgggagctcgtgcgcccaggtgccctgacgctgcccgcacccgccactcacctgcggccttgagcgcggcggccttgaacgtggcgtacttggcgtagtctggctgcagcgtcaggctgccgccgccctgcagccgcgggccgcgcgggggccccggggcggccgacccccggggcgcgttgttgaggcgcttcttgtctggagcgaggagtgagacgcggctcggtccgatgccccggttcactccgccctcgctgtcacctctccgtagtcctctcccc

SEQ ID NO: 89520 - DNA, 168 bp, Homo sapiens
  chr22:42306872-42307040
  hyper
ggaacagaacccagacggggcgtgggggctgccaagcctgcctgcctctcgagagacccagggggaggctctggagcccgagcctcagatcacagccccggccagcaaatcctgcatctggaaccttcctcacacatcacagccccccagactcgaggccgcaggacc

SEQ ID NO: 89521 - DNA, 172 bp, Homo sapiens
  chr22:42307095-42307267
  hyper
cgcagaggccgcggctcatttccaccggggaagcctctatgccccagccgagggaccgcctctcggcctctcacgcccctccgcgtgctccgccgccgctcagccccgcccgccaccgactcacctgcgctgttgtggggggagccccgggggaggccgtcccccatctgca

SEQ ID NO: 89522 - DNA, 924 bp, Homo sapiens
  chr22:42310042-42310966
  hyper
tgctgggagaaccagcgcttcgagagcggcgggaaggatcagcgggcagggagagcagtccgaggagcaggcgggggtccctgggcggcgcgtgctcacctggtcactgtgcgccgcgcgcgcgggctgtgcgccctctccagtcccaggcgcgccccgatgccggccagcaccagcagcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttgaagggcgggtcccactggcccatcacgtcgtagtagccgcggcagcggtcgcccccctccggggctgtcgtgccgggcgccgcgggaccctgcgcctcgggggctcccgcgcggcccgacggcggccgcgccagcagcaacgcgagccgaagcgcgagcgcgagccggaggccgggaggacggcggccgccgagcagtccccgcgccccggcccgcgccatcgggcccgcgcctcccgctactgcgcccggtgcatggccgggcgccgcggctccctccggctcggctcctccgctcccgcagggatcgcgctggctcccggcgcacgccgcctcggccgtcggcctcctctggggaccccagccccgagtgggctgggtctggagctccgaggccgcacctccggtgggcgcgtcctccgcccgggctcacctcggacccgagctgcccggtccgcgtcctgagatcttccccgggccgggcggcgggtcctcgcctgcgcgcggcccccggctt

SEQ ID NO: 89523 - DNA, 297 bp, Homo sapiens
  chr22:42311316-42311613
  hyper
ggcccgcgactagagcgtccctgtcttacaggtgcggggacctgtaccttacaggcgcggaggtcaaagcagcccggaattgccccgggacgggcagggccaccctctcacctccttcccgtcccctctgtccgttctgatcataacataaggagggccccttcccctctcggcgcctcgattttcccacctgtcaaatgggaaggacttcccctggcagcgccgcttcagagggccaaggatttaccccacggcgcgagcccagttccagaacccctcgaacgctgggctggggtc

SEQ ID NO: 89524 - DNA, 100 bp, Homo sapiens
  chr22:42315581-42315681
  hyper
gaggtcgccagggagcggcgggactgggaggctccaaagccctcagtgtacgtgcgaatccggagcggacaccgagaccttagcgcgggaaccaagagag

SEQ ID NO: 89525 - DNA, 59 bp, Homo sapiens
  chr22:42315890-42315949
  hyper
ggagcccgaagcaggcgcccttggccttggtcccgccccttatccggtcccaagctttt

SEQ ID NO: 89526 - DNA, 65 bp, Homo sapiens
  chr22:42322145-42322210
  hyper
cgaagccgccgctgtcgccgcctccagctcaccagacccaccaggaccagcgccaggaccagtgc

SEQ ID NO: 89527 - DNA, 32 bp, Homo sapiens
  chr22:42322723-42322755
  hyper
gggcgtgggggctggcgcgtccctgccccgca

SEQ ID NO: 89528 - DNA, 451 bp, Homo sapiens; identical to SEQ ID NO: 38566
  chr22:42353573-42354024
  hyper

SEQ ID NO: 89529 - DNA, 120 bp, Homo sapiens
  chr22:42367935-42368055
  hypo
tgtcctcgccaggctcgccacctgtgaccctagtgccagggggcagggtccactctgagggcccagggaacccaggtctgaccaaatccaacaggatgcttgccacggagaagcccctgg

SEQ ID NO: 89530 - DNA, 129 bp, Homo sapiens
  chr22:42373203-42373332
  hyper
ggacacacgcacacacggtggcacccacctcgagagagacaatcttggagagaggcagacataggacgcggggagacgcagggacccacggacacgcaagcagggacccagatgcgcacagaaagcccc

SEQ ID NO: 89531 - DNA, 140 bp, Homo sapiens
  chr22:42395150-42395290
  hypo
ctcctcagggcggggcggggagggggtgcgagacgcgtgtgtccttcgaagagaggccggagctgaccggcggttgtgagcagccgggggccttcggtggcagcgtggctgcccttgggtgcctgcgactttgttggatg

SEQ ID NO: 89532 - DNA, 54 bp, Homo sapiens
  chr22:42470162-42470216
  hyper
tggcagacctcgaggcggcctcggagatcccgggcctggcgaatactgggcggg

SEQ ID NO: 89533 - DNA, 244 bp, Homo sapiens
  chr22:42667169-42667413
  hypo
agacctagctggtcccgcctgggtccctggcagcccccgcccatgggttccaggtgtccgtggaggaacgacttgggtcctctcagagcctcagtttccaccgcggaaaacgcgaggagggaggcccacctacctcacctgtaaaacggacgctccagctgccttctgctgcggcattaagaagctgcaatgccaggctgactgcgcccagggtcccgaattaatttgccgataaggcggagga

SEQ ID NO: 89534 - DNA, 30 bp, Homo sapiens; identical to SEQ ID NO: 46738
  chr22:42675831-42675861
  hypo

SEQ ID NO: 89535 - DNA, 92 bp, Homo sapiens
  chr22:42679388-42679480
  hyper
cggaggggacgggggcgcggctggatctggaccggaggggacgggggcgggcactcggcccctgggactgtgacccggggccctgcccttca

SEQ ID NO: 89536 - DNA, 268 bp, Homo sapiens; identical to SEQ ID NO: 38568
  chr22:42679916-42680184
  hyper

SEQ ID NO: 89537 - DNA, 152 bp, Homo sapiens
  chr22:42695951-42696103
  hyper
gaggggaaggaagggcggggagggggagggggaggggcgcgctgaaatcacccgcaacatcaaagccttccccagccgcaaagcagtcacgtgcagcctggttcctttcgttccttcgttccttcgctggtagaagccgctgggcctggggc

SEQ ID NO: 89538 - DNA, 30 bp, Homo sapiens
  chr22:42697866-42697896
  hypo
agccgcttggctggacggccacgggggctg

SEQ ID NO: 89539 - DNA, 185 bp, Homo sapiens
  chr22:42829925-42830110
  hypo
gcattggaaaagcatcggtctgtgcctctacaagtctcattacgacttggcactgggaggcagctgaatgccaaactgcctcggaacaagggagcctgctcttccagccctggtgccgcctccgctcctgcccctgtgccagctcactgaccctacctctcagcctgtcacggtgccccccacac

SEQ ID NO: 89540 - DNA, 204 bp, Homo sapiens
  chr22:42896511-42896715
  hyper
ggggcgaaggcggggcgtgaggcgtggaggtgtggcctgactggggcggggcggggcggggcggaacagcctagaagcagggcctggaactgcaggatacactcccctcctgctacctaggcaggcgtgagggtgtgacggccgcgcattcgccagacgagagcgatggctgagaacgccgcaccaggtcgccttagactcacc

SEQ ID NO: 89541 - DNA, 42 bp, Homo sapiens
  chr22:42916273-42916315
  hypo
ctggagcaatacacacgggactggccatggataggttattga

SEQ ID NO: 89542 - DNA, 36 bp, Homo sapiens
  chr22:42944631-42944667
  hypo
aaaaataaataaatgactgtacgtttcacagtacac

SEQ ID NO: 89543 - DNA, 74 bp, Homo sapiens
  chr22:42963239-42963313
  hypo
aggcttggaccagggcgtcagccaatggtctgggaatgttaacgtgtttgtctttgatccgtgtgggatttgtt

SEQ ID NO: 89544 - DNA, 19 bp, Homo sapiens
  chr22:42995312-42995331
  hypo
gaaaggctctattcacgcc

SEQ ID NO: 89545 - DNA, 30 bp, Homo sapiens; identical to SEQ ID NO: 16790
  chr22:42995705-42995735
  hypo

SEQ ID NO: 89546 - DNA, 103 bp, Homo sapiens
  chr22:43012479-43012582
  hypo
gcgtgccaggaggaacgcgcaagaggtgggaggaggacaggctggccagtggggtcagctgggcagtgtagggcagatgcggaggacaattttatttttattt

SEQ ID NO: 89547 - DNA, 102 bp, Homo sapiens
  chr22:43012882-43012984
  hypo
ttacaactcatttagagctgtgttgatttttaaaattcttcgtataggtaggtgatactgcctgtgaattctgcagcgtaaagggcccgttacaactgttat

SEQ ID NO: 89548 - DNA, 50 bp, Homo sapiens
  chr22:43033683-43033733
  hypo
gggatcccagggccacgtcgggtaccacacgggcacggctctcgcagcaa

SEQ ID NO: 89549 - DNA, 140 bp, Homo sapiens
  chr22:43083005-43083145
  hypo
tctcctccaccctcacggcctctgtcttgttgttcatgtcaatgttcttgaagtccacaaactctaaatctaaaatcggtgaattttcaccaaattacacaccacttaaccagcaccagatcaagaaacaataaccagcc

SEQ ID NO: 89550 - DNA, 208 bp, Homo sapiens
  chr22:43116061-43116269
  hyper
tgggaccaggtgccccggcagatcctctcccaagcccagttccgctcccgctcagtcctcaaccttccccagctggagaggagggaggggcgcctgcggatccgaggcgagcgcggaggccgggcgactccaaccggctcgccccgtgcccagctcgtacccaggccgtttcccgcacggggagggcccttcccgcttctgggcaggt

SEQ ID NO: 89551 - DNA, 30 bp, Homo sapiens
  chr22:43265859-43265889
  hypo
aatttttggtaaatccgtagcacagaaatg

SEQ ID NO: 89552 - DNA, 169 bp, Homo sapiens
  chr22:43434409-43434578
  hypo
actcctgtaagtcaccgggctaccgggagactgcatgggaacaaccacgctcgcgcagcctgtcccgcagccatcgctcctcccacagctcctggctgcccacggcgcttccctgtagcaaacccagctgctgacgtcataaaaggcacacagccggacctgtctgtgc

SEQ ID NO: 89553 - DNA, 25 bp, Homo sapiens
  chr22:43484637-43484662
  hypo
cgtgcccggccggggcccatctttt

SEQ ID NO: 89554 - DNA, 203 bp, Homo sapiens
  chr22:43523306-43523509
  hypo
gggggctcagccatccgggggactcagcaccaccagacctgtccattccccttggtcagcctcagccatccgggggctcagcacccccagacctgcctgttccccttgtccaccatttccaccaaagcccacaggtgggcctgccccaggattctttttgaaatagcttgcacctctggggccacccacggatgggacctcat

SEQ ID NO: 89555 - DNA, 77 bp, Homo sapiens
  chr22:43524552-43524629
  hypo
tagaagtttcatggacggtttcaccacacttaaggagaacataatgaggttctggagatccccgaaccccgggtcct

SEQ ID NO: 89556 - DNA, 194 bp, Homo sapiens; identical to SEQ ID NO: 46745
  chr22:43524923-43525117
  hypo

SEQ ID NO: 89557 - DNA, 60 bp, Homo sapiens
  chr22:43528378-43528438
  hypo
gaccagggcctcagtcgccctccctacctggcactccccacaccccgcacctcactcaag

SEQ ID NO: 89558 - DNA, 30 bp, Homo sapiens
  chr22:43553497-43553527
  hypo
agtaagtggcagcaccggaatctgctggat

SEQ ID NO: 89559 - DNA, 67 bp, Homo sapiens
  chr22:43570247-43570314
  hypo
tggggcagctcagtgcgcaggttgaaggttcggggcagccagggtgggccctcggggccacctgccc

SEQ ID NO: 89560 - DNA, 43 bp, Homo sapiens
  chr22:43571286-43571329
  hypo
ttctgcaaggtgtcccgcctggacctgccggcctggctttcct

SEQ ID NO: 89561 - DNA, 30 bp, Homo sapiens; identical to SEQ ID NO: 16795
  chr22:43581330-43581360
  hypo

SEQ ID NO: 89562 - DNA, 36 bp, Homo sapiens
  chr22:43581591-43581627
  hypo
gcaggggacgtggcacggtggcgaccaccctctgtg

SEQ ID NO: 89563 - DNA, 30 bp, Homo sapiens
  chr22:43584877-43584907
  hypo
aacaaagcaagacctcgaccctacaaaaag

SEQ ID NO: 89564 - DNA, 39 bp, Homo sapiens
  chr22:43593004-43593043
  hypo
actctcatttcatcatgagttatgcggggaaatgggatt

SEQ ID NO: 89565 - DNA, 398 bp, Homo sapiens
  chr22:43600957-43601355
  hypo
aaaaaaagattttattaacaaagggtcccgctgcaaaatgacacaacacaaccaacatctgcaaacagagaacacccagccaagagcacaggctttgcagctggcagatcccaaatcatcacttcaggcctgctcgctggtccctggacctcgggaacatcgctttgctgctctgactttcattcttccctgcacagagaggtcacgatgcctcttcccggggctgcgaggaaaatgatctgcactggcgtgagcagagaacctctcctcagcggtgctcagtacaggtttgctgcagggatctaggcagcaaacggggctgtcctccggagcagtctctggagggcagatgcagtccccgccctctctgagccccagtgtctcgtctctctagtggg

SEQ ID NO: 89566 - DNA, 202 bp, Homo sapiens; identical to SEQ ID NO: 46749
  chr22:43603869-43604071
  hypo

SEQ ID NO: 89567 - DNA, 30 bp, Homo sapiens
  chr22:43608657-43608687
  hypo
ggtggtctcaggccccgctcttggcccttg

SEQ ID NO: 89568 - DNA, 30 bp, Homo sapiens
  chr22:43641411-43641441
  hypo
ggctgcctggggacacgctggtgacagtgc

SEQ ID NO: 89569 - DNA, 30 bp, Homo sapiens
  chr22:43655786-43655816
  hypo
ggaccatccagaggacggagctgacttcta

SEQ ID NO: 89570 - DNA, 92 bp, Homo sapiens
  chr22:43665077-43665169
  hypo
aacaagcctgatgagcgggcatcaccgtgcccaccttccaggcaagcagacggaggttgggacagcgtcggggaagacgtgccccgggctgt

SEQ ID NO: 89571 - DNA, 167 bp, Homo sapiens
  chr22:43677829-43677996
  hypo
cacccttcactgtcacggcacagtccaaattcctgctagacagggtcctgtccctctgagttccgccagctttgggcctggcttcaggctcctgggcccattgtctcccataggtaaccacagctgctgggacgaggactcctctggccaaccggaacaagctggaa

SEQ ID NO: 89572 - DNA, 30 bp, Homo sapiens
  chr22:43687676-43687706
  hypo
catggtgatgctgcacggtggtactcccga

SEQ ID NO: 89573 - DNA, 343 bp, Homo sapiens
  chr22:43689396-43689739
  hypo
cgggacccagccctgcggtctggctgcagaacacgcgcctttggccccaggctaagctggctgcgtcagcgcatgtgctcagaccaatgctgcgaagagccggctgctcctcacacgagctggagtccagtgtcaacttgagcacgtgcacgtcagccccagatgcagcttgccgtgaggagcatcgggaaggacccagcattcctggggttagtcccatctctgggcctataagaccctgtagagaactgtgctggcatacacttaacaatgggacctggacatgggcagctgtccctgggactcagttcggacccctctcatgtcacggttgttaccttcc

SEQ ID NO: 89574 - DNA, 30 bp, Homo sapiens
  chr22:43705089-43705119
  hypo
aaagggcttcccacacggcccaggcccagg

SEQ ID NO: 89575 - DNA, 30 bp, Homo sapiens; identical to SEQ ID NO: 46753
  chr22:43735330-43735360
  hypo

SEQ ID NO: 89576 - DNA, 30 bp, Homo sapiens
  chr22:43738298-43738328
  hyper
tgggcctgtggcctccgggtctccccctcc

SEQ ID NO: 89577 - DNA, 114 bp, Homo sapiens
  chr22:43738536-43738650
  hyper
cgtccatctgtcccccgtctcctcctctctctctcccttatcatcggtgggaccatccctcttgattccccctgatccaccggcctcctcctccttccccgggcggtgcgggcc

SEQ ID NO: 89578 - DNA, 540 bp, Homo sapiens
  chr22:43738979-43739519
  hyper
cggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgt

SEQ ID NO: 89579 - DNA, 27 bp, Homo sapiens
  chr22:43739548-43739575
  hyper
cggcaggtggggggtgtgggcctggcc

SEQ ID NO: 89580 - DNA, 205 bp, Homo sapiens
  chr22:43739576-43739781
  hyper
gccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacg

SEQ ID NO: 89581 - DNA, 336 bp, Homo sapiens; identical to SEQ ID NO: 38575
  chr22:43739825-43740161
  hyper

SEQ ID NO: 89582 - DNA, 81 bp, Homo sapiens
  chr22:43795778-43795859
  hypo
gagagagtcacgcagcgggggtgccttccccgcctgtgggggagccccaggcggcccgcacagtctcgtggtggtcgggcc

SEQ ID NO: 89583 - DNA, 94 bp, Homo sapiens
  chr22:43807413-43807507
  hyper
ggaccttccagaccccgggcgggaggggcccacagcagggtgccccggcggccccaggagggggtccgggcctcgggcgaaggctgcggcgccc

SEQ ID NO: 89584 - DNA, 14 bp, Homo sapiens
  chr22:43807746-43807760
  hyper
gggatgcggactcc

SEQ ID NO: 89585 - DNA, 170 bp, Homo sapiens
  chr22:43808237-43808407
  hyper
ccaggcgctgggcgacgcccgcggcgctgcgcaggggcgcccgcaaagttactttggccgcctttgccgggtgcgggaagcgggctgggcaccccagctgccccgcctgcctagcgggcggcggcgggagggggctccgccagggcgcgggactccggctggggccgcgg

SEQ ID NO: 89586 - DNA, 30 bp, Homo sapiens
  chr22:43898540-43898570
  hypo
cccaagaagatgcagcgggtgggctgtgtg

SEQ ID NO: 89587 - DNA, 44 bp, Homo sapiens
  chr22:44208519-44208563
  hyper
ggctgcagtgaggtccgcaaagcccctaccgcatcctgcgcctt

SEQ ID NO: 89588 - DNA, 30 bp, Homo sapiens
  chr22:44235527-44235557
  hypo
aaaacaaagagaattcggcccaaagcaggt

SEQ ID NO: 89589 - DNA, 30 bp, Homo sapiens
  chr22:44255795-44255825
  hypo
agcacagtcctaacccgccatctaagctag

SEQ ID NO: 89590 - DNA, 44 bp, Homo sapiens
  chr22:44257998-44258042
  hyper
gcccagcagaagccccgggcgcgggcgcggcgtctacgcggccg

SEQ ID NO: 89591 - DNA, 253 bp, Homo sapiens
  chr22:44258280-44258533
  hyper
gccgccgccgcctcccggctcgcagcccgcacgcgcccgcgcccgcgcccgcgcccgcgccccgcacacgctcgcgccccaccggcgcgcggcggcagctccgcaggcgtgacgtcatggcgccgccgacgcgcggcggaggctccgcgggtatgacgtcatggcgccgcccggcacgcggccgcggcgctgcacgggcgtgacgtcatggcgccgcggagccgcgtcctccccgccccgcccccggccgggg

SEQ ID NO: 89592 - DNA, 91 bp, Homo sapiens
  chr22:44263881-44263972
  hyper
gcagggaaggcaggtcgctgtccgcggtgctgaacgcacagcttcccctttatccccctgcccttccatcctggcacgctgggtgaccaca

SEQ ID NO: 89593 - DNA, 478 bp, Homo sapiens
  chr22:44287444-44287922
  hyper
taaatgaggctgtgccgggggtagagggcgcagagcacagcgccaggcaccagcgtctctgggctcgatccgctttcattaagctgtccccgccccttttcgcccccgcggtccgggactcaccgaccgacttgccgcagacgatgctgactgcgttgagcgccccagacgaggaaccgtagatgcggcgggcgccctggaggaggcgcggggctcgctggcgcaggcattcggtggcgcccacgtggtgggcgcccaggtagccggcgccggagaaggacaggttccatctgccctcctcctctaagaagcccatggcgggtggaccgggcggggtgatcgggacgaggaagggtcactccgtgacccgggatagggccgggatgcagccttggacggggctgggcccaaatgtgggctctggagggagccgggctggggctggtgctggtgctccctgcgccgcccccgggctgcg

SEQ ID NO: 89594 - DNA, 102 bp, Homo sapiens
  chr22:44319733-44319835
  hyper
gccgattcccgatcccgacccagatcctaacccgcgcccccgccccgccgccgccgccatgtacgacgcagagcgcggctggagcttgtccttcgcgggctg

SEQ ID NO: 89595 - DNA, 605 bp, Homo sapiens
  chr22:44319869-44320474
  hyper
cgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttcc

SEQ ID NO: 89596 - DNA, 104 bp, Homo sapiens
  chr22:44419815-44419919
  hyper
acaacagaccggccacgttcgtgtgacctgattctctccggctttcaggacgtcctgaggctgcacccacgtggcaatggtgtctgtcgcgctgtcgcctggat

SEQ ID NO: 89597 - DNA, 202 bp, Homo sapiens
  chr22:44420478-44420680
  hyper
ctttgacccaggacccgtaaacaacggccgggacctggcgcgtggggccgcggtggcctccggagtctgccaaacgcgcgtgcgggcgcctgcgcggcggggacctcgggccaccgtgcggggcccgcgcctgctctgcctgccgggtgttcagctcttccctgggccagcggcatagccagccgcgcggggtgaccgttca

SEQ ID NO: 89598 - DNA, 30 bp, Homo sapiens
  chr22:44440960-44440990
  hypo
ataaaattagtctggcgttgtgttgtgtgc

SEQ ID NO: 89599 - DNA, 30 bp, Homo sapiens
  chr22:44451937-44451967
  hypo
cttgcgttttgcacacgcatgcatctctgt

SEQ ID NO: 89600 - DNA, 237 bp, Homo sapiens
  chr22:44455600-44455837
  hypo
aataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagcatcatggaagggggatgtgaggtacccaggtggcagtttctctaccacgatgctttctctgcttgctatcgggagaaatgttct

SEQ ID NO: 89601 - DNA, 37 bp, Homo sapiens
  chr22:44456975-44457012
  hypo
actaggagtacccctcgccacgcgtggggacccattt

SEQ ID NO: 89602 - DNA, 30 bp, Homo sapiens
  chr22:44478056-44478086
  hypo
tgggcggtaggttcccgtgctccggaaggg

SEQ ID NO: 89603 - DNA, 271 bp, Homo sapiens
  chr22:44484711-44484982
  hypo
taggtgctcaggaaacgttagtggtgctctccccctttccaatggacagtcagcaatatgggttggacaagtatgttctgtaatccgaggttgtgtgccctctggctggcccacaaaatttgaattaatggctcgtatttataaatggggagattccacaccaaaccccacatttccagcttttcttgaaaactcagatctggtgactgcagcctgcacttcccactctgccatcccgggctgagcgaggagtgcccgtctccagagacag

SEQ ID NO: 89604 - DNA, 30 bp, Homo sapiens
  chr22:44487778-44487808
  hypo
ggcatcctggggccccgctgccattgtcct

SEQ ID NO: 89605 - DNA, 30 bp, Homo sapiens
  chr22:44490749-44490779
  hypo
tttcactgggctttgcggtgcaggagctgt

SEQ ID NO: 89606 - DNA, 30 bp, Homo sapiens
  chr22:44492533-44492563
  hypo
caaagtcttgaaccccgggcattttgcccc

SEQ ID NO: 89607 - DNA, 35 bp, Homo sapiens
  chr22:44493706-44493741
  hypo
ggtaacagtaagcctcgaaacggcatctctgtcct

SEQ ID NO: 89608 - DNA, 30 bp, Homo sapiens
  chr22:44498119-44498149
  hypo
cagatgaggcccacccgctttggggagggc

SEQ ID NO: 89609 - DNA, 48 bp, Homo sapiens
  chr22:44500221-44500269
  hypo
cccggagagcagcttcggtttggctgtcggtggcgtgttagttactgt

SEQ ID NO: 89610 - DNA, 30 bp, Homo sapiens
  chr22:44512205-44512235
  hypo
gctattggcgtcggtcgtcatcacctgtgc

SEQ ID NO: 89611 - DNA, 36 bp, Homo sapiens; identical to SEQ ID NO: 46756
  chr22:44527455-44527491
  hypo

SEQ ID NO: 89612 - DNA, 39 bp, Homo sapiens; identical to SEQ ID NO: 16798
  chr22:44538737-44538776
  hypo

SEQ ID NO: 89613 - DNA, 148 bp, Homo sapiens
  chr22:44547536-44547684
  hypo
ctcacaaggaactcccgtggtgcaggcagaaataaccaccgtggccttctcagcccctctgtcttcctttcctggggctgctgccacaaagcaccacaaacctagtggctgaaacaacagacctttgtgtcctcgaagtgctggaggc

SEQ ID NO: 89614 - DNA, 361 bp, Homo sapiens
  chr22:44564136-44564497
  hypo
tggggtttttggtcccggtaagtgtcattagccatgtcccccaaccggttcttagacatgtcctgatgcagatccaggaggggctgtgggagtgtctctgttcttgtcaccccaggtgcctgtccccgcagggtgtcagcccgcgccaggagctctcacaaaacctgtgtgtctggggaggcactgcccagagcgtcctggacatggtggtggccagtctttaaggggaagcgctgtgtgtggatgcggcagctggtgtcatgctggagacgtggcttctgagagtacctaccgcaatgacaggaggatggcacgcctctgaagtttctctgtttccttctgcagacgtggttaacttgga

SEQ ID NO: 89615 - DNA, 62 bp, Homo sapiens; identical to SEQ ID NO: 46760
  chr22:44580537-44580599
  hypo

SEQ ID NO: 89616 - DNA, 202 bp, Homo sapiens
  chr22:44664405-44664607
  hypo
ggtgagggagtggaacgaggtgccgggactcccagcccagggttctgctctgcaccagcaccccccagaagactcagtccagtggaaacaggccacggagctctctgactgtgctgcaagtgggcagcagggagagggtgttttagaggatggggagaggcctcgggaaggagcgtgacctcagcgacgttttgaggaatga

SEQ ID NO: 89617 - DNA, 60 bp, Homo sapiens
  chr22:44671250-44671310
  hypo
agcccgcgaaggggccgacggcggatcagaagcgaggctgagtttcgggaagctcctggg

SEQ ID NO: 89618 - DNA, 124 bp, Homo sapiens
  chr22:44681378-44681502
  hypo
tggggcttgtggcagcgggcctgggggaggctgcggctgtggggcccgctgacccggccgaggggcccgagcggggttcccccaccgccgggggtcctgtttcatccatcgtccttggatgccc

SEQ ID NO: 89619 - DNA, 149 bp, Homo sapiens
  chr22:44698427-44698576
  hypo
gacctttgagtgaggcgggagaggccacgtggctgtctggaagaagagtgctgcacacggagggatagcaggggcaaaggccctggggtgggtgcggtgaggaggcagcaggggcaaaggccctggggtgggtgcggtgaggaggcagc

SEQ ID NO: 89620 - DNA, 30 bp, Homo sapiens
  chr22:44708919-44708949
  hypo
ggcccaggatggcagcggctgctcccgcag

SEQ ID NO: 89621 - DNA, 174 bp, Homo sapiens
  chr22:44715015-44715189
  hypo
agccctggcctcgcacgcggtggagacaggaggaaaaggccattccttgagcacctccgatgtgttcagcactatcctgggtgtttcacaagtatcatcccctccaatgttcccaaaaggaggggctactgcccaagtctgcagatgagaacacagcctcggagagattgtgtt

SEQ ID NO: 89622 - DNA, 269 bp, Homo sapiens
  chr22:44726709-44726978
  hyper
ggatcaatgttgattcggccccggaggcgacagcggttccgcaggggccgcgcggcggaccaggacccaggggcacgcacttgggaggggtccttctacccgtcccctgcgctgcccagctgggacccccaggcccctctgggtccgcagcgtggccctcagtccccgtgcagcccgcacggggctcccagctcactgagctccccgactctgttcttggaagccagtcccccccttggacgcggattccggtcccggccgccgcgtcc

SEQ ID NO: 89623 - DNA, 890 bp, Homo sapiens
  chr22:44727361-44728251
  hyper
gggctcagctcacctcgtgcccgccgcccgctcgttcctcgcttcgtagccgggagccggcgcccgcgggagccgcctgctggggtgcgggggctgcccacgcccccgcgatgcccctgccgccgccgcaacagttgtccgggttctgggggctgcggggacgcggggactccgggctccctgatcggcgctcggaaggcgcccgctcctaggcgcgccgggcgcggcgcggagctggggccggggccggggctggggctggggccggggctgcagctccggctcggcgtccggctcggggtccggctgggggtccggcggccggccgcatgccccgtcgccgcccgcggctactcggcggcccgcgccgcccggccgcccgccggccccgagccccgcgccgcgcccgccgccgccgccgccgcgctcatgctcgccgggccccgcgctcgccgccgccgccgccgccgccgccgctgcccacttcactctttggcgctcgctccgcgccgcgccctctgctgccccctcgcccgggctcgccgagctcccgccgccctgcccgccgcgtcctgcgccctcctctctctcccttcctctctcctcccttcctctctctctctccctctctctctcttgcgtcctcctctcattttttttttttctttcgcggtctcttttctccccctctggctctttctctctcccctcctgctgtttgcggtggcttctcactttctctctttttacttcctttccgtccgttctttcacgccttcctcctcattttccttccttctacttttcccttccctctttccgctttcctgccccgtttccttcctccctcccttcctccttccttccttcctctgcgttcttcctctctc

SEQ ID NO: 89624 - DNA, 30 bp, Homo sapiens
  chr22:44765215-44765245
  hypo
tgggacgctcacgtccggcagaggcagcgg

SEQ ID NO: 89625 - DNA, 30 bp, Homo sapiens
  chr22:44782734-44782764
  hypo
agctcctgcaagcaacgatccattcgcaaa

SEQ ID NO: 89626 - DNA, 862 bp, Homo sapiens
  chr22:44892516-44893378
  hypo
acgtaagaggaagcacggcaaggtgggcaaccagggcgccaggaaggacggaaggaagatctcctcggggaacacgtctggagaggcaagaagggaggtcttcaaacaggggcaaagctgtcgtatgggcatttcttctacacagcaaagagcgtatgctacctgggtggctgcagacgctaccaagtgctggcggattcttaaagattccgtgctcgggcaggcagggctggcgctggactagtcccgttggaagctggatgcactgggcaaggccccgtgcccgcagaggccagctggcggcagagcatctgcctctctcgcacagccctattagaggcagaagtcttcctgatttgggcgcgccgcgcatgccggagcggagacttgtaggttctccgcaactctgccaggaacccctgatagttgttgcgcaaggggctgtcaggttgcatgtgggggatagcccacttctccgcctccccagtcagtcgagacacaaggaaggccacacgctcggcctcacccgggaagcgggaggcctggaagatcatgaatctgtccatctgcatcaggaaccccgccaaccggcctgggtccccggaaaagggctcgggcagagaggttggaggtgtggtcatgggtcgagtcccgtttgaagtaattgaggagatgggcggggtgatctgcagagcccccgggatccgcgccctggtgcgtaacaaggtcagctctgccatcacgctctccagcatgttggtgagattggccttctccgcccgcagggtggaagcctcccgcctcagcgccgagttggtgaggcgcagggaggtcagggtgtcaataacgtcatccatctggg

SEQ ID NO: 89627 - DNA, 144 bp, Homo sapiens
  chr22:45004252-45004396
  hypo
tgggcagcagagtagcgccggtgccctccaggccagcccattctgtccaggctccagttcggcagtggactcctcctgccctgaccctcaccctccatccgcctgtttcccggggtacgctagtcaccacgctaaggatgccct

SEQ ID NO: 89628 - DNA, 303 bp, Homo sapiens
  chr22:45016198-45016501
  hyper
ctgctgagggtccagcgctgcggctgggcggggtcgaattgtgttctgggcaatgctggtgtcacttaaagtgaaatacacaaggggcggacgggcggctcccgggctccgggtccttggcctggacctcggcctccccaaagtgaccccggatggcaccgcgagtccccgtttccgacaaccacacggcgccggctgcacacgtcctgtttgcgtggttgctaggaggttgccatggcgactaatcggggatgagggaagcctagcgcttaacacatccccctccgacggtcaaaattgggc

SEQ ID NO: 89629 - DNA, 150 bp, Homo sapiens
  chr22:45020626-45020776
  hypo
tggcctccagaactgcgatcgaataaatgtctgttgttttaagtcccccaggctgtggtcatctgtgagtccgcagaactgacttggggaccttgggtggcagcagctcccctgcacacggtcccacgggtccagcgctgcccacactct

SEQ ID NO: 89630 - DNA, 77 bp, Homo sapiens
  chr22:45064126-45064203
  hyper
ggtgccaggcccattcgtcttcccctccctccccgctccgcccgcggctggaccccgatccccgggacagggactga

SEQ ID NO: 89631 - DNA, 243 bp, Homo sapiens
  chr22:45064675-45064918
  hyper
ggggaccgaggtgagcggcggctacgggtccggaggcccggccggagaggggaccgggtggctggggttggggggcggcacgcgcgaccctgcggaagggggggccccggggcggtgccggcggagcggcgcgcgcgtgtgtgtgcgcgcgtaggtgcgcgcgcgcgcgacgccgactgcggggccctagggtggggtaggggtcggacggaatctgcggggcaggggcggcccccttgggtg

SEQ ID NO: 89632 - DNA, 163 bp, Homo sapiens; identical to SEQ ID NO: 46766
  chr22:45075725-45075888
  hypo

SEQ ID NO: 89633 - DNA, 30 bp, Homo sapiens
  chr22:45085002-45085032
  hypo
atttttaggttttctcgttctctaaattgc

SEQ ID NO: 89634 - DNA, 30 bp, Homo sapiens
  chr22:45087165-45087195
  hypo
tgaccctgcaggtgacgtcaggactcagaa

SEQ ID NO: 89635 - DNA, 156 bp, Homo sapiens
  chr22:45088610-45088766
  hypo
tgcagcccgggagtccgtcccgctctgccgcctgccctgaggagcctcagtctgcaggtctgcagagcggggatgttccccgggcctgcctggcagggcggctgcaaacacgaaggttcggaagtgcacgagctctcagcacggggccaggcacag

SEQ ID NO: 89636 - DNA, 133 bp, Homo sapiens
  chr22:45093092-45093225
  hypo
cctggtgcttggtgccggagtcaccgcgagtaccctgggctcccccagcgtggtggccctgactcaggaacctccttctgccgtgcgaccaccctggcggcggtcaccaagcccttggcgtgcccctgtgact

SEQ ID NO: 89637 - DNA, 51 bp, Homo sapiens
  chr22:45098330-45098381
  hyper
gcggcgcaggcggcccgggtcaccatgaggactctccgcaggttgaagttc

SEQ ID NO: 89638 - DNA, 49 bp, Homo sapiens
  chr22:45098851-45098900
  hyper
atttttcccattttgcggctgagcacgggagcctcggggctcagtgggt

SEQ ID NO: 89639 - DNA, 132 bp, Homo sapiens
  chr22:45120626-45120758
  hypo
ataaaaggggaaccccggtgaatgcctgcggctgggttggtgaagactgaatgagcttctctggaataaagagtaaacacttgggaagaagctctgcaggcggagagaggaggagcccgtggcatccgggat

SEQ ID NO: 89640 - DNA, 22 bp, Homo sapiens
  chr22:45129859-45129881
  hypo
gtacctgggtgtggccgggtgc

SEQ ID NO: 89641 - DNA, 40 bp, Homo sapiens
  chr22:45135939-45135979
  hypo
ctaaggtttgttaaacgagtgaaatcggtggttaattagt

SEQ ID NO: 89642 - DNA, 99 bp, Homo sapiens
  chr22:45137823-45137922
  hypo
acatactggatgattccattccgagatgttcagaataggcaaatccacggggacagaaagtagagtggtggtcgccagaccctgcgggagggggtttaa

SEQ ID NO: 89643 - DNA, 213 bp, Homo sapiens
  chr22:45148657-45148870
  hyper
cggggggagaccctccggccggcgcgcagcctccgggtcccctgtgggttctagactccctctcccttcacctcctttctttcccgcccccccacactcccctcctctgctttttcccctgtcctgttccttctcaccccgcaccgccttccccgccctcgcctctctcagcctgcgttttggtctggtctggccggacggtgtcagctcaaa

SEQ ID NO: 89644 - DNA, 30 bp, Homo sapiens
  chr22:45218482-45218512
  hypo
gcatcgacaaagatccgcagcaaaaggtgc

SEQ ID NO: 89645 - DNA, 162 bp, Homo sapiens
  chr22:45259666-45259828
  hypo
gaaacttagagggtgcggtctcctcgctggcctccctcttcacttgtgtgtcttcccattattcccctgcccctcatctgccgctgtgtgtgttctaccctgctggtgctcgctgtccttaagggaggggctcgtgtggctgctgagcgaccccccacgccc

SEQ ID NO: 89646 - DNA, 351 bp, Homo sapiens
  chr22:45277170-45277521
  hypo
aatctcaagacacatcggcagctacccctcccgggtccaacctttcagatcctcccattacactgttaaaacatgtaactcaatccatccgcgaagaaaaccaaaccaacagaaaaggaagctgaagacatggacatcgcaagccacgcggtaatgcatacttggcacagagtagccaatatagaagacgtgtgcctcacacggttcactttgttcatcaataaaagaatataaaaatcttgttcacccagtggtaagtgtattaaaatagatctgtatcatacagcacagtttctcccggagtcgtgagaatgacaggagggaccgtggcagctgcgggatttgccggcc

SEQ ID NO: 89647 - DNA, 30 bp, Homo sapiens
  chr22:45289175-45289205
  hypo
gagagagatgatttacggtcaccccccagc

SEQ ID NO: 89648 - DNA, 30 bp, Homo sapiens
  chr22:45304141-45304171
  hypo
gcctctgggcctcagcgtccccatctgtac

SEQ ID NO: 89649 - DNA, 30 bp, Homo sapiens
  chr22:45343734-45343764
  hypo
acgacttacaaacagcgatgtgcgcaggtc

SEQ ID NO: 89650 - DNA, 30 bp, Homo sapiens
  chr22:45395822-45395852
  hypo
cactcactaatcctgcggcctctcgaagat

SEQ ID NO: 89651 - DNA, 401 bp, Homo sapiens
  chr22:45402788-45403189
  hyper
cagctttgtgctctgcggaaaagggtcttccgacccctccccctccaaaaatggcatcaaagcaatcaaaatggtaatgcagggcctgggtcccctccccccgccaactccccgacttcgccggggccgcgcgccgggcccccctccggcgggaatggaagcttccactcccggacgggggcgcgcggccgggggcgggggggccgcggcaccaactgaaaagggttagcgcatttgtcccaagccttcggtccagcccggcggcccagaccaggcgcgggccgcggcactgccatcttcctttcagcaagcccggccccccccaaaacccgccactcgcgcacgccccctcccatcactttttaactttaaagactcgacacgaacgcccggcctccgaa

SEQ ID NO: 89652 - DNA, 1100 bp, Homo sapiens
  chr22:45403911-45405011
  hyper
ttccccgggagctggcgtcaggttccaagaataaaaagtgaagctagggaagtggaaggtggtgggggggagggagcctcgaggaacgatttcaaaacgaggtttgccacggaacccagaaatcgcttccaacgagtttggtgtccaggcccccacggccgcccccctccgcccccatggccgcctcagcgcaaagcgggggactccgagccgggagaaatcgccacgttccaaaaacatgtccaccacctcaaaatggacgccgggccgcgcgctgccttttaagtgagctcctctcttcggcccccgcagggcccggctctccctgccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgggggccgaggccacccggcggcgcgccccgagccgtgcaagtttgcaggccggggtgcgtgtgcgagtgagtgtgagtgtgagtgtgtgccgggggaggggggaggaacaaagagccaagtaaacacggcgagtccgtgtcgagcaaagctcataaatattcaagtcgcgtcctaatctccccaacacacacacgcgcacgccgagccccgctcaggctccggccgccacgccgccgctcgccagcagcgatcgccaaaactacttctgcacaccgggcaggttcgcccggggcg

SEQ ID NO: 89653 - DNA, 386 bp, Homo sapiens; identical to SEQ ID NO: 38590
  chr22:45405046-45405432
  hyper

SEQ ID NO: 89654 - DNA, 151 bp, Homo sapiens; identical to SEQ ID NO: 38591
  chr22:45405476-45405627
  hyper

SEQ ID NO: 89655 - DNA, 86 bp, Homo sapiens
  chr22:45405628-45405714
  hyper
agccctcggctgccccaactcctcaggctgcccggcaagttgcgccgggtccccgggctgccggcgcggcccggagcatggccccc

SEQ ID NO: 89656 - DNA, 15 bp, Homo sapiens
  chr22:45405944-45405959
  hyper
gccccgcccccgccc

SEQ ID NO: 89657 - DNA, 346 bp, Homo sapiens; identical to SEQ ID NO: 38593
  chr22:45406039-45406385
  hyper

SEQ ID NO: 89658 - DNA, 142 bp, Homo sapiens
  chr22:45477440-45477582
  hypo
tctctactttttaatctgaggcttacagaggttaaatggccggaccaaggtcacacctcttatgatagatgaagtggagactcagccaggtctgtgagctcatgtgcttggaatcttaaccgctgggcgacagtgccacctg

SEQ ID NO: 89659 - DNA, 49 bp, Homo sapiens; identical to SEQ ID NO: 16801
  chr22:45593666-45593715
  hypo

SEQ ID NO: 89660 - DNA, 104 bp, Homo sapiens
  chr22:45595127-45595231
  hypo
gacagggagcaggcacgggtgctcaggagagagtgcagactgtgcctgggcaggactaaggggcatggtaacacccagatacagacaaccggagtccaggggac

SEQ ID NO: 89661 - DNA, 30 bp, Homo sapiens
  chr22:45603916-45603946
  hypo
cacagcacaggcaggcgaaagagcaggttc

SEQ ID NO: 89662 - DNA, 203 bp, Homo sapiens
  chr22:45604184-45604387
  hypo
aacaggcagaaccaccgactccacacacatgagctgtgagaacaggcagaaccaccgactccacatgcacgagctgtaagaacaggtagaacccgccaactccacacacacgagctgtgagaacaggcagaacccaactccacacgcaggagctgtgagaacaggcagaaccaccgactccacacgcacgagctgtaagaaca

SEQ ID NO: 89663 - DNA, 218 bp, Homo sapiens
  chr22:45680590-45680808
  hyper
cccattggtgagagacgctgtggaagggctgccctggcctgggcacacagtaggcgctttgatgcgggctggagaaggtcctgcccggtgggattgcgccctggggcaccgcgcacgggtcggggaagcccggggcagggccgtatgcaaatagcgcgcgaggaggccgcggattggccagcccaggcgggggcggggcgcgccgagggcccagagct

SEQ ID NO: 89664 - DNA, 142 bp, Homo sapiens
  chr22:45809468-45809610
  hyper
acccgcgttatcaagcgcccgcggaaaaagcgcgggaagggattcgccaagtgtcgcgagaagagagcgagacgcggcaagcgcggagccgttccttagcaacgagttgttgacatttccgagagagcgggagcgtctgtac

SEQ ID NO: 89665 - DNA, 615 bp, Homo sapiens
  chr22:45898351-45898966
  hyper
agggtgcggggttggcggtaaggcctgccccagtgccccccagcagccgggcctccgactgcaggcccgggtccccgctcctccgcgcggagtcgggcggggataacctttgatcccgagccctcccctcgagagggggtggggggaggaggggatcgggtttcacggagtgttgggggataggactgggggcatccggcccgaaggcgccccctctgtgccccctccggggaagtctgggatccaggccctcgcccccagccgtgggcgcgcgcccctcgcagccggggtccggggagggagggtcccggcagggggcgccggggagggaggaccaggagacccgcggccccgcctccgccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggaggtaggggcgtcccgggtccgcc

SEQ ID NO: 89666 - DNA, 106 bp, Homo sapiens
  chr22:45898967-45899073
  hyper
ccccagcttagggtcccgaccccctcggcctcgcgctccctgcgagtttcggaaccacggggactcggagtccgtgcgttgccctgcgcggcgcccccggactgtc

SEQ ID NO: 89667 - DNA, 106 bp, Homo sapiens; identical to SEQ ID NO: 46773
  chr22:45931289-45931395
  hypo

SEQ ID NO: 89668 - DNA, 55 bp, Homo sapiens
  chr22:45939677-45939732
  hypo
ggagcatgacacccacgagtcacagggccttggttatgcccgacctctccctgcc

SEQ ID NO: 89669 - DNA, 30 bp, Homo sapiens; identical to SEQ ID NO: 46774
  chr22:45981309-45981339
  hypo

SEQ ID NO: 89670 - DNA, 30 bp, Homo sapiens
  chr22:46077505-46077535
  hypo
aacttgttacctttgcgacagtacccaaat

SEQ ID NO: 89671 - DNA, 634 bp, Homo sapiens
  chr22:46262418-46263052
  hyper
gggaggtggagacagcgcgctcccgagccctggaccactccctctgccccgcgcggggccgagctccacggcacgtgctttggcttggaccgggaaggcccgcagtcccacagtgcccggggaggacggtccgcgccttccacgacttcgcgccgcccgcgtggctgcagcgccgtggcccggggacgcgaggccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaagg

SEQ ID NO: 89672 - DNA, 113 bp, Homo sapiens; identical to SEQ ID NO: 38598
  chr22:46263511-46263624
  hyper

SEQ ID NO: 89673 - DNA, 105 bp, Homo sapiens; identical to SEQ ID NO: 38599
  chr22:46263743-46263848
  hyper

SEQ ID NO: 89674 - DNA, 130 bp, Homo sapiens
  chr22:46276993-46277123
  hyper
tgatgaatgcagccgcggttgagaatcgcccgcgtgaatccctattcagagcggagcccttgttctcgccgagtctgctgcctgggcagccgcagatgtcccagagcagagtggacgattctgcagacac

SEQ ID NO: 89675 - DNA, 30 bp, Homo sapiens
  chr22:46278524-46278554
  hypo
ccagcgccagcctgacgggcatttgtgggc

SEQ ID NO: 89676 - DNA, 39 bp, Homo sapiens
  chr22:46318740-46318779
  hypo
tgcaggtgaagacctcggtgcgctcgctgcaggtgttgc

SEQ ID NO: 89677 - DNA, 30 bp, Homo sapiens
  chr22:46346365-46346395
  hypo
ttgggatgtggcagccgccaactcgggact

SEQ ID NO: 89678 - DNA, 58 bp, Homo sapiens; identical to SEQ ID NO: 38600
  chr22:46367066-46367124
  hyper

SEQ ID NO: 89679 - DNA, 22 bp, Homo sapiens
  chr22:46368102-46368124
  hyper
cgacagtagaagcatggtgggc

SEQ ID NO: 89680 - DNA, 404 bp, Homo sapiens
  chr22:46372053-46372457
  hyper
ggtgatggatagagacgaagggccgcggcgggtgccccggcctgcgcgctcgcggccgggtgcgcgccccccgccctcccgggcctccgcaggcgccggacgccccccgaccccgccccggcgcaccctccaggcggcgagcgctcggcccgggctcggcgcccagcgcagcccgggggagggaaggcgcgtcccacccccggggcctggagcccaaacaggtgaaagtacgcgccgggcacgctcgccgctacccgcgagcccggccggaccgcccgcgcgccccgctctctctcctcccgcgctgggctcggcgcctctcgggagctcagggggttgggctgcgtctctgctggcgtggggcgagggtctgacacacgggccagccccggagcccagagagc

SEQ ID NO: 89681 - DNA, 30 bp, Homo sapiens
  chr22:46372944-46372974
  hyper
gcagcctgcactaggcgcagccgcctgagg

SEQ ID NO: 89682 - DNA, 47 bp, Homo sapiens
  chr22:46373779-46373826
  hyper
ctgcgccatggttttcgtggcttcctctgcagcgcccagctgtgttc

SEQ ID NO: 89683 - DNA, 24 bp, Homo sapiens
  chr22:46410610-46410634
  hypo
gtgagccaccgcgcacggctatcc

SEQ ID NO: 89684 - DNA, 172 bp, Homo sapiens
  chr22:46435835-46436007
  hypo
ataaaatgctcacaacgtattcaacaaaaagactgtaaaataacctatagtatgatctaatgattatatatacatgaatatatgtatgcatttataacttacgatatggtccattcatatagatatgtgtacacacacacaaacacatatatgcatgcgcacatatatacac

SEQ ID NO: 89685 - DNA, 27 bp, Homo sapiens
  chr22:46438085-46438112
  hypo
aaaatcagctgggcacgttggctcacg

SEQ ID NO: 89686 - DNA, 153 bp, Homo sapiens
  chr22:46440550-46440703
  hyper
gccgcggcctccgcgcggttctcttcctcccctccccggcctgcttttcctccttctttccctctttgttgccaacctcggagccgcgactgaaacccagcccagcgtgtccgcgaagcccggaaacttccagctccgcgactgtgcagaaag

SEQ ID NO: 89687 - DNA, 105 bp, Homo sapiens
  chr22:46440994-46441099
  hyper
gccgctgcaccggagcgcacggccgagcccgcggcccggcccccggcgaagtcagcccccagcctcccaaacaaagactcgcaaagttcggaagagaatctttcc

SEQ ID NO: 89688 - DNA, 118 bp, Homo sapiens
  chr22:46495143-46495261
  hypo
ggcgggcccacctcccgaggctgtgcggagaggaccccaggctgctgcatgtgagcagagcagccggtgtctggcccggacccctctgccatctggggcccggcgtgtttacaggtcg

SEQ ID NO: 89689 - DNA, 30 bp, Homo sapiens
  chr22:46498655-46498685
  hypo
gcacagttgctcctgcgctggctgtggctg

SEQ ID NO: 89690 - DNA, 55 bp, Homo sapiens
  chr22:46512624-46512679
  hyper
ccccagggcgcttcccgctctcctggcgtgtgtgtgtttgcgggggaggtgtggg

SEQ ID NO: 89691 - DNA, 187 bp, Homo sapiens
  chr22:46521852-46522039
  hypo
cccattctacacagccgaaccaaggcactgagcgctcaggagcccagaggaagcctggtggctgtgagccgggccggctggctcattcagcccaggccccacccgccctgggatgatctggaccccggccctgctctcagctctcaatgctcccttcccagatgagccaagacgtcccatgcagacg

SEQ ID NO: 89692 - DNA, 53 bp, Homo sapiens
  chr22:46545478-46545531
  hyper
tccgctccggcagctcgagcgtcacggcccgaacaaagcggctttgcagggcg

SEQ ID NO: 89693 - DNA, 30 bp, Homo sapiens
  chr22:46571644-46571674
  hypo
catatggcatataaccgtttgagactcagg

SEQ ID NO: 89694 - DNA, 34 bp, Homo sapiens
  chr22:46615432-46615466
  hypo
accctactaatgagacgaacgatggtgtcacctt

SEQ ID NO: 89695 - DNA, 232 bp, Homo sapiens
  chr22:46634500-46634732
  hypo
acagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcag

SEQ ID NO: 89696 - DNA, 21 bp, Homo sapiens
  chr22:46651216-46651237
  hypo
ccactgcgcccagcccccatg

SEQ ID NO: 89697 - DNA, 110 bp, Homo sapiens
  chr22:46658633-46658743
  hyper
cggcctgcaacatcacgcgcgcggggccgtctgtggggcactcggtgcgggccacgaagccctgctggggccgcgggcctggcgcggcggagcgcggggagacgcgggcc

SEQ ID NO: 89698 - DNA, 144 bp, Homo sapiens
  chr22:46719046-46719190
  hypo
atcactttacctgaccgcacacttcctttcttggacttaggtgactccccggacagctcaacaccaaagctttcgcgggcacagcggccgcagtcgtgcacgtcagttggcaggtgagtgacgttggtccgcttcctctcttta

SEQ ID NO: 89699 - DNA, 37 bp, Homo sapiens
  chr22:46748950-46748987
  hypo
cttgtggaggggagacggcaggcggagccggggctag

SEQ ID NO: 89700 - DNA, 77 bp, Homo sapiens
  chr22:46770807-46770884
  hypo
gaagcacctgggaggcggcggggaaggttggccctggctggtctgacacacgcctcggggctcgtccttcatgggcc

SEQ ID NO: 89701 - DNA, 138 bp, Homo sapiens
  chr22:46805005-46805143
  hypo
ggtcactccaggacacgacgctctcaccgctgaagagctgggggtgaggcatggctgcggacacaggcccagggacctcaggtgtctcccgaaatcacacggccgcggacttggctgcaggggcgggggatgggcctg

SEQ ID NO: 89702 - DNA, 30 bp, Homo sapiens
  chr22:46847001-46847031
  hypo
tgcccttgggtttcacgcattgtttgactt

SEQ ID NO: 89703 - DNA, 148 bp, Homo sapiens; identical to SEQ ID NO: 46779
  chr22:46929253-46929401
  hypo

SEQ ID NO: 89704 - DNA, 93 bp, Homo sapiens
  chr22:46929625-46929718
  hypo
gctcgttgccctgcacgaaggtgtagttgaggctgtctgacacgtcggggtcatgggccgggatgcagccgatcacgccggtggggaaactgt

SEQ ID NO: 89705 - DNA, 113 bp, Homo sapiens
  chr22:46929921-46930034
  hypo
agctggaagaaatgccgcatgtccccttccacaatctgatacatgatctgggcattagggccttcatcagggtcgttagcacgaatctttgccaccaccgaccccactgggtt

SEQ ID NO: 89706 - DNA, 30 bp, Homo sapiens
  chr22:46930811-46930841
  hypo
gtagtccagaggtagcgccagggtgatgag

SEQ ID NO: 89707 - DNA, 30 bp, Homo sapiens
  chr22:46931231-46931261
  hypo
cagaaaggtggaggccgtgtccaccaggcg

SEQ ID NO: 89708 - DNA, 409 bp, Homo sapiens
  chr22:46931719-46932128
  hypo
ccacctcgatgtacacggtggccgtggcactgagcgggcccggattgcgcccctggtcgttggcctccaccaggagctggtactcggccgcctcctcccggtccagcaccgcccgtgtgctcaccacgccagagctctcgttgagctggaagacgtcccacgcgccccccaacacgcggtaacgcaagttggcgttgatgggcgagtcgcggtcgctggcgcggatggtcagcacctcgtagcccacctccaggttctcccgcacgcgctcgcggtactccgactgctcgaagaccgggctgtggtcgttggtgtctttgaccaagacagtgatgtaggtggtggccgagcgcggcggcgtactgtagtccacggctttcaccctgaggacgtgcgtctccttggtctc

SEQ ID NO: 89709 - DNA, 277 bp, Homo sapiens
  chr22:46932725-46933002
  hyper
gcagccgggaaggtgcgtgcgcgcccgcaggcggcggctcagcgccgtcggggcactgcgggccaccaagcggacttgcagcggcagcgggcgccccgcgcccgagacgcgccgacgtcctgccagccgcccatcgcggcccacgtccagcagctcccgcggcgcccggggcgtgcaagcggcgcccaccgcgtaggtacagccgggccggagggcgaaggcgcgggtcccgccgggtacgcgcggctcccaggcggccgctcgcagccccatcgcc

SEQ ID NO: 89710 - DNA, 173 bp, Homo sapiens; identical to SEQ ID NO: 46782
  chr22:47005073-47005246
  hypo

SEQ ID NO: 89711 - DNA, 57 bp, Homo sapiens; identical to SEQ ID NO: 46783
  chr22:47005505-47005562
  hypo

SEQ ID NO: 89712 - DNA, 81 bp, Homo sapiens
  chr22:47022551-47022632
  hypo
tttggaaagctggaccggctgtgccctgtgtgtgggagctggctcgtggggcttggaggtggcgagcgggagagtgaccac

SEQ ID NO: 89713 - DNA, 69 bp, Homo sapiens
  chr22:47023112-47023181
  hypo
gtggcagacttctcacgcacatgtgacgcggaagcctcggcctggccctgggagcgttgacatgcggat

SEQ ID NO: 89714 - DNA, 89 bp, Homo sapiens
  chr22:47054535-47054624
  hypo
tcatggctctgatcccggcctgctggtgaccccattctgtacatccacccagtgccccaccccgggggccagcccggcctcttaggatc

SEQ ID NO: 89715 - DNA, 36 bp, Homo sapiens; identical to SEQ ID NO: 46785
  chr22:47193335-47193371
  hypo

SEQ ID NO: 89716 - DNA, 30 bp, Homo sapiens
  chr22:47298494-47298524
  hypo
cctgggacagagccccgctgtgtccgctaa

SEQ ID NO: 89717 - DNA, 30 bp, Homo sapiens
  chr22:47328152-47328182
  hypo
ctcccccaggttgcccgtcaaggccgtgct

SEQ ID NO: 89718 - DNA, 183 bp, Homo sapiens
  chr22:47428866-47429049
  hypo
ttcctctggggctgtcgctgtcgtcctggctgctcttccccaagtagccaactgctccttcatggaagctcattcttttttctgtgcaaaagagccttgttgagtaaatggagtcattttctaaacagctggttttaagtgttcagacttgaattccacgtgtcagtgcgctgggggcagcag

SEQ ID NO: 89719 - DNA, 78 bp, Homo sapiens
  chr22:47523374-47523452
  hypo
cttccccaagtgccgggatgacaggtgtgagccaccaccacgcccagcctggatttcttttgacgtgggcctcctagg

SEQ ID NO: 89720 - DNA, 219 bp, Homo sapiens; identical to SEQ ID NO: 46787
  chr22:47525705-47525924
  hypo

SEQ ID NO: 89721 - DNA, 66 bp, Homo sapiens
  chr22:47594807-47594873
  hypo
ctcaggggtctcacccgggcccaaaccgtggtcctcgcatggctggacccccgcccggtcttcctc

SEQ ID NO: 89722 - DNA, 143 bp, Homo sapiens
  chr22:47598585-47598728
  hypo
tacagctggctgctccgtatggcccaccactgccatcacaggcctccaggacagccacacagtgcaggcctctagaacagcattgcagtgcagctgtgatgagcagcgtgacagtagtgagatggtcccgggggtaggcgtcc

SEQ ID NO: 89723 - DNA, 158 bp, Homo sapiens
  chr22:47605408-47605566
  hypo
gcctgggcaggggcccgagcaggagcgaagcttatggggccgtcggtgtctgtgggatgagtgggctttgctgggcctgaacccaatgtcgtcagccagctgcacagctgctgtgggcacatgccgcccgggagggttggtgacgatgggtcctgtgg

SEQ ID NO: 89724 - DNA, 16 bp, Homo sapiens
  chr22:47622148-47622164
  hypo
gcggtttggatggctg

SEQ ID NO: 89725 - DNA, 39 bp, Homo sapiens
  chr22:47666772-47666811
  hypo
tgcaaagccagggtgcgaccagtccgtctggttccatgt

SEQ ID NO: 89726 - DNA, 100 bp, Homo sapiens
  chr22:47739194-47739294
  hypo
cctacccaatccctgcgctaccaatccctgttctactcaacctatgccctatccaattcctttcctaccggatccctgccctacccgatcccttccttac

SEQ ID NO: 89727 - DNA, 36 bp, Homo sapiens
  chr22:47840461-47840497
  hypo
ctctccctgcttccccgtgtgcgcctcactcccgcc

SEQ ID NO: 89728 - DNA, 110 bp, Homo sapiens
  chr22:48027676-48027786
  hypo
ggaggagtgtgtgtgcgcttgatgacgatgatggagcccagtgagccaccgtccgtggagtgtcagagcctcctaggatggccacgccgaaggtgcggaaggaggcggct

SEQ ID NO: 89729 - DNA, 30 bp, Homo sapiens
  chr22:48465028-48465058
  hypo
ggtgccttgaacaaccgaactttattctct

SEQ ID NO: 89730 - DNA, 173 bp, Homo sapiens
  chr22:48548955-48549128
  hypo
atggcgggggcgagccgggcagcctgtcgcagagccacagcttctggggaaggcttccctgagcctggtccctcatttgtgctggtgaaatgtcccattttgctgaagaggagacggacatggaagcctttgtctttagttcacgcttacaagtggcacggggacgtgccggg

SEQ ID NO: 89731 - DNA, 34 bp, Homo sapiens; identical to SEQ ID NO: 46790
  chr22:48553477-48553511
  hypo

SEQ ID NO: 89732 - DNA, 30 bp, Homo sapiens
  chr22:48631792-48631822
  hypo
ggagcacgtggaagtcggatgaggtgattt

SEQ ID NO: 89733 - DNA, 30 bp, Homo sapiens
  chr22:48657078-48657108
  hypo
cttcatcaccatcatcgccatcctcctcct

SEQ ID NO: 89734 - DNA, 67 bp, Homo sapiens
  chr22:48661092-48661159
  hypo
cacatccacaccccacgtggcaagagggagggaggcagtcacaggtggaagccggggccactccttt

SEQ ID NO: 89735 - DNA, 86 bp, Homo sapiens
  chr22:48728717-48728803
  hypo
ggctggggttgtcctcgttgtaccaagggtgccggagagggaaggtgggtgggccagtgctgcctcagagccggggacagggtctg

SEQ ID NO: 89736 - DNA, 30 bp, Homo sapiens
  chr22:48729299-48729329
  hypo
gctgctctgcaagggcgcaggagctcgggc

SEQ ID NO: 89737 - DNA, 30 bp, Homo sapiens; identical to SEQ ID NO: 46793
  chr22:48793754-48793784
  hypo

SEQ ID NO: 89738 - DNA, 30 bp, Homo sapiens
  chr22:48836877-48836907
  hypo
gggctaaattggagccgtgactccccagtg

SEQ ID NO: 89739 - DNA, 1 bp, Homo sapiens
  chr22:48884959-48884960
  hyper
c

SEQ ID NO: 89740 - DNA, 309 bp, Homo sapiens; identical to SEQ ID NO: 4918
  chr22:48885529-48885838
  hyper

SEQ ID NO: 89741 - DNA, 115 bp, Homo sapiens; identical to SEQ ID NO: 38608
  chr22:48885907-48886022
  hyper

SEQ ID NO: 89742 - DNA, 781 bp, Homo sapiens
  chr22:48886204-48886985
  hyper
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtgggtgcgccggcgcccctgggaactcactggctggccgcctgcagggagca

SEQ ID NO: 89743 - DNA, 175 bp, Homo sapiens
  chr22:48907729-48907904
  hypo
gcttgctgtggggaacggtgcgctcactcactcctcaccattgctaggctgaggccggtggccaaggttggagccccatggcacagagctgcagggagggccaccagaagctgatggccacggttcaggcggggatttggggaaagtgtcaaggggccctcgccacccgattccg

SEQ ID NO: 89744 - DNA, 98 bp, Homo sapiens
  chr22:48912088-48912186
  hypo
ttaactacatattaacggcttttcttaatactcttcctggtgatctcagcacaatccaccccctttgtgccatttaattcctgcgattcccattcccc

SEQ ID NO: 89745 - DNA, 198 bp, Homo sapiens
  chr22:48917385-48917583
  hypo
ttccaggatgggtgtcgtgcctgcgatgaatggtgtttattacaaatgtgagtttcggggagccatcccagccagccgcacgggagacggaggatgcgtggccacagatggacccgatccgttaggtgtaaaaggtaaatacggcgagaagtttccatcaccacctggaactgccccaatcttcgttgaatttgtcat

SEQ ID NO: 89746 - DNA, 37 bp, Homo sapiens
  chr22:48919191-48919228
  hypo
gccctcctgtgtggccggctcgcggcattccgctggg

SEQ ID NO: 89747 - DNA, 241 bp, Homo sapiens; identical to SEQ ID NO: 46795
  chr22:48931827-48932068
  hypo

SEQ ID NO: 89748 - DNA, 40 bp, Homo sapiens
  chr22:48939361-48939401
  hypo
aggacacctcaggcccgctgctgaccgcagtctggagagg

SEQ ID NO: 89749 - DNA, 30 bp, Homo sapiens
  chr22:48947525-48947555
  hypo
gtgcaggaggggagacgggggctaaggaaa

SEQ ID NO: 89750 - DNA, 94 bp, Homo sapiens
  chr22:48958660-48958754
  hypo
ctcccccaaaccacacggggccccacttgacagctcggagaccctctttcctctcacagccccgggaccccgggatgcccgtctgtgcggaggc

SEQ ID NO: 89751 - DNA, 82 bp, Homo sapiens; identical to SEQ ID NO: 38610
  chr22:48970842-48970924
  hyper

SEQ ID NO: 89752 - DNA, 148 bp, Homo sapiens; identical to SEQ ID NO: 1524
  chr22:48971532-48971680
  hyper

SEQ ID NO: 89753 - DNA, 201 bp, Homo sapiens; identical to SEQ ID NO: 1525
  chr22:48971758-48971959
  hyper

SEQ ID NO: 89754 - DNA, 176 bp, Homo sapiens; identical to SEQ ID NO: 1526
  chr22:48971960-48972136
  hyper

SEQ ID NO: 89755 - DNA, 247 bp, Homo sapiens
  chr22:48972219-48972466
  hyper
ggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtaattgtccccgggcgcgcggaccggtcctccgcgctctgcccggctcgcggcggctccggcgcccgacccggcttccagca

SEQ ID NO: 89756 - DNA, 106 bp, Homo sapiens; identical to SEQ ID NO: 46796
  chr22:48976157-48976263
  hypo

SEQ ID NO: 89757 - DNA, 144 bp, Homo sapiens; identical to SEQ ID NO: 46797
  chr22:48987212-48987356
  hypo

SEQ ID NO: 89758 - DNA, 72 bp, Homo sapiens
  chr22:48996677-48996749
  hypo
tcgcggcgaggcttgcggggcttgtgttcgaggtcggtagagcctgacactcggtcacggtgcccacgtcat

SEQ ID NO: 89759 - DNA, 30 bp, Homo sapiens
  chr22:48997695-48997725
  hypo
gttcctccacacagtcgcacaccattctgt

SEQ ID NO: 89760 - DNA, 152 bp, Homo sapiens
  chr22:49013333-49013485
  hypo
ctgcctcagtggccccggaagcgcctctcgcagaacctcggcactcactgtcctcactgtcgtcacctctcaggctgagtggcccatgaaagaaactggggatgcagcaggagagagaatggcagagtctgtctccgcgtctatctcctggg

SEQ ID NO: 89761 - DNA, 30 bp, Homo sapiens
  chr22:49039051-49039081
  hypo
cgtggctcgctgtggcgatctgttacgcag

SEQ ID NO: 89762 - DNA, 186 bp, Homo sapiens
  chr22:49048024-49048210
  hypo
acctgctctattgtacgcaagagactgggagtgcgccaaggtccctaagatgcggtgtctgtggccgagtcagcctgcatctaccagttggtgctcagcctggccaggggttggccccagggtggcagctggagaggctgtggctggccctgcctgccccgttcatcccttcggcaagtggtggtt

SEQ ID NO: 89763 - DNA, 52 bp, Homo sapiens
  chr22:49063305-49063357
  hypo
agtgaacgtcttccacgtgagtgcccctcccgccttccgtgccacactcccc

SEQ ID NO: 89764 - DNA, 30 bp, Homo sapiens
  chr22:49070079-49070109
  hypo
gcctccggcattgctcgcccccacctgccc

SEQ ID NO: 89765 - DNA, 194 bp, Homo sapiens
  chr22:49115630-49115824
  hypo
gtgtgtaaacaaaaacgtatatggccggcgccacatcagctagtattgtaagcagtgacactcttcattttctcagcagaaatgagcccagaaacaaaaaaaaattggtttgaccaaacccacattatttctgtctgcactttgggccacttttgtaatgggagacgtgacacgctgggcgccatttacagtaa

SEQ ID NO: 89766 - DNA, 84 bp, Homo sapiens
  chr22:49117075-49117159
  hypo
ctgggccactgcccccgtgccaccatttcagcccgcccactgccttcatgccacccactgccttcgtcccgcccgctgcgtgtg

SEQ ID NO: 89767 - DNA, 146 bp, Homo sapiens
  chr22:49132497-49132643
  hypo
aacacggatgaacctcggaaacatgacgccgagtgaaggaagccagtcaccgaagtctgccctgttggagcccagtgatgtgaaacttccggaacaggcaaggtcacagaggccgaatgaaggcccgtggccgccagggtccagga

SEQ ID NO: 89768 - DNA, 30 bp, Homo sapiens; identical to SEQ ID NO: 46801
  chr22:49138471-49138501
  hypo

SEQ ID NO: 89769 - DNA, 30 bp, Homo sapiens
  chr22:49139651-49139681
  hypo
gataaacagatgatccgtccgcacattcct

SEQ ID NO: 89770 - DNA, 210 bp, Homo sapiens
  chr22:49145839-49146049
  hypo
ccgacccgaggaggccggactcagacacataggcggggggcggcacctggcatcagcaatacgcagtctgtgggagcccggccgcgcccagcccccgccgaccgtggcgttggccctgctgtcctcagaggaggaggaggaggaggcagctccggcagccacagaaggctgcagcccagcccgcctgagacacgacgcctgccccagggg

SEQ ID NO: 89771 - DNA, 243 bp, Homo sapiens
  chr22:49147007-49147250
  hypo
atttcctgcccctttcgccactcacggaccttgaggccagttgacggcccttctccccacgcctgtgtccccgcgttctgagaagtcctctgtcttcgtgtcactaggtccagaaagtcgcgccgggcagaggcgcaggcggggccggcagggccgaggaataagcgacaattctggtttttctcccctggccgtcgttcgccagcctccttcattttcctgagttcccgctgaagtatatac

SEQ ID NO: 89772 - DNA, 73 bp, Homo sapiens
  chr22:49149757-49149830
  hypo
tgacctgggacacatcgcttctctgagcctcagctgctagatcacaaagtggagaccccgcaagcctctgccc

SEQ ID NO: 89773 - DNA, 30 bp, Homo sapiens
  chr22:49153919-49153949
  hypo
tccagctggcagctccggccatggctgcct

SEQ ID NO: 89774 - DNA, 16 bp, Homo sapiens
  chr22:49170462-49170478
  hypo
gcgtttttatagagct

SEQ ID NO: 89775 - DNA, 30 bp, Homo sapiens
  chr22:49175177-49175207
  hypo
ctggccctgctggcacgcacagcgtggctg

SEQ ID NO: 89776 - DNA, 30 bp, Homo sapiens
  chr22:49177385-49177415
  hypo
tgggggttaggaccccgacccacctgccca

SEQ ID NO: 89777 - DNA, 30 bp, Homo sapiens
  chr22:49195092-49195122
  hypo
gttgtttaacaaaaccgtgcagtaggaact

SEQ ID NO: 89778 - DNA, 63 bp, Homo sapiens
  chr22:49198381-49198444
  hypo
atcgggcagtcactgcgtgctccctctgtgcccacacgcgtcacgtttcgaggcagcctccat

SEQ ID NO: 89779 - DNA, 30 bp, Homo sapiens
  chr22:49233404-49233434
  hypo
acatgcacactcccacgtgtcctcacacac

SEQ ID NO: 89780 - DNA, 102 bp, Homo sapiens
  chr22:49247239-49247341
  hypo
tctgtgcagccatctcgcgtggccaccgtgaagtatggacaagcccaggggagggtttagttgatgggactccatgcagctctcatgcgtggccaccgtgaa

SEQ ID NO: 89781 - DNA, 30 bp, Homo sapiens
  chr22:49257599-49257629
  hypo
ctccatgtgccactgcgttactgatgttga

SEQ ID NO: 89782 - DNA, 78 bp, Homo sapiens
  chr22:49277436-49277514
  hypo
cctcctcctgcctcacgcaccacacaacccacatgcagacacacacaccacacaacctgggcacgacccataggcacc

SEQ ID NO: 89783 - DNA, 30 bp, Homo sapiens
  chr22:49282479-49282509
  hypo
gggagaagcctcagtcgccaggagctagtg

SEQ ID NO: 89784 - DNA, 30 bp, Homo sapiens
  chr22:49295585-49295615
  hypo
cctgcccaggagtggcggctccatccgtcc

SEQ ID NO: 89785 - DNA, 30 bp, Homo sapiens
  chr22:49297953-49297983
  hypo
gcagcaggcctgacccgcagctccgtgtca

SEQ ID NO: 89786 - DNA, 52 bp, Homo sapiens
  chr22:49340964-49341016
  hypo
gcaggacccagctggcggctgggaggcctcacacacgcgcctccatgcaccc

SEQ ID NO: 89787 - DNA, 87 bp, Homo sapiens
  chr22:49387604-49387691
  hypo
caacggctcttctttctccacagccactccagcattcattatttttgtctttctgatcatctcggttccaatcgaggtgagatggtg

SEQ ID NO: 89788 - DNA, 150 bp, Homo sapiens
  chr22:49388460-49388610
  hypo
ctgatctcgtagaagtagagagaagaatggtggttatcagaggctgggaaagggaggggcggggaggttgtcaatgggcacaaagtcacagtcaggagggataaatcctgccattctgtagcaaggtaaggcgaccgcagtgaaaaatat

SEQ ID NO: 89789 - DNA, 155 bp, Homo sapiens
  chr22:49404122-49404277
  hypo
cgatatttccacggacggaagtaggggggatgatggttctgggatgaagctgttccacctcagactcagaacgtcagatacgcaaaaggagtgcacaacttagatcctttttactttattcattctttttgagatggagttttgcttttgtggtc

SEQ ID NO: 89790 - DNA, 191 bp, Homo sapiens
  chr22:49416905-49417096
  hypo
atgccttgtgcacagcggcagccgtgaggaaccttctccttcccacttgccactgctagcatggagcacagggccccccacagcccgctgctctctgccccctctgcagggccaccatggaggcgaggtctctgtgaagctggtcactgcattgcaggtccccggcagccacacaacgaacatcggctgga

SEQ ID NO: 89791 - DNA, 84 bp, Homo sapiens
  chr22:49447288-49447372
  hypo
tcaatttttacttttcggattgtgtataagaaactctttctgttcttaggtcgtaaagaccgtctccatcgcttcttccgttcg

SEQ ID NO: 89792 - DNA, 98 bp, Homo sapiens
  chr22:49491699-49491797
  hypo
acactcacacagacgcgtgaacgcactcacatacacaaaagcacacacaggcatgcacgcatacatgcatacattcacacacacgcaggtgcacactc

SEQ ID NO: 89793 - DNA, 134 bp, Homo sapiens
  chr22:49508009-49508143
  hypo
gactatacccggccacgggaggaggatggcgagtcgcgcttgcaaatgtttgctcacccggcacgtgtcacgagtgtgcgctccgcgcccatcacctttccaggcgctgaggatccggtcgtgaacaaacccac

SEQ ID NO: 89794 - DNA, 30 bp, Homo sapiens; identical to SEQ ID NO: 46810
  chr22:49510169-49510199
  hypo

SEQ ID NO: 89795 - DNA, 36 bp, Homo sapiens
  chr22:49524652-49524688
  hypo
agtcgttgtctgtatcgatatcgcacctgtcattcc

SEQ ID NO: 89796 - DNA, 30 bp, Homo sapiens
  chr22:49557840-49557870
  hypo
tcatgagaaaaccatcgcactagttttaat

SEQ ID NO: 89797 - DNA, 30 bp, Homo sapiens
  chr22:49578631-49578661
  hypo
gacagggcaggcgaccgagagggttctcca

SEQ ID NO: 89798 - DNA, 30 bp, Homo sapiens
  chr22:49584808-49584838
  hypo
ttctaaggatgctgacggggctgccgtggc

SEQ ID NO: 89799 - DNA, 30 bp, Homo sapiens
  chr22:49632704-49632734
  hypo
agggttgagggcccacgccatctctgtcca

SEQ ID NO: 89800 - DNA, 253 bp, Homo sapiens; identical to SEQ ID NO: 46811
  chr22:49637528-49637781
  hypo

SEQ ID NO: 89801 - DNA, 39 bp, Homo sapiens
  chr22:49683091-49683130
  hypo
attgaagttccggcccggcgctgtgactcacacctgtaa

SEQ ID NO: 89802 - DNA, 203 bp, Homo sapiens
  chr22:49691277-49691480
  hypo
cacctgcaattcactcgagctgtgcctggcagggaaagagcactctgtgaacagccctcaggctctctgcctccaccttgcccagctctagggctgtggagtcaggtgggcattctcctccagccaggttccctccctgaatgacgtcagcaagccccagcacgctcctcttccaattcccactgagccgcacccctccccat

SEQ ID NO: 89803 - DNA, 153 bp, Homo sapiens
  chr22:49694454-49694607
  hypo
gttcgtgccactcaccggggaaggtgtcggcttcaccctgtccactccacaggcaagcctggaagtaatattttgctggtcacctgggcaccgtgtggctctgtcacagtgatggcgaagtcacagaattcaccatctcggggacacacctgg

SEQ ID NO: 89804 - DNA, 182 bp, Homo sapiens
  chr22:49694859-49695041
  hypo
agcttctccaccgcccgcagcagcttctccacccgcagcagcttctccaccgcccgcagcagcttctccacccgcagcagcttatccaccgcccgcagcagcttctccaccacccgcagcagcttctccaccgcccgcagctcctcacgcaggcctccagggcattccgaggcctctgcagg

SEQ ID NO: 89805 - DNA, 30 bp, Homo sapiens
  chr22:49704081-49704111
  hypo
ctgcagcgggcaaggcgcagaaggtctcag

SEQ ID NO: 89806 - DNA, 37 bp, Homo sapiens
  chr22:49722594-49722631
  hypo
cggagaaacaagaaccgaactgcgttcccccaaattc

SEQ ID NO: 89807 - DNA, 30 bp, Homo sapiens
  chr22:49729017-49729047
  hypo
gaacaaagcaccatacgctgggggattata

SEQ ID NO: 89808 - DNA, 30 bp, Homo sapiens
  chr22:49745207-49745237
  hypo
aggggacacccgtgccgtcctcggaaactg

SEQ ID NO: 89809 - DNA, 32 bp, Homo sapiens
  chr22:49748891-49748923
  hypo
ggccctggcctctgccgcggctctgccaggca

SEQ ID NO: 89810 - DNA, 57 bp, Homo sapiens
  chr22:49785322-49785379
  hypo
tagccagggtttgcccgcggacgccgcccagccctccctccacggtgccctgcacac

SEQ ID NO: 89811 - DNA, 115 bp, Homo sapiens
  chr22:49814611-49814726
  hypo
agcaggaggtgcatccgaacgaatttcctaaaatgcatcaagcagagagaatgagatggaaaatctgaaagcagaaagcataagagcttgccaggtggagcgcacatctgttcag

SEQ ID NO: 89812 - DNA, 30 bp, Homo sapiens
  chr22:49827331-49827361
  hypo
tctccacaggtgtcccgcacctggggtctt

SEQ ID NO: 89813 - DNA, 87 bp, Homo sapiens
  chr22:49828938-49829025
  hypo
ggaaacagacacaggcgagtgaactggattttctgagtcaggagaggcctttcctcctcgttctgggggcaccgattacaattccct

SEQ ID NO: 89814 - DNA, 122 bp, Homo sapiens
  chr22:49831405-49831527
  hypo
gcgacacggtcttctcgtacgcgtgaggagccagtggaggaactcagatggccaaccccacacctgcagcaggtgcggaggtggaaggcaggaaagaaaaggactcccgcagccctccattc

SEQ ID NO: 89815 - DNA, 138 bp, Homo sapiens
  chr22:49831849-49831987
  hypo
aggctttcagggaagcgcctcagcgcccggctcaaatcaccctggacagcagcctcagaaaggagttggccccatttttcttcttagtctttgcattgtctggaatttggagccggtgacatacgctgaagtctctct

SEQ ID NO: 89816 - DNA, 30 bp, Homo sapiens
  chr22:49832454-49832484
  hypo
ctgaaaccactgtcacgtggggatgtctgt

SEQ ID NO: 89817 - DNA, 30 bp, Homo sapiens
  chr22:49833286-49833316
  hypo
tcctgaaacacaggacgcatggaagaacca

SEQ ID NO: 89818 - DNA, 96 bp, Homo sapiens
  chr22:49836808-49836904
  hypo
accccctaccaagaccgacaggaatacaaagacaacaggtaccagttaccaaacccagaaatgaagagtgggcaaccacacagcctaaagacataa

SEQ ID NO: 89819 - DNA, 30 bp, Homo sapiens
  chr22:49849362-49849392
  hypo
tgtggcacatgtgcacgtctgtgtgcgttc

SEQ ID NO: 89820 - DNA, 180 bp, Homo sapiens
  chr22:49851733-49851913
  hypo
cttgggaaccacccacggctgtgcgtcccttaacaaaggaaaacagtctcccgaccactggccacatctgcttggcccttggtaatcgccgaggcctggccaggatgggggccacagggcacaaggcagaagggggcaggtgcaggagagtcagcgtcgtgagtgcgagtgatgtgtgtc

SEQ ID NO: 89821 - DNA, 274 bp, Homo sapiens
  chr22:49852443-49852717
  hypo
aacccccagcccctgcggggtgtccatcccgcccttacaaatggacggaccaacccgggcgctgacatcactctgcatttgagggatgcaggtgcagcgtggggcacgggacgaccctggccagggcacctggtcagccctacactccctgaccccaggctgactgtccgcggtgggagagcacttgaacgctccttccaccctggctttgtgtgctcacgtgccagctgttcaggacaggtaacgccgtgtttctggacggcatgaagttctt

SEQ ID NO: 89822 - DNA, 30 bp, Homo sapiens
  chr22:49863553-49863583
  hypo
accctcgggtggtggcgaagagggaggggg

SEQ ID NO: 89823 - DNA, 57 bp, Homo sapiens
  chr22:49864413-49864470
  hypo
cgggatggtggaggccgagcccaggtcccaccccgtccatcacgggtgtccgcgccg

SEQ ID NO: 89824 - DNA, 149 bp, Homo sapiens; identical to SEQ ID NO: 46819
  chr22:49864707-49864856
  hypo

SEQ ID NO: 89825 - DNA, 112 bp, Homo sapiens
  chr22:49868073-49868185
  hypo
attcactgttacagccgcggttcctaacagagcacctcatataaaatgaacatgctgtaaacacttgtggaaagagtgactccacgaagcaagcgtacgaatacaagctcac

SEQ ID NO: 89826 - DNA, 39 bp, Homo sapiens; identical to SEQ ID NO: 46821
  chr22:49888284-49888323
  hypo

SEQ ID NO: 89827 - DNA, 80 bp, Homo sapiens
  chr22:49911506-49911586
  hypo
tctctgtataaccttcgcggccactgcccccgtgcctgcagagcgggtttgcaggagacgtcatccgaatggataaatgt

SEQ ID NO: 89828 - DNA, 667 bp, Homo sapiens
  chr22:49934713-49935380
  hypo
ccggccgcttcctcccggctccttagccccgaacccggcctcgctcctcagctgcgcacttggggagcgaatgcgcagtccctgggcggctgcagtccacccaggtcacaggctgacgcgcgattcttaggggtgagaagggggtgactggggcagcggagaaagcggagacagagacagggtgtgcccagggcgcgggcaccgggaggtccagcctgcgaggcacgtggcctgcccagctgcggacgggcgcggccccaccacagcccacagccaagtccgcctcacctgcagctcccgcgcggagcagccagatccatggcggccctgggggtgtggagtggagagcaggccgctgcctcccgagggccccgggcggtgagtacgcacccacggagccctcgggggcaatcaccgcagcctcctccttgtcctctccgcgggctcccggcccagcccctaaggccgccaagcctgaggcctggctgcccagcgaggggagggcggctcctgggcaccttcttcccgtcgtccctcgcggctgcacgcgacgactctagccccacccccttcccaccatcttttctgctcgcgctgggacttccgctcagggcctcagacgccgggacctgctgttcacgccggggcgggccgctggctgtgtccg

SEQ ID NO: 89829 - DNA, 184 bp, Homo sapiens
  chr22:49937697-49937881
  hypo
cgctgcaccgagctgcgaggttggcttcccctgaggcactggctgtgtggatagctaaacaaagtcaggatccgttggaaaggagggtgcgggaatggaaactcagtgggagggtaaccagcagcgtccacctgtatgaacctttattgggagcttttgtttaatcccacgtgagcaaaatcac

SEQ ID NO: 89830 - DNA, 69 bp, Homo sapiens
  chr22:49941794-49941863
  hypo
ccagacaagtcccgccgctgtcagcgcacctctgcattgggcactcccttctgtcggcagagtcgtgct

SEQ ID NO: 89831 - DNA, 196 bp, Homo sapiens
  chr22:49943168-49943364
  hypo
tgcctgatgcagagtcgggggcggcttcctgcagaccgggcttccttggcccattccccctctccctttttcaaatctcagaactccagagcggtgctctcctccaaaaagagggctgctccccttaaggcactcgctctgactttgccatcctccagctgacctgagtgagctcagcagccggagttcgtgtggc

SEQ ID NO: 89832 - DNA, 42 bp, Homo sapiens
  chr22:49948578-49948620
  hypo
ccttctctccagccccgggtgcacccacggtgatcagggacc

SEQ ID NO: 89833 - DNA, 109 bp, Homo sapiens
  chr22:49959096-49959205
  hypo
ccctgggctgagaagcgtctctgagctgatgcacatgctggcagggggagcaaagccagtccagtagggaacaggcatactcttcactgcttctcggagtgggatccat

SEQ ID NO: 89834 - DNA, 130 bp, Homo sapiens
  chr22:49963301-49963431
  hypo
ggcaggggaaggaagcgtctccagggcactccctgctcataagtgttttcacctgatggggtcaggcccacccaggacgatctgccaggactgcaggctggaggtttctgacgcgcgggaacagcgtgaa

SEQ ID NO: 89835 - DNA, 43 bp, Homo sapiens
  chr22:49963875-49963918
  hypo
aagggacccctcactcgtgcagcctctccgagcacccctgact

SEQ ID NO: 89836 - DNA, 198 bp, Homo sapiens
  chr22:49967979-49968177
  hypo
ggagcaaggggagcacgggagcctcggggcctgcggggggccaggcagcagctgccctcacagttgcacggtacagtttgcagaacacaccctcctgccctgtggaagcttccaggctcccgggcaggtcgctgaaggatcctcttcctggcccctggagtccacaggtgcgacatcccgtcccgacatgggtgcctg

SEQ ID NO: 89837 - DNA, 145 bp, Homo sapiens
  chr22:49970518-49970663
  hypo
accagctgatgacaacgtgtttccccctgtggctgcagccactcctgtcccatgggcagcgcagagctgtcctccttgctgagtgtccgccgggcctacagtgggacgatgtttcctcgcaggctgaccccgcactgccctggtc

SEQ ID NO: 89838 - DNA, 189 bp, Homo sapiens
  chr22:49977647-49977836
  hypo
gccaggtggaggctccgggcagctgcgtcagggccccacatggccgctttgccctggggaagtcacctgttctctgtgcctcgatttccacataaggaaaacaggagtcacagtaatgacgatcatgtttatccatatcatatcacaactcagaggaaccgcaggggtgtcacgcgttaatgtgggtga

SEQ ID NO: 89839 - DNA, 144 bp, Homo sapiens
  chr22:49979613-49979757
  hypo
accccatccctgggccggggctgaccggtcatcagcgaaagcaccctccgtgctgtgagtcccaggggtgctggcgggcactggagagaaaagaaacctcgctggactggagacaaagaaccttccctgcgcctccctgggctg

SEQ ID NO: 89840 - DNA, 461 bp, Homo sapiens
  chr22:49980160-49980621
  hypo
agcacagagtcactgcgaggcggcgtgagtctgtgtgacatcagcgtgtttagtgcatgacatcagcatgtttagcacagagtcactgggagacagtgtgagtctgtgtgacatcagcgtgcttagtgtatgacatcagcgtgtttagtgcatgacatcagcgtgcttggcacagagtcactggaaggtggcatgagtctgcgtgacgtcagcatgtttgcactcagaaaggttctctcggtgtttgtgctgctctgtgtgatctgctgattggttaatgtgaacaggatgtgcctgaatgctgcaggggcagcaaggtgagccctgggctctgtcctctctgctaatgggagacctgaggaggaagcacccactccagccagaggcaacactcactggcccggggacgcgggcagggccagaaatgcaggtgcacccactgctctcgtgggccccaggtt

SEQ ID NO: 89841 - DNA, 123 bp, Homo sapiens
  chr22:49982542-49982665
  hypo
agcatctgcttccttcgcaacccatgggttcagtccaagcaacacacacagccgacaagacccggttcccgtgtgcggacagaactcctccaagaccaagtccctccccgggtcaacacgccc

SEQ ID NO: 89842 - DNA, 179 bp, Homo sapiens
  chr22:49982979-49983158
  hypo
ctgtgagctccccctcgtcggggctcagtggcagagccccggtttctgccgcaaacacctctcactgccctccacacaacacatagctccctcctcctcctcacagagtgcctcacacagggcctacccagcggaggaaagagagtctcagctgccccggagcccgttcctcaccaaga

SEQ ID NO: 89843 - DNA, 205 bp, Homo sapiens
  chr22:49983668-49983873
  hypo
cggcagtgctggggccgggaattctccctgtgggctctgccctccggcgtgaccagtgcatgtgtctgtgctggaggtcggggcccttgagatgagacactgaatgctccctgctctgcccggctcccggcggcaggtggagcgtccagcgcacacagggtctgcacagccaggcgtttcttccccacctcgcatctctcctggg

SEQ ID NO: 89844 - DNA, 149 bp, Homo sapiens
  chr22:49992130-49992279
  hypo
aaaggtgggaaccctcggcgctgcatctttcacttgctctagaaaacacccagccatggccccgcaggctccccatgtcactgggtcccacatggaatgcagattcgaggcccaggaagcactctgtctgcccccgcacaaatcttcct

SEQ ID NO: 89845 - DNA, 44 bp, Homo sapiens
  chr22:49992716-49992760
  hypo
cagcatgagtaatgacgacggcccctccacggccgatctggcgc

SEQ ID NO: 89846 - DNA, 112 bp, Homo sapiens
  chr22:49994187-49994299
  hypo
gggattccgaggctccgagggaaggacacgaggccccagccaggctgttgtgttggggtgaagagcgggcggcctcacacaggccctggggccgcagcgtccacagccccgc

SEQ ID NO: 89847 - DNA, 30 bp, Homo sapiens; identical to SEQ ID NO: 46839
  chr22:49996899-49996929
  hypo

SEQ ID NO: 89848 - DNA, 30 bp, Homo sapiens; identical to SEQ ID NO: 46840
  chr22:50000658-50000688
  hypo

SEQ ID NO: 89849 - DNA, 196 bp, Homo sapiens
  chr22:50001634-50001830
  hypo
tacaggagacatgatcgtgattattgttaccatgattaatgtcgtgcgcaggcctctcctgggtgccggggattcagctgcgatgaacaggacaaagtccagatctcatgggaccggcatgggggtgatctcagggaggacaacagagaaaatggaagccaagaaccgggaacagggattccgacagatctgggtt

SEQ ID NO: 89850 - DNA, 357 bp, Homo sapiens
  chr22:50002462-50002819
  hypo
ccttaagtgaccaggcgtccagatggagccgagggtgctggtctgcccggcgcccacacatgctccagttagaggacaaggcgcaagctcccccgatgacacgggaagctggagacattctcgtgttcacggtcacagctctgctcctttgagaaataagcggcacgatgtttttctagtgggtttgcctttttctcagtgatggtaaaagtgctgtgtatgttaaggtgagtgactcaggaccaaggtgagtcttgactcctcttggctttgcgctgagagcacctgggagagtcaagggagcacacaggacagtccctgcttcggctccccaggaacacgcggccaagtgcacgc

SEQ ID NO: 89851 - DNA, 225 bp, Homo sapiens
  chr22:50003057-50003282
  hypo
tgggaagatggaccccgcgcctttcctgggaagagaagagtgtgttttacacacgtgctcccgccaggggagagcagaggggaggcaagccaggcacaaagctggcacgtgggatgagtgaatcagacacagctgcatttgtgttctcggttcctccaaacacgagacgcttggaacagggtctctgaggggtggacacaaaacagggaccgcagtctgtgcctc

SEQ ID NO: 89852 - DNA, 176 bp, Homo sapiens; identical to SEQ ID NO: 46844
  chr22:50007867-50008043
  hypo

SEQ ID NO: 89853 - DNA, 226 bp, Homo sapiens
  chr22:50008747-50008973
  hypo
gatgcaggccccctccggcgctgcgctccacaatttgaacataatccaggctgatggaggtggtttaagacaggaaaccacaccccagggctgcgggatgcaggcgagaacgggagccccttccccacaggctgcgtcctgcaaggtccacggagctctttcctctcccccctgcagtgacctatacacagagacaccatcttcatggacacggacatgacacgcg

SEQ ID NO: 89854 - DNA, 147 bp, Homo sapiens
  chr22:50009183-50009330
  hypo
tcccacccggctgcccgagacacctcccctcaagattcaccaaacaccacgacgtgcaaagaagaaagtccacgcctccgcggaaaacactgcggctcggcaggtcaatccaaacctggaaacacctcggcgcggcctgtcagtctg

SEQ ID NO: 89855 - DNA, 44 bp, Homo sapiens
  chr22:50009619-50009663
  hypo
gaaaatataccagggcggaggggaatacacggaaaatataccag

SEQ ID NO: 89856 - DNA, 717 bp, Homo sapiens
  chr22:50010081-50010798
  hypo
ggggagcagggaggccgggcacggcccccactggcttcagagctcctcgcagcctgcgccagcgcagagcaggacgggaaacagccccgggagcagaaggtcccagcagcggaattcccctccacttggaccaggcctgcgggagatccgggcactgacaggcggggacattttagaatcttttcaagaaaagataaagaaagaaacaagagtaacaggaggccagaagcaagggcatctactgcagacagcggtgccgcggggctggagctgaagctacccaaggagccccaggctcgggagcctccaggcacaggcgccgtcgggagcctccaggcacaggcagcgtcgggagccaccaggcagaggcagtgttgggagcctccaggcacaggcggcgtcgggagcctccaggcagagacagcgtcgggtggcagggagcccctcagactgtccctgtcccagtggtctccagcccccgactgcactcgactctgcggttctcacccctctgccatcccagaggaaggggcatccctgcgactttccatccactaccctggcctggaccactcaactccagggacttcctccaccacccagacgcctccctgagcccaacccggttgtccctacccataactgacatcagggcaccttccaggccccgaagttgtctctgaggccccagcttcaacacgtcgctggctggtgtgg

SEQ ID NO: 89857 - DNA, 46 bp, Homo sapiens; identical to SEQ ID NO: 46848
  chr22:50013222-50013268
  hypo

SEQ ID NO: 89858 - DNA, 179 bp, Homo sapiens
  chr22:50015584-50015763
  hypo
ccacagggcagacgccgtgcacaccagacctgctgggccacagccaggcccgggtggtgaaggacggggacccaggcctcaggatggggaaggtggtggaggccctgctctgagccttctaagctggaggccccggcttaggggccatgcatggtcccacctttcgggtaacacctccc

SEQ ID NO: 89859 - DNA, 176 bp, Homo sapiens
  chr22:50015975-50016151
  hypo
gccctgagaagtgaccgtgctggtaggcgtggtgtaaggctggacactgccggctgacctgctcccgggggcccaggagaccctgcactggccactgggaagagtgggcagcagcagcctccctggaagctggggtggccgggcggtgtgggcagggctggcggccagacaccatc

SEQ ID NO: 89860 - DNA, 173 bp, Homo sapiens
  chr22:50023940-50024113
  hypo
gcggctctgagctcccgggaaagtggccggggcctgggccctgttcccaggaagctcagcaaggctccgtgccccacaacctggaggggtgggaggggagtctgggttgggatggctgcacccttggcccttggggaggagccccccactaccacccccggcaagaccagaaa

SEQ ID NO: 89861 - DNA, 30 bp, Homo sapiens; identical to SEQ ID NO: 46851
  chr22:50025118-50025148
  hypo

SEQ ID NO: 89862 - DNA, 177 bp, Homo sapiens
  chr22:50025502-50025679
  hypo
gtgtttcaggacacacggaatgcaggtatttcggggcacacgcgtgtgtttcagggcacgccgggtgcaggtgttttggggcacacacgtatttcaggacacacagcgtgcaggtgttttggggcacacgcatgtttcggggcacgccgggtgcaggtgtttcggggcacacgtgtt

SEQ ID NO: 89863 - DNA, 37 bp, Homo sapiens
  chr22:50030437-50030474
  hypo
ccagaatcctgccctcggtgaccgccctctcgcccca

SEQ ID NO: 89864 - DNA, 130 bp, Homo sapiens
  chr22:50031124-50031254
  hypo
ccttccctgagcacccgccctgccccgggtgaggccaggcctggacgccttctcgctgcaggccctcggagatgtttcccagcactgacggtgctgaggacagaacgctggaggccgggccacactcagg

SEQ ID NO: 89865 - DNA, 213 bp, Homo sapiens
  chr22:50031666-50031879
  hypo
agaaacggaggcccacgggagtcaggaacaagccccaggtcgcacaagaaatgcaaaggaagccacatggctccagagtccaggctccgagacccacccgctgcctgctgggcagctgccccgggaaccctgtctgggcacctggattttccagccacggattttccccgctgacagctctcgccgtttcctgggtctcgagtttatcctctg

SEQ ID NO: 89866 - DNA, 198 bp, Homo sapiens
  chr22:50032291-50032489
  hypo
agagcctgctccagccggcggagtggttctctcggctctgtggataactgaaagctcagaaacatcaaaagttaattaaaataagaatatgttactctgaaataatgcattaaaaacgtccaaaggtgagcctgctccacttcattcccctccgcatctcccgagcacggctcttcgggcggacggagcccccagcag

SEQ ID NO: 89867 - DNA, 52 bp, Homo sapiens
  chr22:50039630-50039682
  hypo
acaaaaataaaccagcggtccacaggaaataaaccagcggtgccaggatgtc

SEQ ID NO: 89868 - DNA, 35 bp, Homo sapiens
  chr22:50041968-50042003
  hypo
cactgttaccgtggccgagccgcagcctggatgca

SEQ ID NO: 89869 - DNA, 248 bp, Homo sapiens
  chr22:50054387-50054635
  hypo
atcttccagcaagaacgcaataaacaagactgagagcctcattaggagcctgtgagccccacatcaccagacgcgctgcagctccccgtgatgaccgctcctcctccgagccccgcacacggcgcgggttacatggaaaaggcaccgcagctccccgtgacgtcctctcctcctcggagccccgcacacggcgcgggttacatggaaaaggcactgcagctccccatgacgatcgctcctcctctgag

SEQ ID NO: 89870 - DNA, 201 bp, Homo sapiens
  chr22:50056957-50057158
  hypo
agggcagacaatgtccgttttcactttcaagatcagccggtagacaacgcagaaaggccacctgccgtcggtgtccatgacagctggcttcaccgtgaaagtgccagccgggcgttcagaggggaggcactcagcagagaccccaggatctaaggcccatgttggacgagcaggacgtgatgggatcgggctgtggagggg

SEQ ID NO: 89871 - DNA, 30 bp, Homo sapiens
  chr22:50075250-50075280
  hypo
agcatcagtcattcacgatgaagtataatg

SEQ ID NO: 89872 - DNA, 30 bp, Homo sapiens
  chr22:50084890-50084920
  hypo
ctggcccagcaggaccggtgtcctcctaag

SEQ ID NO: 89873 - DNA, 60 bp, Homo sapiens; identical to SEQ ID NO: 46858
  chr22:50119416-50119476
  hypo

SEQ ID NO: 89874 - DNA, 46 bp, Homo sapiens
  chr22:50147751-50147797
  hypo
ccccaagggctctctcgggccagggccgctgcgctcagcctcctcc

SEQ ID NO: 89875 - DNA, 204 bp, Homo sapiens
  chr22:50149266-50149470
  hypo
ccctttccatggcaacgccccataaggtgccacccctttccatggcaacgccccataaggtgccacccctttccatggcaacgacccataaggtgccacccctttccatggcaacgccccatacggtgccacccctttccatggcaacgccccatacggtgccacccctttacatggcaacgccccatacggtgccatcccttt

SEQ ID NO: 89876 - DNA, 207 bp, Homo sapiens
  chr22:50170583-50170790
  hypo
ccatgctccctgagccggagtccagtccccagcagtcgagccctaagacgctaaccaggaggtgtggagagccatggaggcaggtccgggcgactcaccggctgcgatcctggccgccttggcgtagttcccattctcgatgcaggagatcagctcactgcggtcctccagcgtgtgccgtcgcacaagagccggtttgccccgccc

SEQ ID NO: 89877 - DNA, 51 bp, Homo sapiens
  chr22:50177248-50177299
  hypo
gctcccagtcggtgccgggctctcctctgcgtccttcgtgactgtccagag

SEQ ID NO: 89878 - DNA, 45 bp, Homo sapiens
  chr22:50191581-50191626
  hypo
cgcgcagcctcaccgcggctctatagaacacggtgtccctggcat

SEQ ID NO: 89879 - DNA, 86 bp, Homo sapiens
  chr22:50225678-50225764
  hypo
gtgcatacccattcccggctgtagggttaagtcaatttgtattcctaggtgcattccgtgcctgggtgtgtgcctaagaaacctgt

SEQ ID NO: 89880 - DNA, 218 bp, Homo sapiens
  chr22:50242294-50242512
  hyper
ggggaaacagaggcacggtggatccggcggcggggctgggtctggggctggacgttgacctaggaccccgcccctgcccgccctgcgccgcgcccctcccgggccggccttgaccgagcagctccacgcgggcccggggctcgtccacccgacaggagcggggggctgcagcccacgagcccacgagcccgcagcgacgcacccggagtgtaacctcg

SEQ ID NO: 89881 - DNA, 811 bp, Homo sapiens
  chr22:50242712-50243523
  hyper
tcctggggaggtgcccggtgtggggtgtttctggttcgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtggg

SEQ ID NO: 89882 - DNA, 48 bp, Homo sapiens
  chr22:50243630-50243678
  hyper
cgcgacctggccccagaagacagtctgagaggccggtggccgcggatc

SEQ ID NO: 89883 - DNA, 89 bp, Homo sapiens
  chr22:50251106-50251195
  hypo
tgctctggaaggtgccgtttccaagacgcccttacctgggttcctgagcacgtctgacagagcagctctgactccgggtttctggagtc

SEQ ID NO: 89884 - DNA, 218 bp, Homo sapiens
  chr22:50294626-50294844
  hypo
agaggcccaagaggacgccctgccatgcctggtcatgaggaggtgctcgaaggagaggcacggcacacaggcagagcatggcagggttcccgccagcaaatctcgtacactttgaacaccaggataattaaagacaggagtgactcacagaccactgaagtcgggaggcaatccacatgtggccagcgataaaagagaacaaacgagcgtggataacc

SEQ ID NO: 89885 - DNA, 30 bp, Homo sapiens
  chr22:50297116-50297146
  hypo
ggtgggcaggacacacgtggcctcctggca

SEQ ID NO: 89886 - DNA, 30 bp, Homo sapiens
  chr22:50297790-50297820
  hypo
ggcctctgggagggccgtgctgtgtgtgga

SEQ ID NO: 89887 - DNA, 30 bp, Homo sapiens
  chr22:50310723-50310753
  hypo
tctctgccaggagcacgggaagaccaagtc

SEQ ID NO: 89888 - DNA, 65 bp, Homo sapiens
  chr22:50316873-50316938
  hypo
tgttccagatgtggacgagtgtgcggccgagccgcctccctgcagcgctgcgcagttctgtaaga

SEQ ID NO: 89889 - DNA, 180 bp, Homo sapiens
  chr22:50421861-50422041
  hyper
gctgaagcgagggggcggggagacgggagaccttgagccctcgcgccctcgcgccctcgctccgggttcctgcgcgtggagggggcaggacgccccgcccttattcccgccgccagggggctccacggaggccgcccctcatccacagcagctgcgggtcctgcccggccctccagggcc

SEQ ID NO: 89890 - DNA, 30 bp, Homo sapiens
  chr22:50436010-50436040
  hypo
acactggcttggcaccgttattccacctcc

SEQ ID NO: 89891 - DNA, 45 bp, Homo sapiens
  chr22:50436676-50436721
  hypo
cagtgtctggctctccgggtggtagtagaccgtgtcccacagcac

SEQ ID NO: 89892 - DNA, 30 bp, Homo sapiens; identical to SEQ ID NO: 46862
  chr22:50439060-50439090
  hypo

SEQ ID NO: 89893 - DNA, 30 bp, Homo sapiens
  chr22:50447897-50447927
  hypo
acagggtggcactggcgccctcagagcagg

SEQ ID NO: 89894 - DNA, 82 bp, Homo sapiens
  chr22:50453457-50453539
  hyper
acagcgctgtgttctcggcctcagctccgcgcaggtttccacggagacgcgcgtggctccgggtcgtcgtcctggtccccgc

SEQ ID NO: 89895 - DNA, 275 bp, Homo sapiens
  chr22:50466770-50467045
  hypo
gtggcaggcagaccacgtggggactggggagtcattggtgtctgggaggccacgtcactggccttcctgagtgatccccacacctgggaatgtgccctgcgggccatagccgcgggattgctgcaggaggaacttcgcctcccgtggggcaagaggcatctccgtgagtgggtcccagcccctgaatcgcagtgggaatcagggaggcggcaacacctgcgtgccgtcataaagacccccaccatgccctcgtaaagacccccatcacaccgtcc

SEQ ID NO: 89896 - DNA, 300 bp, Homo sapiens
  chr22:50469755-50470055
  hypo
gtggcctggaggctgcgggcatggagcccccacctctaaccacagtcaggactgggtgaggctgggaacaagagggaggaaagctggacagaggcactgagcctgagtgagcggggccgctccgcccgcacgcctggagtagccccttcctcggtgccgacgaggcactgagccccatgggagagcagggcaggcctgggccctcagcgggaccgagcatggtcacagagcaggatcggtgtcctccatagaccccgctgcactggcggcctgcagctccaccctcgcccagtgaccagg

SEQ ID NO: 89897 - DNA, 268 bp, Homo sapiens
  chr22:50470497-50470765
  hypo
tcaggtacttctggacggcgttgttgcacaggtggatggcgctgcaggggggacgaggggcaggtgctcagcctcccttggcccaggagggcacccaaggccggtcctcccagccgtgctgagcccacccagctggctctagagaaccctgcccctgaggactccaaccctctgctggaggggcccagctgggatgagcgttactgtcccagatggagaaacagggctcagagaggccatgggattggccaggcgcacagctcacagc

SEQ ID NO: 89898 - DNA, 42 bp, Homo sapiens
  chr22:50482195-50482237
  hypo
aaacgctccatgctacgtggttctaaccgaatggcattctag

SEQ ID NO: 89899 - DNA, 110 bp, Homo sapiens
  chr22:50484380-50484490
  hypo
tgttcacgcacagcccgatctccagagacagtggcgtgttaggcaggaggggcagctcagctcagctctgcctcgctcacaaggcgaggacgggccgtccacctcagact

SEQ ID NO: 89900 - DNA, 48 bp, Homo sapiens
  chr22:50484839-50484887
  hypo
attagagaggcatatcgtgaagtccccgcaccccgatgtctggtttgt

SEQ ID NO: 89901 - DNA, 106 bp, Homo sapiens
  chr22:50488454-50488560
  hypo
ccacactcaggccggcgccgactcctcctgcccgtgacagacgcacacgccctgagctgagacgtgcgcctccgatacgctaccattgacccgggcgccttcatcc

SEQ ID NO: 89902 - DNA, 212 bp, Homo sapiens; identical to SEQ ID NO: 4922
  chr22:50496971-50497183
  hyper

SEQ ID NO: 89903 - DNA, 170 bp, Homo sapiens
  chr22:50497213-50497383
  hyper
cggggtgaccgtatcagcgccccccgtcctgcggcggaacttgggagggccttggtatccgcagaaccactcgtggggtcccacgccgctgccccccggggggttctgagcccacccaggtccacacggcccctgtcgtttccccccgcaccccgcggatcaccccgcca

SEQ ID NO: 89904 - DNA, 160 bp, Homo sapiens
  chr22:50506998-50507158
  hypo
cgggttgcaggaccacggccggagcctgggagcccaggacagcgggcgtggccagggctgggggggcgggcatggccgggcactcatgggcatagtcccaagctggttccctgcatgactcctgctgaaacctctgccttttcttttttctttttctttt

SEQ ID NO: 89905 - DNA, 102 bp, Homo sapiens
  chr22:50509901-50510003
  hypo
tgggtccctgttaatcggggagtccctcagcctctgtcacctccgttacctggtcgcttctggggggtgcagcccatcagctgcagtcgggcctccgtgtgg

SEQ ID NO: 89906 - DNA, 57 bp, Homo sapiens; identical to SEQ ID NO: 46867
  chr22:50512688-50512745
  hypo

SEQ ID NO: 89907 - DNA, 30 bp, Homo sapiens
  chr22:50513114-50513144
  hypo
gaccctggaccccatcgaagggactcggga

SEQ ID NO: 89908 - DNA, 30 bp, Homo sapiens
  chr22:50519234-50519264
  hypo
ctagaatgtaactcacgcaggcacaagacc

SEQ ID NO: 89909 - DNA, 30 bp, Homo sapiens; identical to SEQ ID NO: 46868
  chr22:50526328-50526358
  hypo

SEQ ID NO: 89910 - DNA, 102 bp, Homo sapiens
  chr22:50529523-50529625
  hypo
tcctgctgcaggcagcgtgttcagggcctctggatccacgagggccgatgcccggggggccggctgtgttacctggagcacttgctccgtggatctcttcgg

SEQ ID NO: 89911 - DNA, 30 bp, Homo sapiens
  chr22:50529892-50529922
  hypo
taataaaaagataatcgatagtactaataa

SEQ ID NO: 89912 - DNA, 53 bp, Homo sapiens
  chr22:50582627-50582680
  hypo
ccggccaccatggtccgggtgaacgccacctgcaggttcgaggaggtgagccc

SEQ ID NO: 89913 - DNA, 30 bp, Homo sapiens
  chr22:50587368-50587398
  hypo
aggcgtgagccactgcgcccgaccaacccc

SEQ ID NO: 89914 - DNA, 30 bp, Homo sapiens
  chr22:50596623-50596653
  hypo
taccggaagcaggtacgccctgcccaggca

SEQ ID NO: 89915 - DNA, 30 bp, Homo sapiens; identical to SEQ ID NO: 38621
  chr22:50609166-50609196
  hyper

SEQ ID NO: 89916 - DNA, 103 bp, Homo sapiens
  chr22:50623612-50623715
  hyper
ggccagccgggtccccctggaggcctccggacgatcggaagtgactgagcgtccgggtccgtgaggccgggggtcggcccgccctaagactcccacctggtcc

SEQ ID NO: 89917 - DNA, 281 bp, Homo sapiens
  chr22:50623741-50624022
  hyper
cggggcccctggggcccgaccttcccggggtgccccaacctgcggcaaggccgaggtcccgctgaggcatgagtcccgggtcggggaccgctctgggccgacccccggaggacggactaggccgatccccagagggaagggggccaggccgaggccatggcagcgcgttccctgatcccgtgttctcggctcctcgcgtcccactatcggctgtccctttcgtgcgggactgacggctcacagaacagttacatttcaatatcattcgactgaaaaccatc

SEQ ID NO: 89918 - DNA, 59 bp, Homo sapiens
  chr22:50656906-50656965
  hypo
ggggcctcacctgtgcgcttgaggtggaagcagacgtccttgagcgcccacatcatgag

SEQ ID NO: 89919 - DNA, 457 bp, Homo sapiens
  chr22:50686455-50686912
  hypo
gtccaggagggagctcggtgcagatgcagctgccttacacactggacccccaggcagcagaggtggaggcctcccctctggggagtggctgctggggctcatcggcacagcggtcacatctagggacagttcggagtcatagccactgcacaggagcccgaggtgggatcctgcagcctagcacccggccacactgaccttgctgctggaggctcttccagtgcggggcctgggcagcacgggcactctggatggactctagggcactgtgagggagacacaacagtcgtgacacctggtctcacaccccggccctgcccgccctacctcccctcgcacctctgacatggcgccattggccctgacaggggtggggccgggtcacccagcagcgtctgtactgtcatgcacactgactccgccagtgactccaggtggtagccgccctgggaggagg

SEQ ID NO: 89920 - DNA, 225 bp, Homo sapiens
  chr22:50695326-50695551
  hypo
gggagggctgatgagcggcttctccaccgggactcactctgtggatgatgccggcagcgtggatatactgcggggggcagaggatttggcaggcttcagcgcaccctctcagagccacagggccctcctctgcccagccccgaggccctgcctgcctccctgcagcctcccccggggcccgtaccctcagccccttcagcatctggtacacgaggaactggatcc

SEQ ID NO: 89921 - DNA, 30 bp, Homo sapiens
  chr22:50697675-50697705
  hypo
gtgtccagggggcagcggggactgtggaca

SEQ ID NO: 89922 - DNA, 229 bp, Homo sapiens
  chr22:50721136-50721365
  hypo
cacctggcaaagcttcgtagcggctcgaaggctcgcagtacggggttttcgcggtaggtgaagaagatgccggggttgggcacgggggaccccccgtaggagacctccagaagcatctggccccgtgtcgcctgggggccagtgacacactggagctgcgccccaaacttcgtcctgggggagggagggtgctggtctgcatcaacccctcccccgggaccagccccag

SEQ ID NO: 89923 - DNA, 44 bp, Homo sapiens
  chr22:50721828-50721872
  hypo
accccccgtgaaaggcgtctccgcagcctcgatcacacacacga

SEQ ID NO: 89924 - DNA, 30 bp, Homo sapiens
  chr22:50755701-50755731
  hypo
agagtggccaagcagcgcaccttctggaag

SEQ ID NO: 89925 - DNA, 126 bp, Homo sapiens
  chr22:50764712-50764838
  hypo
aggtgaacaaggaggcgctgcagggttttaagcaggagagccacaaaggttgaactctggggtgcagctggggtggggatgacatcagtgatggcagcaaaggaacggatccgagacctttgttgc

SEQ ID NO: 89926 - DNA, 19 bp, Homo sapiens
  chr22:50766201-50766220
  hypo
cacgtgttggccagacgcg

SEQ ID NO: 89927 - DNA, 78 bp, Homo sapiens
  chr22:50766520-50766598
  hypo
ttcggatcatctggcctaggtgtggggtaggctgtcccatctaggtttgtcacataacaaaatcgcctaatgacacat

SEQ ID NO: 89928 - DNA, 30 bp, Homo sapiens
  chr22:50873974-50874004
  hypo
agtgggttaggtgggcgcaggcacagcaca

SEQ ID NO: 89929 - DNA, 690 bp, Homo sapiens
  chr22:50899018-50899708
  hypo
agagcccaaggtgaacgcaaaggtggccctgatgtccggcgggtaccgcagcttatgcagctgcttacggaagagctcggcgctgtcagaccccacctcctcgtcaaaggccattttcagcagctgtgtcagtaaaagcagcccttaggggtgtgggtggccccccagcccctcccccaactctgacactgccaggctccccttcccctcgcagccatgacagagagagaagcaggccccaggcaaaggcctgtatctgtgtcacacgaaggcaagcgcttgtgtaaactcgaaatctcagtggctgtgagctgaggcctgggtttgcaaggcacacccaagacacggacttgagggccggcgccccaaggaaaggacaaggacccaaagaccgcacatcaaacagtggacatcaactcaagagccacagtgagggccccagacatgcaagcgtaacaacagggccactgctggagactggcctaaaaatggttcatacaagaaagaccggtttgcaggagaaagaccagggcgggggatgagagccccacccgcgcaccgcgccccacctggaatgtgcaggagcgcagctggagcccgtcctgcaggagctggtccacaggggtctggacgctgatgcgcttctccttggtcagcgcagccaccgggaaggagcggaccaccacctgc

SEQ ID NO: 89930 - DNA, 30 bp, Homo sapiens
  chr22:50900202-50900232
  hypo
agccccaacggcccccgcaaaccttctgga

SEQ ID NO: 89931 - DNA, 70 bp, Homo sapiens
  chr22:50900758-50900828
  hypo
ggcctggctgaacaccgtgctctcctccttctgcaccagctcctgctgcttctcacgactcagagttggc

SEQ ID NO: 89932 - DNA, 32 bp, Homo sapiens
  chr22:50909774-50909806
  hypo
ggcgaacacagacctcgcgttctgtcatctgc

SEQ ID NO: 89933 - DNA, 40 bp, Homo sapiens
  chr22:50919589-50919629
  hyper
gtcaggctggggggccggggtccaccgggtcagaccctgg

SEQ ID NO: 89934 - DNA, 58 bp, Homo sapiens
  chr22:50922605-50922663
  hypo
gagctcagggattgccgagtccacgtaactgacctgtactccacgaggccctgtggga

SEQ ID NO: 89935 - DNA, 204 bp, Homo sapiens
  chr22:50927887-50928091
  hypo
aggggcaacgcagcccgtccaccaggcccggtcctgcagccccaagtgagccgctgggtggccttgcccgcaggctttctacatgatccggttccactccttctacccctggcacacgggccgcgactaccagcagctgtgcagccagcaggacctggccatgctgccctgggtgcgggagttcaagtacgccccgctacccgc

SEQ ID NO: 89936 - DNA, 169 bp, Homo sapiens
  chr22:50935672-50935841
  hypo
gtcagacacctggaccgtggcacccacctgtccaacctcgcccagctcagatcaccaacctcatcgatttccttgcaaaacttttgacttccgccttggacttttgccccttaaaattttatctctgcagagttagaatatgacattgctttgtcgataccataataat

SEQ ID NO: 89937 - DNA, 242 bp, Homo sapiens
  chr22:50943170-50943412
  hypo
gaggtcagctgggcccgctgacctgggccccaccaccctgcccgccctgggagggctcaccgtccagtggtggccgtcgtaactgccctccagcaccacctcaggccgtccaccaagcccagtcatgcggcggaagaggccgtaggagttggccagctgtaggtgctccacggcaccaaacaggcggtgggccccggtccagaggcgcccgtgggtcccgggctccacgtaggagtacggca

SEQ ID NO: 89938 - DNA, 351 bp, Homo sapiens
  chr22:50944365-50944716
  hypo
tgtccccgggagccacgctgtccccaacagggcacgctgagcagcgctgaaggccgagccctgtctgcctctctctgacagctgcggccctcacccacctgcgagtagaaagcagccaagcgcaggcgtcgaatgggggcgaagaacaggggcggcacagcgatctcaattaggaaggtggccaccacgctgagcttgtgcagccagaccggcaggtggtgtgcgaaccaggcggcgggcgtgggcaggcactgggtctcgtagtggtaggtgagggctgcaggcgagggcaggagtcagggctggccgagcccccagactaccccaggtccagaccgggcccctcaccag

SEQ ID NO: 89939 - DNA, 32 bp, Homo sapiens
  chr22:50948627-50948659
  hypo
gcgtgagccaccgcgcccggcctcttttttgt

SEQ ID NO: 89940 - DNA, 30 bp, Homo sapiens
  chr22:50954437-50954467
  hypo
gcagaggaaggatggcgactcacctgtaac

SEQ ID NO: 89941 - DNA, 69 bp, Homo sapiens; identical to SEQ ID NO: 46878
  chr22:50954977-50955046
  hypo

SEQ ID NO: 89942 - DNA, 41 bp, Homo sapiens; identical to SEQ ID NO: 46879
  chr22:50977129-50977170
  hypo

SEQ ID NO: 89943 - DNA, 44 bp, Homo sapiens; identical to SEQ ID NO: 38624
  chr22:50987052-50987096
  hyper

SEQ ID NO: 89944 - DNA, 145 bp, Homo sapiens
  chr22:51042260-51042405
  hyper
gcccagcagagctcccgggccccctccctgccacggacaccgggcccggcggggcgcagtcgccagtgcgcccgggttgcgactgcgaagggaaccggcctgcggaaccccctgcgccaggggggacttcgccctcctcagatcc

SEQ ID NO: 89945 - DNA, 109 bp, Homo sapiens; identical to SEQ ID NO: 1528
  chr22:51042457-51042566
  hyper

SEQ ID NO: 89946 - DNA, 32 bp, Homo sapiens
  chr22:51049120-51049152
  hypo
ccgtctttccccagccgcgccttcctggagta

SEQ ID NO: 89947 - DNA, 127 bp, Homo sapiens
  chr22:51111883-51112010
  hyper
agtgcaggacagttccgagaggccgctcagggctggggggcctggtgcaccccgatggggcggcggtgcctgagctcgtttctttactgagctcccccctcctccgcccactcatcaccccctcccg

SEQ ID NO: 89948 - DNA, 291 bp, Homo sapiens
  chr22:51112026-51112317
  hyper
cgtaaaactaaaattcacttcccagtcgcaggtggagactagtagcgccccctcccctaggcccttccccgtaggtcgcgcccccatcccgccgtcgctaaggtgacggggagggggcgacaggcgttggatccggaccggccaggggtccttggggggaagtccggagcaaactccccaaactaggctggcgtgggggagccgcgccgaacacgccagggcgcggtcgaaagggttaattcggagggcctctcgccgaggcggtgggaagggccccgggccctccccggt

SEQ ID NO: 89949 - DNA, 46 bp, Homo sapiens
  chr22:51113404-51113450
  hyper
caccccgcatggggccggcggggcgggtccgcgctcccgggacctg

SEQ ID NO: 89950 - DNA, 110 bp, Homo sapiens
  chr22:51144325-51144435
  hypo
ccatgaagaagtttgcgtccagccgtaacctgaacaagatcctggcacagtgcgactcatcctcgcgggagtacgaggagatccaggcggtggagcgcaagtggcacctg

SEQ ID NO: 89951 - DNA, 45 bp, Homo sapiens
  chr22:51181429-51181474
  hypo
ctaacccaaaggtcacggtagagagtccagcgctttctttctttt

SEQ ID NO: 89952 - DNA, 41 bp, Homo sapiens
  chr3:100211005-100211046
  hyper
aacgccctttgggggcgtgggcagcccggagccccagcctc

SEQ ID NO: 89953 - DNA, 34 bp, Homo sapiens
  chr3:100989020-100989054
  hypo
tccacctgcctcagcctcccgaagtgctaggatt

SEQ ID NO: 89954 - DNA, 30 bp, Homo sapiens
  chr3:101021607-101021637
  hypo
aaaacacatgcaatacgtttcattaaaatg

SEQ ID NO: 89955 - DNA, 164 bp, Homo sapiens
  chr3:101230477-101230641
  hypo
atacaccaagaacatcgataacattggttgcatatgaaaagggatttcaggttttcaactgcttcaagcagtgtccccagagatccataatcactctcctttgcaattaaggctgaaagcagtttgagatgcactgccacagggcactcctaaataaatttgga

SEQ ID NO: 89956 - DNA, 163 bp, Homo sapiens
  chr3:101230941-101231104
  hypo
gcgtgagccaccgcgcccggccaataaatctgtaattgttaactgtctctgcagaaaccaacggtaccatcagaaacagaaaaatgaaatgaaataattgattcattgggcgttcgtttgtgtactggactgtaagcatatgagtcctcgtcctctcctccta

SEQ ID NO: 89957 - DNA, 30 bp, Homo sapiens; identical to SEQ ID NO: 39857
  chr3:10127378-10127408
  hypo

SEQ ID NO: 89958 - DNA, 30 bp, Homo sapiens
  chr3:10129903-10129933
  hypo
ggggttggggtgggacgtgttgagccttag

SEQ ID NO: 89959 - DNA, 98 bp, Homo sapiens
  chr3:101397204-101397302
  hypo
tttcccccatggggtcgggcagtgagagcagaagaccaaatgcaccctctgcgaacccaggaggctggtctacgtgtcaggccaaccccactctcctg

SEQ ID NO: 89960 - DNA, 24 bp, Homo sapiens
  chr3:10156881-10156905
  hypo
gcaagactccgtctcaaaaaaaca

SEQ ID NO: 89961 - DNA, 49 bp, Homo sapiens; identical to SEQ ID NO: 14519
  chr3:10182868-10182917
  hypo

SEQ ID NO: 89962 - DNA, 444 bp, Homo sapiens
  chr3:10206755-10207199
  hyper
ggggaccagggcgaccggagcccccagcgatcccgcctggagcggccgccaagctccctcgggcacccgggttcagcgggtcccgatccgagggcgtgcgagctgagcctcctggaccgggtccgccgcggacctcggcctgtcacctgaaggtgccgcgtggtctctgaggacgtctgtcgacgagcaggggccgccgccactgcgctctgagtccagagaacggtgggtacgggggccctcctgtcagcgctgctggctcggtgacgtccccaggtggcctctcatccagcccacaacagcctgcaaagtgcgagcctcgaccctgtagggacccacggtgctgtcacttcttgggggggtgtgtgtgtgtgtgtgtgtggtgtgtttagttttagtgtatattagaaggatctatgatttaacatatatatatatattgaa

SEQ ID NO: 89963 - DNA, 25 bp, Homo sapiens
  chr3:10210615-10210640
  hypo
tcaggggaaccagcccgcagtattt

SEQ ID NO: 89964 - DNA, 30 bp, Homo sapiens
  chr3:102435036-102435066
  hypo
gcttggacatgtgatcgcttagggtaatat

SEQ ID NO: 89965 - DNA, 30 bp, Homo sapiens
  chr3:10332154-10332184
  hypo
tctgagagctcatggcgagtcttttcatga

SEQ ID NO: 89966 - DNA, 30 bp, Homo sapiens
  chr3:10373144-10373174
  hypo
tcatgtgactgacaacgcagaggggatgac

SEQ ID NO: 89967 - DNA, 36 bp, Homo sapiens
  chr3:10434940-10434976
  hypo
cgggccaaagctcagcgcccacgaagggagaaggtg

SEQ ID NO: 89968 - DNA, 30 bp, Homo sapiens
  chr3:104512166-104512196
  hypo
ggttccttccttttacgtgttatgaaagta

SEQ ID NO: 89969 - DNA, 55 bp, Homo sapiens
  chr3:10452238-10452293
  hypo
cccccagcgtggatgcggtggccaggtgtgcggggcggttcgtgggtctgaggcc

SEQ ID NO: 89970 - DNA, 102 bp, Homo sapiens
  chr3:10547163-10547265
  hyper
accaccaatcctgcacggtttcccggcgggcagccccgtaatcgcggtgcggcagctggtgccgcggctgagcccagccagcgtgcccgggcccctctgcag

SEQ ID NO: 89971 - DNA, 30 bp, Homo sapiens
  chr3:106136655-106136685
  hypo
attccttggtatgtacgctatatcgaggtc

SEQ ID NO: 89972 - DNA, 41 bp, Homo sapiens
  chr3:106732480-106732521
  hypo
agaaaagagtgacaacaacaaatattcgcaaggatgtagaa

SEQ ID NO: 89973 - DNA, 30 bp, Homo sapiens
  chr3:106824203-106824233
  hypo
gcttatggtgcacttcgtccaggaagtgca

SEQ ID NO: 89974 - DNA, 16 bp, Homo sapiens
  chr3:106835414-106835430
  hypo
gcgccctgccaaaggt

SEQ ID NO: 89975 - DNA, 38 bp, Homo sapiens
  chr3:106862938-106862976
  hypo
gggagccaagatggccgaataggaacagcttcggtcta

SEQ ID NO: 89976 - DNA, 33 bp, Homo sapiens
  chr3:106936157-106936190
  hypo
ttgtatgatatatgacgccgtttatgtggaatg

SEQ ID NO: 89977 - DNA, 67 bp, Homo sapiens
  chr3:107148996-107149063
  hyper
aatattccaggactacgcagtagccagacgactctctaagaacatgggtttccgcagtcagctccga

SEQ ID NO: 89978 - DNA, 280 bp, Homo sapiens
  chr3:107149774-107150054
  hyper
ccacatttgtcttggcgctctggggaagaaggtaagaatagatagacgaacgaaggtgcgtgcaagaaaggagggaggggaggaggtacggtcggcttgcacaccagactgtgcttgtttgagcaggaatagtggcggggtgtcttcgagaggataacggaaatgccccaccacacgcccacagcgcaagtgccggcgtccccaatcggccagtggcagcagcagaaccggggtccacttggcacctcaggggctctcgcccgtccgctctgggcgtcgg

SEQ ID NO: 89979 - DNA, 30 bp, Homo sapiens
  chr3:107244633-107244663
  hyper
ctggggattgtgacccgggctgggtgtttg

SEQ ID NO: 89980 - DNA, 744 bp, Homo sapiens
  chr3:10749201-10749945
  hyper
gccaggtggggaagtcggagccatctgggaagaagaaatagggggttctagcgtcccggacgcccccccagctccggggctgctccgagcccggaaagttttcgcgcagcaggcgcaaggcgcgcccccttccctcacccgcaggcgccgggtccgcggacgcccaccccggcccgccccgcccgccgcctggtgcccgctcaaggtcactgctgacaaggcgcctgcctccgcggggcgaagggaccaagacacgctccggctcacgctcccgccctggcccggcgggggtctccggggccgagcgcccgcggaagggaagccagcagggaaagtgacaagagaccgagcgagaggggaagaggcccagagcccgggcccggccgcccctgcctcacctgcgccggctccgagagcgagatgctgccgccgccgctgccgccgccgctgccgctggtgcgcgcccggcccggcccggccccgctgcggctgcggctcctctgccgcggctgccccgcgctcgcctgccccgcggccccgccgccgcccgcccgcctccctccctccgccgccgcctctgccaccgctgcactgcgctctgcccgcctccccctcccgccctccctgctcactcctccccgcgcgctccccctcggccctccccaaactcctcacggagagcgccccgcgggaccggagcgcgcggtcccgcccgcgtcctcctccgcgcgcaccagtggggct

SEQ ID NO: 89981 - DNA, 50 bp, Homo sapiens
  chr3:107632014-107632064
  hypo
gcatccataggaaaacgttatttaaacattggaaccgttggctgaaatgc

SEQ ID NO: 89982 - DNA, 215 bp, Homo sapiens
  chr3:107771800-107772015
  hypo
cgagactccatctcaaaaaataaaaaaacccaaaaaaacaaataaatacagaataagaatcctacagatggaaaagcgttgaacagaaacatgccatgaaccactcagcaggagggggatcctactgaacagagaggcccattccgctgggacctgggctggatgacagcactggattttctcatcagcagatggaggcacgcctccaggactgc

SEQ ID NO: 89983 - DNA, 39 bp, Homo sapiens
  chr3:107833994-107834033
  hypo
aaaaaatcttcataacggcaaggtcgcaatagccatttc

SEQ ID NO: 89984 - DNA, 91 bp, Homo sapiens
  chr3:108483736-108483827
  hypo
catgaatgaagcttgcgaaactgaaagttgttctaggagagtaaatagaaagtgaatatgggccggcgcggtggctcaagcctgtaatccc

SEQ ID NO: 89985 - DNA, 93 bp, Homo sapiens
  chr3:10857625-10857718
  hyper
ggagccggcctaggccggaatgggcgcttccactcttggcccagcaggccagtgggcagggccgcgggaaggacgggcgctgcaggggctccg

SEQ ID NO: 89986 - DNA, 365 bp, Homo sapiens
  chr3:10858054-10858419
  hyper
cgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggtgaggtgatagtgaggagaaggggagggggcgccaaccgcccggtgggggcggggagccaggggcgagcgcgagaccccctcccgcgcctgcgtggagcggaacccgagcggagaacctcgactccaggcacctcgcgtgtgagctcgccccggagcgcggcccacctgtgccagtgcgcacgcgcacgtgccaattcgcacctgagggttc

SEQ ID NO: 89987 - DNA, 84 bp, Homo sapiens
  chr3:108829148-108829232
  hypo
aatacttgatgactacgaataaagtcagcaaagaaaacagatttggtttggattttctagccctcataccgcacattcacgtac

SEQ ID NO: 89988 - DNA, 30 bp, Homo sapiens
  chr3:109035016-109035046
  hypo
cactacagcccatgccgtcccacccccgcc

SEQ ID NO: 89989 - DNA, 30 bp, Homo sapiens
  chr3:109787249-109787279
  hypo
tctacaattttcggccggccaaggatcatc

SEQ ID NO: 89990 - DNA, 41 bp, Homo sapiens
  chr3:11033835-11033876
  hyper
gcgacccacagagggcgaaaagaggacgaccgcagagagaa

SEQ ID NO: 89991 - DNA, 355 bp, Homo sapiens
  chr3:11034146-11034501
  hyper
ggagggagaagagagcgggagaatgcgagaggaaagaagggagaggggaggcgtagaaggggagaggaggtgaagggaaaaggagagagcctgctggcggcgaagctgcaagaggcagctgcggagggagcgcgcggcgggcctgggggagcgctgggcgggggcgggcggtgcgggcagggctatacccgagctgggcgggctccgggcgccgcgggccctgccctccccctccatccctccggactcgctcccccctcctctcccttccccgcgaccctccgcccgccctcggaagaccgagacagcggagaggttgcgggtgagctgcgctgagcccaggagccgaggagtc

SEQ ID NO: 89992 - DNA, 851 bp, Homo sapiens
  chr3:11034502-11035353
  hyper
ggagcgcagtagcgctgagcccgagcccgagcggccccgcgtcccgagcgcatcggagcggccgagccgcccggatgcagcgcctgtcccgggcagcgcagccccggccgcaggtaggaaagggcggccggcgtcggggcgcggggcgcagagcctgggataacggcgcaggaacggccagagccccgagccgctgccgcgagccgggccgggtggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccc

SEQ ID NO: 89993 - DNA, 52 bp, Homo sapiens; identical to SEQ ID NO: 28066
  chr3:11035382-11035434
  hyper

SEQ ID NO: 89994 - DNA, 51 bp, Homo sapiens
  chr3:11062025-11062076
  hypo
aggggatggcagggacggggcatgtcagccagagcccggcaggagacagag

SEQ ID NO: 89995 - DNA, 280 bp, Homo sapiens
  chr3:110789454-110789734
  hyper
ccctcctactccccccgcggaaccaatgtggcagtggctccaaggtcaagctgccggtactgtgcgaggcgggaggatggagagggcagggcggagagccacctgggatgagcgagggtcatggtggaccacagacgctcttcttatacgggcaaatgtttaatacttcccgaggtcgcctctctgccatcaaacgaaaacaggcaagaaaataaaactacacatacgaacatgcaaaggaaacaaaaccaaagaaaaacaccaacgcactcgttggggg

SEQ ID NO: 89996 - DNA, 30 bp, Homo sapiens
  chr3:110790641-110790671
  hyper
gcggcgggcggctcccgcttcagcctcggc

SEQ ID NO: 89997 - DNA, 215 bp, Homo sapiens
  chr3:110791320-110791535
  hyper
ggaccgttacttcctcgctcattctctgggaaccctcgtaggttaaggtgccgggatgcacgtttgccgctttttttcccggtgaaacttgagctgtgagcccagaaaccctagggaccggagcccgatggaatgaagcctccgggtccacttctcatggccttccaccctggagaaggcaccattttagcccacccagccgcagaatcccctac

SEQ ID NO: 89998 - DNA, 30 bp, Homo sapiens
  chr3:111197729-111197759
  hypo
ctttgccgaggtgctcggcctctatggtct

SEQ ID NO: 89999 - DNA, 360 bp, Homo sapiens
  chr3:11196531-11196891
  hyper
gtccgtctttgagctcgggcgagcagagggggagcctcgttttctttgagcctccccagggtctgagttcgctgctaaccgtagtgccagcccattggttgagtgcgttcactgtgccaggctttgggcatccattatctgttgcaatattgttatactcattttacagaggaggaaactgaggctcggggagggaagttgtgcccaggagcatcagctggttaaggggagagagtcagggttttgctcggagtcatcctgatccaaatcacttgaatacactgaggtaagccccaggctcagcgtcacctggagtcgggggtgggaactgtccggaccaccacccgcccttcccctgca

SEQ ID NO: 90000 - DNA, 34 bp, Homo sapiens; identical to SEQ ID NO: 39967
  chr3:111988003-111988037
  hypo

SEQ ID NO: 90001 - DNA, 64 bp, Homo sapiens; identical to SEQ ID NO: 28283
  chr3:112052498-112052562
  hyper

SEQ ID NO: 90002 - DNA, 109 bp, Homo sapiens
  chr3:112930328-112930437
  hyper
cctcctcctcctcctcgcacggtaatgggaggctcctaggcaggagaagcaaaagaaggaattgtttgcgagttcagtcatccaaaaagcttcttccatatggagggac

SEQ ID NO: 90003 - DNA, 56 bp, Homo sapiens
  chr3:112930455-112930511
  hyper
cgtcccctgcgttgtcctcctgctgccgcccccgcggccgccgctttctgccgcgg

SEQ ID NO: 90004 - DNA, 468 bp, Homo sapiens
  chr3:112930806-112931274
  hyper
caccacgctggcccccgggccccggctcgcccttcccaggcgccggctgcagcagaggtgagtcacgtcgctgaagtttgttttcttttcataaaaagttgtgtttactgttggttcggggagaggagggggcgggaggcggccgcaggccgaggcagcgccagcgagtggctgccgggggacgtgccggcggcgggagccgggtcccagcgctcggccgggcgcccggggctgggagctgcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacacca

SEQ ID NO: 90005 - DNA, 58 bp, Homo sapiens
  chr3:112931566-112931624
  hyper
tcgtgtgtgcgtgtacgtgtgtgcgcgcgcgtgtgtgcgtgttcgcgccagcagcgtc

SEQ ID NO: 90006 - DNA, 18 bp, Homo sapiens
  chr3:113557458-113557476
  hypo
tttcgcacattggggcag

SEQ ID NO: 90007 - DNA, 208 bp, Homo sapiens
  chr3:113866148-113866356
  hypo
gcaaagtacactgaccgggggtcagaaattgcagggctgagcacaactcacagccagtcattcagctgtgctgtgaatcacatggatgctagaaatgaagccatcactgttacctgtggtattaaagccaaacagaagagggcaggacacagcaaaggccagtacccagacggccgtgatcatgagggccacgcgccgacaggagctc

SEQ ID NO: 90008 - DNA, 44 bp, Homo sapiens
  chr3:113958201-113958245
  hypo
aatggaagttgatgccggttgggtcggggcgacctgcaagcttg

SEQ ID NO: 90009 - DNA, 30 bp, Homo sapiens
  chr3:114973219-114973249
  hypo
gccaactagaaacagcggtggtcagtggag

SEQ ID NO: 90010 - DNA, 16 bp, Homo sapiens
  chr3:115231485-115231501
  hyper
ggggctgcagaagccc

SEQ ID NO: 90011 - DNA, 313 bp, Homo sapiens
  chr3:115231502-115231815
  hyper
ctgcgcgcctcctggtttctatggagaccctgcttgatgtcaatggcggctccggagcgcagggaaacctaagcgtttgtatttaaatgagggaaagtgggggaaggggaagtaaaagaggaagggaacagaagagaggatggtagaggtgagcgggcgggtgttgaactctggggactagaaaaatccagctgcgttactcagtcatctcatgctcgcggagaaatcagaggaagcagcagcgggcagaggggtgtttatttcttgcgtgagaaatatccgacttctttctgacatccgggagtaagggaca

SEQ ID NO: 90012 - DNA, 314 bp, Homo sapiens
  chr3:115377639-115377953
  hyper
cttggagaacaaaagcgtcagcccagggccccaggtctctccgcgggaggagggcacccaggggcgatgcgccgggctctctccttcgcccttcttggcccgctcgccttcagctcccacccgcagcagcaaccgcagcctgcttccggggactgagcagccctgggtcagccaaggttaagcagcgggtggggaagaggagagaaagctgggtcaattggaagtaaccttcttgtaccgcccactttttccttgcttggaggcggcaaaaagcactttagcattcttcgggctgtttgcgcctctttctctaa

SEQ ID NO: 90013 - DNA, 76 bp, Homo sapiens
  chr3:115502397-115502473
  hypo
caacaagagcgaaacgccgtctcaaaagaaaacaaaaaaaatgcacggagggaaaacagcccggaggctgaatcct

SEQ ID NO: 90014 - DNA, 71 bp, Homo sapiens; identical to SEQ ID NO: 39971
  chr3:115752446-115752517
  hypo

SEQ ID NO: 90015 - DNA, 21 bp, Homo sapiens
  chr3:115789599-115789620
  hypo
tgtacctgccgggcacggtgg

SEQ ID NO: 90016 - DNA, 94 bp, Homo sapiens
  chr3:11581322-11581416
  hypo
cctgccctgcacagccgcctggaggttcacctgcatcattgcgtgtgtcagcgcttggtgcctttctgtcgctgagtagcgtctcgctgtgtga

SEQ ID NO: 90017 - DNA, 56 bp, Homo sapiens
  chr3:11600778-11600834
  hypo
acaggtgaggaggcccgggacactcaccgctcggtggcctccggtagctggcaggc

SEQ ID NO: 90018 - DNA, 281 bp, Homo sapiens
  chr3:116163708-116163989
  hyper
gcccgaaagccctacctgaggatggctgtgtccccctgcctcacggtgatgttgtccgtgcctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtgctctggaggggtgcgcgctgctcgcgaggagaggcttcaccaacacggggctttcatccacagcgagcgcagagcggg

SEQ ID NO: 90019 - DNA, 47 bp, Homo sapiens
  chr3:116583118-116583165
  hyper
ctgaagtgaaacatacgtgcatggtcagcagacgcacaaacacgctg

SEQ ID NO: 90020 - DNA, 35 bp, Homo sapiens
  chr3:11658975-11659010
  hypo
gggcagggacgcaagcgttacgtgaggaagcttca

SEQ ID NO: 90021 - DNA, 30 bp, Homo sapiens
  chr3:11683213-11683243
  hyper
cttcctcccaaataccgagagagaagagca

SEQ ID NO: 90022 - DNA, 148 bp, Homo sapiens; identical to SEQ ID NO: 39972
  chr3:116990241-116990389
  hypo

SEQ ID NO: 90023 - DNA, 37 bp, Homo sapiens
  chr3:11706859-11706896
  hypo
tacaggcctgagccaccgcgcccggccaaacatctta

SEQ ID NO: 90024 - DNA, 218 bp, Homo sapiens
  chr3:11763029-11763247
  hypo
ctcttacatagactccgttttagtccatcagtagtctcggactaggaaaagagaaatcctgagaaagactgtaaataggagattcatcctgccaaactcagacagggaatgaggaaggaatgaggactgcctgggcagattccaggaaatatggtaagacagaaaaagggttttagattcagacagaatttgaatccaaactccgcctctatttgtta

SEQ ID NO: 90025 - DNA, 164 bp, Homo sapiens
  chr3:117715479-117715643
  hyper
gtaccaggtgccaagcggatacctagcctcctaaacttaatgccaattccctcctgaaagaggaggaatgcagtgatatcagcaccggggacacggggatagcgaacaccaccgcggctcttggagtttacagaggagcaaccccagctccgtcgccaccacct

SEQ ID NO: 90026 - DNA, 361 bp, Homo sapiens
  chr3:117715763-117716124
  hyper
cacacacacacacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcg

SEQ ID NO: 90027 - DNA, 99 bp, Homo sapiens; identical to SEQ ID NO: 2246
  chr3:117716213-117716312
  hyper

SEQ ID NO: 90028 - DNA, 394 bp, Homo sapiens; identical to SEQ ID NO: 28296
  chr3:117716313-117716707
  hyper

SEQ ID NO: 90029 - DNA, 164 bp, Homo sapiens
  chr3:118864613-118864777
  hypo
tgacatttggaggtgcggtgggggatgttaatcagaggagcagtacctgagagagggcctctttctcacacactgcggagaacctctgtgaacaaggaagagggtaacactctaggtggcgatgcacggagccccgtggcctggttgctcggcagggtgaggag

SEQ ID NO: 90030 - DNA, 37 bp, Homo sapiens; identical to SEQ ID NO: 14558
  chr3:118976384-118976421
  hypo

SEQ ID NO: 90031 - DNA, 30 bp, Homo sapiens; identical to SEQ ID NO: 39974
  chr3:119055204-119055234
  hypo

SEQ ID NO: 90032 - DNA, 123 bp, Homo sapiens
  chr3:119298873-119298996
  hyper
tgtatagttcgggtacgagaatgtgacccgtgaaagttcagaggagttaagtaattacagcgttctgaaagcgaacgttaaagggaatttacaaccgaaaaaagatgccggtcttcttccccc

SEQ ID NO: 90033 - DNA, 294 bp, Homo sapiens
  chr3:119421788-119422082
  hyper
ctctccactcctcttcggccccgccccgcggcctcctccctcctccttgccccgccccctatccctgcgcgccggcggccgttaccatagcgacgtgcacgcagtagccaggcctgacccgctggtcccttgctggcgggaggaaagaggcggcaccatgagccacgcagtaaccatcgaggagccccaggcccagccgcaggtgtctcaaactcggtaccgggagaggtcgcgggctgggagccacatctcctccaatcgagcgtatgattttctgtacggtaaggaccgccg

SEQ ID NO: 90034 - DNA, 173 bp, Homo sapiens
  chr3:119517629-119517802
  hypo
gaactatacaaaatgcggtctttgggtatacttctttcacttagaatgttttcaaggttcatctgtgctgtagcatctatccttcattcttttaaaccgctgaatagaatttcattgtatattagtattccaggtgcattccacattttattgatccacgaaccggttgatga

SEQ ID NO: 90035 - DNA, 30 bp, Homo sapiens
  chr3:119771793-119771823
  hypo
ttcaaggtcagagttcgtaagtgttagagc

SEQ ID NO: 90036 - DNA, 88 bp, Homo sapiens
  chr3:119815404-119815492
  hypo
taattgttaggggcccgatagcagtaggagggtgaaaacaaaatggtttgggaccttaaataattgaaatgtatctttatttatttat

SEQ ID NO: 90037 - DNA, 180 bp, Homo sapiens
  chr3:119815732-119815912
  hypo
cagcctcacagagtgtcaggattacaggcgtaagccaccacaccgggccggttgaaatttatctttaaaatagtgcacctttaatcctttttttatttctgtgtgtatcttataatgtgcatatcatgttagctcaagatcaagagtttatggacaagccaggagtggtggcttatgact

SEQ ID NO: 90038 - DNA, 18 bp, Homo sapiens
  chr3:119817451-119817469
  hypo
aaacgctaggattactgg

SEQ ID NO: 90039 - DNA, 294 bp, Homo sapiens
  chr3:120003742-120004036
  hyper
tgagagtttctttaccggttccaaacaaactgcccagattctggaaagggagagaaagcccctccccctttccactttcacttaataattaagtgtttgaagttttgtggatccttaaggtcgctgtgctcacctcatcagcgtcggaccgccgagaagcgccaagcccgctgctatgtgcaggacgcccacggtcccccggcgtctcgcgcgttcgcggggctggaaggggcgggaaggggcgggccggggcagagacaggggcccgcgcccatcgccgcgccgggagcctgg

SEQ ID NO: 90040 - DNA, 274 bp, Homo sapiens
  chr3:120004079-120004353
  hyper
cggggcgccgggcgcctctggccggggcactggctgagccacgcctgcccgcccctccctggcgccgcccgcgtggcgcgcctcgaccctgctctcccgcgagggccgggagggctccgggaccttgcagactccacgcgcctcacggctcctccagctcctcggatctttctccttgcgtcgccgccgagtcccctggggcggccccgcctccggccgtctcctcagagaccttccctggggggcgccttcccctcagcgccccttcccgggc

SEQ ID NO: 90041 - DNA, 357 bp, Homo sapiens
  chr3:120169620-120169977
  hyper
gaaggcgccgggccccgcgctgacctgggaaacttgctcgggtcccgcaggctcgctccggccgcccaagcacccccggccgcccgaagagtccggcctccgcgccgtgcgccctgcgctcaccgtggtctggtccaggtctcctgggggcgcggggcaggacggcggcagcgagctgtaagcggaggtgggagctccgccgatcgccagcctcggaggaaatgcgacctcccctcgccgccccttaagacctctccttccccgcctgcctgcccccccagctcctccccattctcctcccccttctgctgcagcggcccccgcggctcccgctccccctccttccgacccctgctc

SEQ ID NO: 90042 - DNA, 165 bp, Homo sapiens
  chr3:120170066-120170231
  hyper
cggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccgggaaggtccgggactggaacctg

SEQ ID NO: 90043 - DNA, 30 bp, Homo sapiens; identical to SEQ ID NO: 39861
  chr3:12039968-12039998
  hypo

SEQ ID NO: 90044 - DNA, 239 bp, Homo sapiens
  chr3:12045681-12045920
  hyper
gctggaggcctgggtcgccccctcctgcaagccccgagagtcgccagacgcgcggctaggtgccctccgtgagcggggcggggccgcctctgcggcgcggggcgggggctatctctggccccgcccctgccccgcccgctccctctccgcgagcctcgcgccgcgcgggttgcctggcccagaccgccgctgctgtctgcggggtctggtgccggggcctgagtctctgctggctaagc

SEQ ID NO: 90045 - DNA, 375 bp, Homo sapiens
  chr3:12045978-12046353
  hyper
cgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtgga

SEQ ID NO: 90046 - DNA, 255 bp, Homo sapiens
  chr3:12046377-12046632
  hyper
cgccaggaaggccaaggtgctgctggtggtcgacgagccgcacgccgactggtaggtgccgggcgccttcgccctcgggggtcggggtccgccggcagccgcaggccaggagaggacggtcccaggtcgccgaggaaacgtttcagaccaataaaaaggagggtccccgaggtcccgctgggaggaggtgcgggctgagcgcgcgcgcgtttgcggggtgagggagggcatccatcagcccggaaaggcgaaccc

SEQ ID NO: 90047 - DNA, 393 bp, Homo sapiens
  chr3:120626865-120627258
  hyper
cagaacttaccctatcgaatctaggattggcgccgaagctactcccgccctttgacgtccccgggcaccccgcccccttcacctcccagctttgccggggaagaagcagggcggggcaagctaggggccggcccgggggcggggcctgcctcccacggcgggagggcggagcctgctctggagcctgactgctcggttaggacctcggagagcgccaggcgccgcgaccagagggcccagagaagcggccggagcccgcctacctcggccccctcagcttcccgggctggcaggcggctagaggcgtctgaggaaggtgcctaagtcctgggtcagatagtcatccctctgggacgccgccgccgctgccgccgtccagctgtggctccctcg

SEQ ID NO: 90048 - DNA, 693 bp, Homo sapiens
  chr3:120627318-120628011
  hyper
acagagacagagagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtc

SEQ ID NO: 90049 - DNA, 30 bp, Homo sapiens; identical to SEQ ID NO: 28305
  chr3:120628354-120628384
  hyper

SEQ ID NO: 90050 - DNA, 39 bp, Homo sapiens
  chr3:121265940-121265979
  hypo
aaataaaagagatctcgccggccgtggtggctcacgcct

SEQ ID NO: 90051 - DNA, 28 bp, Homo sapiens
  chr3:121280181-121280209
  hypo
atgcccagggttggccgggcgtggtggc

SEQ ID NO: 90052 - DNA, 30 bp, Homo sapiens; identical to SEQ ID NO: 39979
  chr3:121438641-121438671
  hypo

SEQ ID NO: 90053 - DNA, 95 bp, Homo sapiens
  chr3:121563924-121564019
  hypo
gaaaagctctgatgccgaaagaacaaagagtttgtggaataagtgactttacgtagtaaatcatagtataatgaaaaatgggatgggcgcggtgg

SEQ ID NO: 90054 - DNA, 269 bp, Homo sapiens
  chr3:121637808-121638077
  hypo
ggctcgctcagcctgcgactggactgggcatgtagcgagcagcttctgtgttgggtgcggcatctagacaaggggaacacggtggcgcccaaaaactcggagatgctagcaattgcagagtcctaagaggtgttatagctcctgctcagggagtcccaaggtctgagcccccagaaatgttacagctgttcactcctgtagttcaacgagcaggagcatgttacaactctctcctgtagtctagcgagcgggagcgtgttacggctctt

SEQ ID NO: 90055 - DNA, 223 bp, Homo sapiens; identical to SEQ ID NO: 28306
  chr3:121902727-121902950
  hyper

SEQ ID NO: 90056 - DNA, 229 bp, Homo sapiens; identical to SEQ ID NO: 309
  chr3:121902990-121903219
  hyper

SEQ ID NO: 90057 - DNA, 335 bp, Homo sapiens; identical to SEQ ID NO: 28308
  chr3:121903323-121903658
  hyper

SEQ ID NO: 90058 - DNA, 30 bp, Homo sapiens; identical to SEQ ID NO: 39982
  chr3:121980857-121980887
  hypo

SEQ ID NO: 90059 - DNA, 144 bp, Homo sapiens
  chr3:122100925-122101069
  hypo
gggattctaggcactcgattttaaacactcttttctggattttatttcaatttggaaataggatattttacagaagtactaaatctaatttttataatgaaaaaataagagttgcaaaaattttaaacactttaggccgggcgt

SEQ ID NO: 90060 - DNA, 26 bp, Homo sapiens
  chr3:122231241-122231267
  hypo
gtgaagaaacttctacgagaaccact

SEQ ID NO: 90061 - DNA, 35 bp, Homo sapiens
  chr3:122234211-122234246
  hypo
ccctttgcttgataacgtatgcgtagtatcaaaaa

SEQ ID NO: 90062 - DNA, 94 bp, Homo sapiens
  chr3:122234546-122234640
  hypo
ataataataacaataataataataataataatgaaactacatgaaacacatactcgttttactctcaactgctctcaaacgaaaacttggagca

SEQ ID NO: 90063 - DNA, 20 bp, Homo sapiens
  chr3:122279526-122279546
  hypo
ctggtcgaaatgatttctaa

SEQ ID NO: 90064 - DNA, 334 bp, Homo sapiens
  chr3:122296447-122296781
  hyper
cagagaaaagaagttcgaggcacaagcctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatggtgaggagcgcgggggacgggtgcgggaaggggacagcagggctgagcctggggcccgcaagacccagcagcccgagcggg

SEQ ID NO: 90065 - DNA, 22 bp, Homo sapiens
  chr3:122511767-122511789
  hypo
aactattcgctccttgaagcat

SEQ ID NO: 90066 - DNA, 25 bp, Homo sapiens
  chr3:122573648-122573673
  hypo
gactcaaaggctgggcgcggtggct

SEQ ID NO: 90067 - DNA, 158 bp, Homo sapiens
  chr3:122702275-122702433
  hypo
gcacaataaatcatccgcggggcggggacggggcggggtggtaaaaaaaacctataaagacacacgagaaagccaagctacttttgggggagcacagagaagcttctagaatggctgacagagtcctattacttgacttgggtgatgatgtaaagagc

SEQ ID NO: 90068 - DNA, 338 bp, Homo sapiens
  chr3:122745310-122745648
  hyper
aggagggggccagaacggcgctgcaggtgatcctcctccttgtttaaagtttgcggtgggcaaaggagtcggctccgttgggccgggttttctcgagcctcgccttcttcctccgccggtccggcgaccacttccctcttggctcccgccccgcgcgggtccccgatcccctctcccgtctgcatccctctctgtgcccgagcgccccccgctccctccctcctcgctggatctcccgcaggacgtgagcggaaagtgaatgggcagccccaaccacaaagacaaattaccatgagaaacataaatcgggaaatcgccgctcgcgtccctgcttccag

SEQ ID NO: 90069 - DNA, 242 bp, Homo sapiens
  chr3:122745939-122746181
  hyper
cgcacctctgtccctccgtccctcagcctcactcgtccgtctccttctccaggcctgggtcccgggtccccatcgccgctgcagcccagatgcgccgaccacagccctggcagggcccagtgcaacccggacccaagctggctggcggcgggaacgcagcagcgatgagggctctcaagccgaggtggcagcgggaggcgcggaagccaggggaccccctgtcctcccgcccgcagcctcac

SEQ ID NO: 90070 - DNA, 141 bp, Homo sapiens
  chr3:122746828-122746969
  hyper
gtgtggtgaccagcccggtgggccgaagccccttccccggccggcattccggcggcaagacctaggactccgagcacttgccgccgtttgccacatcccgccttgccgttctcggtcaccccatctcgaatgtgacatccc

SEQ ID NO: 90071 - DNA, 30 bp, Homo sapiens
  chr3:123123913-123123943
  hypo
agaggaaagagcctgcgacagctgctggaa

SEQ ID NO: 90072 - DNA, 64 bp, Homo sapiens
  chr3:123166942-123167006
  hyper
ctccgtcccgcccgccgaggcagccgccgccgccgagccgccgccgccgcccgcagggggcgcc

SEQ ID NO: 90073 - DNA, 802 bp, Homo sapiens
  chr3:123167300-123168102
  hyper
gcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttgcgggcggtgcctcctcgggccggcagtgcccgggcgcggcgctcgctgattccgcctaagcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggaggtgggatgggaggtggagaggacgggggagggggcgacgggcggagcaacagctccggagccccgggggggagggtcctggagcccgggggggccgttgcccgcatcccccacctc

SEQ ID NO: 90074 - DNA, 27 bp, Homo sapiens
  chr3:123168541-123168568
  hyper
gcgccatgcacgcttcgggccctgcgc

SEQ ID NO: 90075 - DNA, 327 bp, Homo sapiens
  chr3:123168581-123168908
  hyper
cgcgccgctcctcccttctcgcccgctcgccgccgccggagagccctccgcatcccctcctcccgctgcctccccgccccccgcgccgcccgggcctcggctcacagccgcgcgaggccgcctccgcccccggcctggccatggccccagcctcggcgccccgcgggcatcctcaggcctggccgcgggcaccccagttccccttcctcacctaaaattctcgctgcgcccctccctccctgggactaggagccgcatccagcctgcggtcccgtcaccagacctgggtggagcgcggtcttcccccgcccccggccagggctccag

SEQ ID NO: 90076 - DNA, 543 bp, Homo sapiens
  chr3:12329482-12330025
  hyper
gacaccggagaggggcgccacgccgccgtggccgcaggtcagagtacgggtgcccgcggcgctcgggaaccggctgctggctgggcggggagtgctcagggagggggcgcggagggctggggccgagggtctgggggctagggccgaggaaacgggaactgacggggtcccagacggatgagagctggggagaagggggtctcggctgaggggtccggggctgaggcagggtcatggtccggcaggacccggactgacgggtcgcgggcgggcggctcacgggtgaccgggtgaaggggtcttgggctgagggcacccgggctgagggtcgcgtctaccggagcgcgcactaggggcggagggcgcgggcacagagagccgcggccggtgccgactcgagtggacgcgagccggtgcgtcccggcttccaggacagcccccctcgggagagcgccgggtgggcgcggagccggggacacggggacctccgcgtccccggcggaggtgcgcaagcgtcgggagccgctccgggggaactttgga

SEQ ID NO: 90077 - DNA, 573 bp, Homo sapiens
  chr3:123602612-123603185
  hyper
gccaggtctggcactcgcgggccgccttccccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccagcccccacccagaactcccaccctcggagccttgacttccagggcccgcgcctggacaaaagcatggggcgggctcactcacccgcgcggcgaaggcggcccgggagccggggcaccggcgctcggcggggcgccccggccgcaggcgcacagcgcgggctccgagctcgctcagcgccctgctgccgaccgggcggcgcggggagcccgcgagg

SEQ ID NO: 90078 - DNA, 368 bp, Homo sapiens
  chr3:123603206-123603574
  hyper
cggggcggggcggggcggggcgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtcttggtgcgtgtcttagtccta

SEQ ID NO: 90079 - DNA, 188 bp, Homo sapiens
  chr3:123752385-123752573
  hyper
cccgccgcgcgcctccgcctgagggaggctcagcgtcctctgccccagccccgccgcccaacgcccgccctcgaagctccgcggccgccagctctgcggccgcagcagctgcgccccgcgccctccgcccaccgggcgccgagcagccctcggccccaggcttcttcggctcccggctgcccgcggac

SEQ ID NO: 90080 - DNA, 342 bp, Homo sapiens
  chr3:123752820-123753162
  hyper
tggcagtgctggctgcgtctggggagggcgtgggggctgggaactccgcgcccctccgccttcaccccagttgcgggagtctgtgttggggaggtgggaggcggtcccctcggaccgccttctcccagagcgcggggatgggcggtgttggctcactttgcagcgcgccgctccggctaccggcgtcccggcccctcccttggctccccctcccctgtgcctgtcagcggggctcccggcggccgccctgggtcggcacccctcctcgccgtcgggggcccggggccctgatgtgcacagaggggcggcggggacccggagccgcgccggctgcagactgac

SEQ ID NO: 90081 - DNA, 157 bp, Homo sapiens
  chr3:124606585-124606742
  hyper
gagggagagcaggtacgggggtcgtgccggtaccgcctcatcctcccaaagcctcactgccggcggcctgagatgggacgtagacgcccgcgcgtggaaccgcaaagcgacttctggatgagcaagggagggcgtggtggggcgtggaggcacaagt

SEQ ID NO: 90082 - DNA, 312 bp, Homo sapiens
  chr3:124773620-124773932
  hyper
gatggagaaagtgagcgcaaagagacagcagtcccaaggtcataatggtattatggttagaattccactcagtatgtggcatatttttccagatcataagaaagaactggacacaaaggtagcagggagaagaggtcagttccttctctctgcgtgggacaggcggtggctaccacggagcaacagttcattgggaaaggaaaggggagggaggaggctcagggatggtcctgtatcagcctgtgccttgcaggggttcaaccatgcaaccccaaccgcgttcctttgcttttaagtcgaaccagtagagcg

SEQ ID NO: 90083 - DNA, 30 bp, Homo sapiens
  chr3:124875073-124875103
  hypo
agtgagaaggcatttcgtcactgaatcatg

SEQ ID NO: 90084 - DNA, 230 bp, Homo sapiens
  chr3:125366752-125366982
  hypo
ggagctgaaaggagacgttaagagaaagggctgcaaacgtaggggtgttcaagacatcccctttgggggacaatgggaagctctcctttgtttcttcccaaaaagcctaagaatgtaaccctggaccaggggactagctacggaaatggataggaaagggcaggctcacaaagtgaggggaaagggaaaaaaaatcacaacattatcaaaaacatcgtagagggtggaca

SEQ ID NO: 90085 - DNA, 28 bp, Homo sapiens
  chr3:125434714-125434742
  hypo
cgcccctggatatgacgatggacatcgc

SEQ ID NO: 90086 - DNA, 39 bp, Homo sapiens; identical to SEQ ID NO: 14567
  chr3:125785793-125785832
  hypo

SEQ ID NO: 90087 - DNA, 30 bp, Homo sapiens; identical to SEQ ID NO: 14520
  chr3:12586227-12586257
  hypo

SEQ ID NO: 90088 - DNA, 978 bp, Homo sapiens
  chr3:125898647-125899625
  hyper
tcctaggcaagtgcccgcggggcctgagctctcgatagcggggccccaggagccacgttgtggggtctgctatccggcctccctctgcacgcgcgaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgcggtgagaaccgagtcctggagcccctggagcccccggagcccccggagctgcagccggggcagcctcctttccgccgggagtccagcgctctcgagagcccagaaactcaccgcgcgcaggagttggtgcgggcgtcccgggcaggttagacttctgtgagccgcagccccgaaactgaggttggtgcagacccgtcctgggagccaggaggtgggacctgtccccgccagtccgcgagctctggttaaggccagagcccgtgaggggaggggcgcggggcgggcggagagtcagccgagtgggggcggcgctcaccggtggtgggactatggcgggagcgcagcgcaccctctccgggcgggtctataaatgccatgtaaaagccaaccccgcaggggcctgcgctctttcccgctt

SEQ ID NO: 90089 - DNA, 66 bp, Homo sapiens
  chr3:125899826-125899892
  hyper
cagagcgaaaggagacgctgccctccgggaatttgcagccgcttgcagaggcggccccttagcagc

SEQ ID NO: 90090 - DNA, 54 bp, Homo sapiens
  chr3:125931966-125932020
  hyper
cctccccaccctccccgcgccttctcgggcctccgcgtccgccctgcgccctcg

SEQ ID NO: 90091 - DNA, 371 bp, Homo sapiens
  chr3:125932252-125932623
  hyper
cttttaactttttggcgtggagtgcgcgtcctgacgtgccccctgagctacagcttactgagctttactggcttcgccggacagccgtccccaggtggagagacagcgcgtcgcgcgctgcccgggccccgcagggcctggcgcctggggcccttgcgccgctttggggcgaggggatcacaccgcgggctcccggagcttagcgtcttccacgcggcgctgtgtgtcatccacgcagtgtgctctcgctgccgtgttcaggtcactgcgagggtgagccccgctttatctaccccttctgctgttgatgggcactcgtctggggctagaagggataaggttgctgtgagcgttctcgtgtgtttttggtg

SEQ ID NO: 90092 - DNA, 26 bp, Homo sapiens
  chr3:12596518-12596544
  hypo
gtggcatgggctgggcgcggtggctc

SEQ ID NO: 90093 - DNA, 231 bp, Homo sapiens
  chr3:125986509-125986740
  hyper
gtttgcagagcagcccggcccagccgcgcgcccgtggccggaggctccatttaccctccgcggagggcgctgtgcggcggcacttaagcggcagcttcctctctcccaggcggcctttgtggctgtggccgggacagggaaaagctgcccaggccaagagggcgggggcgtcaggggcagccagcgccgcctttgcgcaactgaagcggatgaagccgcctgctctcaggt

SEQ ID NO: 90094 - DNA, 470 bp, Homo sapiens
  chr3:126075183-126075653
  hyper
gtcacctccgagggccgtgggagaaaacagcccctctgtgccctccgtgagaggggggttccatgagtaacaccaaggcggggagggaagagtgaaccggaccaccatatgggatggggacggcctctctgccccgccgccgccatccctcggtcaggccatggctttggtaatgttcggtctgagcggacggggactcagcgtggagtgagacgcgtgaacggtgcgggtgtgcgtgaaggggtgtgagttcctgtcgtgtgactgcgtgtgcggggcgtggtgcgcggcagccgctgtggctgtgcgggaggctgtccgcgaaggactcgcgcgtggagccgccgtgggtgccggcgggtgaggggaaacgtgcgtgggaaatgaagagagccggctcagaccccttctagagtcctggaccgctgcccgctgggcaccatgccctcgtcccacgccccccccttgcc

SEQ ID NO: 90095 - DNA, 104 bp, Homo sapiens
  chr3:126075959-126076063
  hyper
ctcgcgcggtgcctccgagagctgcgcgggagcacggccacgcgccccgaggccggccagccctctgatcacccggggccgcgtccacgcggccggccggcccc

SEQ ID NO: 90096 - DNA, 114 bp, Homo sapiens
  chr3:126076540-126076654
  hyper
gccgctgtctcgcggcgtccacgagggccggcttctaaagctcggttcccaaggtgagaacgtgagactggcctgaagacttaagaaaagctctgagatcgccccaaagtgcag

SEQ ID NO: 90097 - DNA, 156 bp, Homo sapiens
  chr3:126108034-126108190
  hyper
accgcgccccgcctgcgagctaggaactgtggggacccggcagcgggcgagcgagcccaggtcgcggcagcactgcctgcgcggtcgtcttgacgcctgaccagggccggttttcaacttgtttacaagcctgcgtcaccgggaacctttcaccgc

SEQ ID NO: 90098 - DNA, 116 bp, Homo sapiens
  chr3:126108251-126108367
  hyper
cggcgcgctgacggtgcggggcgccacgccgtggcggatgcggacagcgcgcggccggttcgcccgtctgccccctagcgccctgctcttcccgccgagcgcgtagtctgcccata

SEQ ID NO: 90099 - DNA, 198 bp, Homo sapiens
  chr3:126113459-126113657
  hyper
cttcagtgcttggcacgtggcgaataaaccaatcaggatgaaaggagccaacccaagtgcggagtgttgaacctcagaggaagaaacccgcgttcaccaggcccaggcctgggccaggcgctgtcctggcggcgtcagggaggacatcgtgcccagagctcggacccagcagcccggccccgcgccctccctgtcccg

SEQ ID NO: 90100 - DNA, 165 bp, Homo sapiens
  chr3:126113794-126113959
  hyper
cggagcgagccggggcagtcggggtcggtgggtgcgctcgcggtccggggagagggggcgcgcggggtccgtgagggcgcgtgggggcggcggcaggggtgcgaaaccagggcccgaggggcgcgcgtggccgggagcggacttgcaaggcgccttccaaggctg

SEQ ID NO: 90101 - DNA, 126 bp, Homo sapiens
  chr3:126134579-126134705
  hypo
acagcaagagggacacggggcggggtcggggtgtggggaggtgagtcctgccttcctgctcctccgaaagttttctcccaagggagggctggctcgaagccacccccaggccgcacaggagctgga

SEQ ID NO: 90102 - DNA, 51 bp, Homo sapiens
  chr3:126138969-126139020
  hypo
ggaggtttctgcagacgatgcggctggggcggagcccgtcttacctgagca

SEQ ID NO: 90103 - DNA, 167 bp, Homo sapiens; identical to SEQ ID NO: 39993
  chr3:126195886-126196053
  hypo

SEQ ID NO: 90104 - DNA, 30 bp, Homo sapiens
  chr3:126228677-126228707
  hypo
ggctgagggaggtggcgttcaggccccaac

SEQ ID NO: 90105 - DNA, 197 bp, Homo sapiens
  chr3:126242861-126243058
  hyper
ggcggggcccagaggcgaggggcttccccaatcagtctccgccctagcgccctggacttcggccccattccattgggtgagggtgggggcacgaaaagaggagcgggcttgcggccccaccgtgtcccgcctcctcagtccccagcgactcgcaggggctggtggggctggggtccagctgccgtgctcccctgccc

SEQ ID NO: 90106 - DNA, 76 bp, Homo sapiens
  chr3:126243385-126243461
  hyper
tggggctaggggtggcgggcaggggcgctggtgaggcacagaaaggctctagacgcccccgcgagcaaaggctctt

SEQ ID NO: 90107 - DNA, 34 bp, Homo sapiens
  chr3:126271443-126271477
  hypo
cgtccccacctccctcgagcgtggctgccctggt

SEQ ID NO: 90108 - DNA, 69 bp, Homo sapiens
  chr3:126373464-126373533
  hyper
gacggctgacctcaccgccgcagcccgggacccgcgggcgccccggcccggacccgccctgccccgggt

SEQ ID NO: 90109 - DNA, 72 bp, Homo sapiens; identical to SEQ ID NO: 28334
  chr3:126373752-126373824
  hyper

SEQ ID NO: 90110 - DNA, 21 bp, Homo sapiens
  chr3:126374476-126374497
  hypo
agtgactgagttagccggtca

SEQ ID NO: 90111 - DNA, 102 bp, Homo sapiens
  chr3:12673087-12673189
  hypo
actccatctcaaaaacaaaacaaaacaaaacacaattgttcagtagtgtttgtaaagcacttagcattgcacctaacacagagtaaacgatactgttatagc

SEQ ID NO: 90112 - DNA, 250 bp, Homo sapiens
  chr3:126756255-126756505
  hypo
gctgggaagcaggggcggccgcaggagtgcagccacatcccaaacacggaagcatatctccctgggagactcagccacacccaggacagatggccacactctgtgagttgggtgcgctcagcccaggtgacacattggagcccttggcggagactaaaacaccagtgcctgacccccactggagccttggagcttcaggggtctgagcggtggtcacttttagatgcttcccaggcgattctcccgtgac

SEQ ID NO: 90113 - DNA, 30 bp, Homo sapiens
  chr3:126848530-126848560
  hypo
ggtgctccagtttggcgccaccagcgctct

SEQ ID NO: 90114 - DNA, 30 bp, Homo sapiens
  chr3:126853082-126853112
  hypo
ccttgctcctgtctgcgtggtgctccttct

SEQ ID NO: 90115 - DNA, 89 bp, Homo sapiens
  chr3:126854032-126854121
  hypo
gtcctgctgtgcccccgggctgggcatctgtatgtggtgtggtggctagccgtgcatggtcatgtctggccccacgcgtggccccggag

SEQ ID NO: 90116 - DNA, 80 bp, Homo sapiens; identical to SEQ ID NO: 28335
  chr3:126854425-126854505
  hyper

SEQ ID NO: 90117 - DNA, 311 bp, Homo sapiens
  chr3:126854536-126854847
  hyper
cgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctccaggccatcgcagcccccggccctgccacgcaccggcgcagcccctgcactcgggcggccctgcctcggcgggatgagttcgtccgaggtgcatacaagatgagaaacagagcgccgggttgcagtgccaggcaccgagctgggctcccc

SEQ ID NO: 90118 - DNA, 86 bp, Homo sapiens
  chr3:127176157-127176243
  hyper
gggaacgggctgcatcgcggagaggaggtgcgaagcagcgcgccgtttccgggctctggaagccgagctgccgaggcgtaagctgg

SEQ ID NO: 90119 - DNA, 30 bp, Homo sapiens
  chr3:127177694-127177724
  hyper
cctctttcaggaccacggagagctccttgg

SEQ ID NO: 90120 - DNA, 30 bp, Homo sapiens
  chr3:127258523-127258553
  hypo
agggcagaagacccacgatgcacagccagc

SEQ ID NO: 90121 - DNA, 46 bp, Homo sapiens
  chr3:127268781-127268827
  hypo
ctcacagttccaccacgggaggcactgctgccgtttgtaatcatga

SEQ ID NO: 90122 - DNA, 233 bp, Homo sapiens
  chr3:127318268-127318501
  hypo
acctccagccctggccgtgaccttccaccatttgaggatgagtccgaggggctcctaggcacagaggggcccctggaggaagaagaggatggagaggagctcattggagatggcatggaaaggtaatttcattcaaggccctggactcagcagatagttttgcagagagcccattgtgtgcctggtggcctggctttgggagctgggagcagatgaatcgatggcattcttgc

SEQ ID NO: 90123 - DNA, 263 bp, Homo sapiens
  chr3:127347860-127348123
  hyper
ggacgggcggagggacggccgcccgcgcgtccgcttcgtctccgcgggggcgcgcccgcggcacgcggccgggcggggccgggcgtgagtgacggccatgcggaccaatggggcgggcgcgcgccgccgccgccgcccgcgcggcccctgacgcgggcccgggcgccgcgccgctgcggctgcaggcggcgacggctacaccatgggccggctgctgcgggccgcccggctgccgccgctgctttcgccgctgctgcttctgc

SEQ ID NO: 90124 - DNA, 146 bp, Homo sapiens
  chr3:127390301-127390447
  hypo
ccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctc

SEQ ID NO: 90125 - DNA, 77 bp, Homo sapiens; identical to SEQ ID NO: 39994
  chr3:127394832-127394909
  hypo

SEQ ID NO: 90126 - DNA, 85 bp, Homo sapiens
  chr3:127395891-127395976
  hypo
cctggaggccaagtgcgagaaggtgtctgagtttggtgcgagcagggtttggggcccggggccatgggtgcggcctggcagggct

SEQ ID NO: 90127 - DNA, 30 bp, Homo sapiens
  chr3:127505428-127505458
  hypo
tcgagatgaacaagccgcagagcctctcag

SEQ ID NO: 90128 - DNA, 68 bp, Homo sapiens; identical to SEQ ID NO: 39996
  chr3:127534964-127535032
  hypo

SEQ ID NO: 90129 - DNA, 136 bp, Homo sapiens
  chr3:127536709-127536845
  hypo
caagagcccacaaagcggcttgcccccatccatgggccagtctccatcgccgtgctgatagcatcagtggacatttgctcatgatccagtatccccccctttttctttttttgagatggagtcttgctctgtcacc

SEQ ID NO: 90130 - DNA, 30 bp, Homo sapiens
  chr3:127570998-127571028
  hypo
aatcatccactctcacggagctggatggga

SEQ ID NO: 90131 - DNA, 41 bp, Homo sapiens
  chr3:127633909-127633950
  hyper
agtgtaaaagactaacgggaacaccggcatttttcaaagct

SEQ ID NO: 90132 - DNA, 218 bp, Homo sapiens
  chr3:127634094-127634312
  hyper
cggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcaca

SEQ ID NO: 90133 - DNA, 52 bp, Homo sapiens; identical to SEQ ID NO: 39998
  chr3:127637657-127637709
  hypo

SEQ ID NO: 90134 - DNA, 43 bp, Homo sapiens
  chr3:127731040-127731083
  hypo
aaaaaaaaaaggacctaaaaatccccctcgcctagtgacgtca

SEQ ID NO: 90135 - DNA, 467 bp, Homo sapiens
  chr3:127794393-127794860
  hyper
ttcctccctgcctgccgggacttcaacctcgcttgctgggaagtcgcgcactttcgtcgcgacttcccaagtcgtgctgggtgtgacttggaatctcggatccctgggctaggcctggccacgcccccatggggggaggggcagcgcggcgggggcggagcctgggcccgaaacgccacgggcgcgactctgtgcgcgtccgcccacacgggggcgctgtgtcctcgcaagctcccgcggggtgcctcgcggccctggaacgctgtggttttcgaggggaaaagtgagagtggctggtcctgcctccgctgccgcttggccctgagatccccactgcccacgggataggccccagtccacccagccggggccccccccttcccctcgtctcgctctccttggcagttcggacttcgggtcagtcccacactcgcgcccggctgtccctgctgcgctcctgtcactgg

SEQ ID NO: 90136 - DNA, 15 bp, Homo sapiens
  chr3:127795148-127795163
  hyper
cccaacagcatgacc

SEQ ID NO: 90137 - DNA, 90 bp, Homo sapiens
  chr3:128102325-128102415
  hypo
atgaggagactaaggcgcagagaggtcacatgtcttttgtgaaggcacgcagctgatctgcgcctggactagggtcgggatcttggtggt

SEQ ID NO: 90138 - DNA, 38 bp, Homo sapiens
  chr3:128145121-128145159
  hyper
tcctctctgagcttccgctttcccgtctgtaaaaccgg

SEQ ID NO: 90139 - DNA, 33 bp, Homo sapiens
  chr3:128152132-128152165
  hyper
gctcctccctccccccggcgccaggtgacccac

SEQ ID NO: 90140 - DNA, 359 bp, Homo sapiens
  chr3:128202349-128202708
  hyper
cggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtct

SEQ ID NO: 90141 - DNA, 30 bp, Homo sapiens
  chr3:128205103-128205133
  hyper
ggtggtgggccgcagcggcagagagggctg

SEQ ID NO: 90142 - DNA, 1961 bp, Homo sapiens
  chr3:128205402-128207363
  hyper
tagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagcggggttggcatagtaggggttgccctgcgagtcgaggtgattgaagaagacgtccacctcgtctggaggcagcagctgcgcgggttccatgtagttgtgcgccaggcccgggtggtgtgagtcggggtgctgcgcattcagcacggccgggtgcgccatccagcgcggctgctcgggcgccacctccatggccggcggcggcggctcagggtctgggtgcagacggcaacggccctgcgcgaggaagggggagtgaggcgtgccgccagcgcctgacaccccccaaagtcccaccacgaggtgtcccgcacgccacggagccccagcccagatccggcgagaaagagcaccagtcccgggtgggaggaaagcccaaggctcaaaacgaaaggaaggcgggggagggggttcagccacgcacactcacgtggtgacccgcggctccagaatcacacacccgtgcacatggggtcacgcccggggacgggtcccgacaccagtgaccccaacaaacgcacagagcagcacttcagtcagacactcacactgagcccccccgcccggtagacaaacacatgaacacagactcaaaagttggagacaggcgcccgggcacccagtgtggcacttgatcccagcgacacgcacacacccacacttggcgccagatacacatactgatctcaaccccgaaaacatgcacacgcagccccctgagcgcagtactaagcggcacaatcaggacctctcaacaaagcacaccaaagcagtcgcccgcagcctggccccccgccctaagtccccccagagtcccctcaaagctaggagcgccccaggcccccagccggctctcaaaccccaaacttacacacgcagccgtggggaggggagggactcggcctctgagagtgaaggagttccggcgggagccccgagggcgacgggcccagggacagcacgtccggaggctggcggggcttacagggtaggagctgggggtagagtgcgcctcggcctcgggccctcccggctccggcccctcggcatcctccggccgccctggcgccagctgccgactcctgcacagacatgaagcgggggccgcgcacgcctaagaagcccaagccagccaatcaacgccgcgcgcctcccagcctccgcctcccattggctgcgtccgcaattcccgaaccgctggactccgggactgacccgcgggccggcccccctcagccggcgggccccctccctgcgcgctcctggcggcccctgctgccaacgcgccccaccactaagggaccctcaccccaaggcccgacccctgcagcccctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctagctcgggcgctgtctgggtggactgggggttgggatggttcggacgacagcggcggaacagcaggagccgagaggggcagagaggggcaggaactacagggctctagagggcacctgggcctcggacacgcggccgctcagggctgtgc

SEQ ID NO: 90143 - DNA, 1633 bp, Homo sapiens
  chr3:128207713-128209346
  hyper
ggggagacggaggctcgaagggagccccgggccgaggagggaggtccaggacaaaggcattttgggggacctagacaggtgccgagtactggggggactcaacagcgtcctccagccctcttccctgttgggcccgaggctcccggggtagatgtccagagggcccccaggtgggtcgggggcaggaggagggctggggtcccggccacccccgggagagtgggggaggggcggcgggattgacagtcggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgac

SEQ ID NO: 90144 - DNA, 15 bp, Homo sapiens
  chr3:128216698-128216713
  hyper
cgggattagctcatc

SEQ ID NO: 90145 - DNA, 220 bp, Homo sapiens; identical to SEQ ID NO: 2255
  chr3:128273832-128274052
  hyper

SEQ ID NO: 90146 - DNA, 347 bp, Homo sapiens; identical to SEQ ID NO: 2256
  chr3:128274308-128274655
  hyper

SEQ ID NO: 90147 - DNA, 30 bp, Homo sapiens
  chr3:128279869-128279899
  hypo
tcccacggggtccaccgagggctatgccga

SEQ ID NO: 90148 - DNA, 30 bp, Homo sapiens
  chr3:128297409-128297439
  hypo
cactcagtcctcaggcggtgacctcacctt

SEQ ID NO: 90149 - DNA, 95 bp, Homo sapiens
  chr3:128326970-128327065
  hyper
cgcggggtaacagcccgttccggagccggtcatcaggcgccaagccccgctgggctcctcgcagccgcgggacctttctccgcccttcccgaggc

SEQ ID NO: 90150 - DNA, 141 bp, Homo sapiens
  chr3:128327456-128327597
  hyper
ttgccaaggagctgtcgctggagcggtgactttgttcagggccgagaaccggaggaggaggccagacttgctgctgggcagctggcacatgggacatggggtgttatgactccagcatttatggagcgcctgctgtgtgct

SEQ ID NO: 90151 - DNA, 35 bp, Homo sapiens
  chr3:128343672-128343707
  hypo
atctcaaaaaaaaaaacacacgctgtgcctgtcat

SEQ ID NO: 90152 - DNA, 30 bp, Homo sapiens; identical to SEQ ID NO: 39999
  chr3:128346689-128346719
  hypo

SEQ ID NO: 90153 - DNA, 240 bp, Homo sapiens
  chr3:12837883-12838123
  hyper
gactctatgatattacgtccatgccgcaagacagagctggcacctacgggaataacaaggaggtggtggcagggtagtgagctccccgtctctgggggtgtgtgcaatccggcgctgcgctgtcagcagggcaagggctggggccggggccaagaccaccaagccaggcccaggcccgcccgcctcccgcggccgccacggccaaggcgtgagcacggggcggggcgggagctgctattt

SEQ ID NO: 90154 - DNA, 573 bp, Homo sapiens
  chr3:128417048-128417621
  hyper
atttttaaaaattgctggaagaacgcccttccccgctcccgcctcggtgacaaacaggcttcccagggcccagaaggctgtacgcagacgccaccaccctggcccctgcactcctgcgtgagcgacttccattcgggacggctcagccgcccgctaccgcagccttcccgcctgggtctcccacaggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacccggggttctggccccctcctcccccaggacctcagcgcggcaccccacccaccaccccccgcccccaacccaggccagctgtctctttttcctcaggggtcgggctcccagcctctgccctccacaaccacccgcctgcctcaccagggcccagcctggcccctgggagcggccacagcgccga

SEQ ID NO: 90155 - DNA, 82 bp, Homo sapiens
  chr3:12851610-12851692
  hyper
cacagctgagcagcccgcgcctggcggtgcgcaagcgggcggtcggagcgcttggccacctggcggccgcctgcagcaccga

SEQ ID NO: 90156 - DNA, 81 bp, Homo sapiens
  chr3:128599545-128599626
  hypo
agccttaaaatggagatagtgttgtgtctccttcacagatgtgttgtagagccccagtgagataaacggtgcatggagagt

SEQ ID NO: 90157 - DNA, 34 bp, Homo sapiens; identical to SEQ ID NO: 40001
  chr3:128611894-128611928
  hypo

SEQ ID NO: 90158 - DNA, 30 bp, Homo sapiens
  chr3:128653973-128654003
  hypo
agagcctggaagacccgcctccgctcagtg

SEQ ID NO: 90159 - DNA, 382 bp, Homo sapiens
  chr3:12867117-12867499
  hypo
cggcgggacctcatccgagaggtgtggagcagagctggggacccaggggaagctgggggtgatgccacctctcatgcctcactgttagggcattattatctcatcagagcaggtgccggggccacatggcctgggtcaagtcctgccctgactccgagctgtgggaccccagccagggcaacctgatcctctctgagcctcagtttctcctcgtgagcacatgagggtgctaattgtgtctgcgtcatagggttgctgcaacaatttggtgagtgaggtcctgtaagtgttcagaaccaccgcaggcacacagccagcgctcagtaaatgttgatgtttgacaggtgttcactgaacatctgcactgcgcccaagtgccagg

SEQ ID NO: 90160 - DNA, 36 bp, Homo sapiens
  chr3:12870958-12870994
  hypo
ttaaaaaatatgtactgtaagcgtgagtcacttttt

SEQ ID NO: 90161 - DNA, 82 bp, Homo sapiens; identical to SEQ ID NO: 28355
  chr3:128720061-128720143
  hyper

SEQ ID NO: 90162 - DNA, 184 bp, Homo sapiens; identical to SEQ ID NO: 2257
  chr3:128720163-128720347
  hyper

SEQ ID NO: 90163 - DNA, 116 bp, Homo sapiens; identical to SEQ ID NO: 2258
  chr3:128720418-128720534
  hyper

SEQ ID NO: 90164 - DNA, 318 bp, Homo sapiens; identical to SEQ ID NO: 28358
  chr3:128720566-128720884
  hyper

SEQ ID NO: 90165 - DNA, 430 bp, Homo sapiens; identical to SEQ ID NO: 2261
  chr3:128720885-128721315
  hyper

SEQ ID NO: 90166 - DNA, 78 bp, Homo sapiens
  chr3:128733875-128733953
  hypo
gctccatcagaaccacggaccacacagcatcaggttaatcttttcaacacccagatcccacctcgggctcgcccactc

SEQ ID NO: 90167 - DNA, 86 bp, Homo sapiens
  chr3:128746467-128746553
  hypo
aggaagtccactcagcgagtccatgtaaaacatgtaaaatggggactcagggcgggtgcggtggtccacgcctgtaatctcagcac

SEQ ID NO: 90168 - DNA, 118 bp, Homo sapiens; identical to SEQ ID NO: 28360
  chr3:128764489-128764607
  hyper

SEQ ID NO: 90169 - DNA, 70 bp, Homo sapiens
  chr3:128764836-128764906
  hyper
cggggtccaggaatacagcccgaaccccaagaatacaacccgaaccccaagagtacgtgcccctcagaga

SEQ ID NO: 90170 - DNA, 68 bp, Homo sapiens
  chr3:128765883-128765951
  hypo
aggacatctgagcaacgggtgtctgggttgcctgctctggaggcccctctgtgcggccagcttcgtcc

SEQ ID NO: 90171 - DNA, 30 bp, Homo sapiens
  chr3:128766505-128766535
  hypo
actgaggtgtgcacccggctgctctccacg

SEQ ID NO: 90172 - DNA, 30 bp, Homo sapiens
  chr3:128785960-128785990
  hypo
ccctatgcacctgtgcggctatttctctag

SEQ ID NO: 90173 - DNA, 41 bp, Homo sapiens; identical to SEQ ID NO: 40003
  chr3:128790177-128790218
  hypo

SEQ ID NO: 90174 - DNA, 30 bp, Homo sapiens
  chr3:129047343-129047373
  hypo
aggtctgaagatggtcggcatcagtgttcg

SEQ ID NO: 90175 - DNA, 33 bp, Homo sapiens
  chr3:129047805-129047838
  hypo
cttttttcgagacaacggagtcttgttctgtcg

SEQ ID NO: 90176 - DNA, 32 bp, Homo sapiens
  chr3:129048078-129048110
  hypo
gcatgagccactgcacccggccaaactgctca

SEQ ID NO: 90177 - DNA, 178 bp, Homo sapiens
  chr3:129085333-129085511
  hypo
gctgcttccttggggcgttggtttgagtgtgactcttgcccaccctgctgactttgaaccggcccctggtcagggctgaccctactggggggctcggtccagctgtgctgcctggcttcagatgtggcctccctgtcccagggcacccccccggggcactccacggtggggcagcgag

SEQ ID NO: 90178 - DNA, 16 bp, Homo sapiens
  chr3:129090469-129090485
  hypo
acgttcatgcagtcct

SEQ ID NO: 90179 - DNA, 30 bp, Homo sapiens
  chr3:129103767-129103797
  hypo
gcttcttctttggctcgagagtctcccaag

SEQ ID NO: 90180 - DNA, 36 bp, Homo sapiens
  chr3:12915182-12915218
  hypo
catcccaggctgcaccgcacccgcccagccacttcc

SEQ ID NO: 90181 - DNA, 170 bp, Homo sapiens
  chr3:12917547-12917717
  hyper
accctgtggacccagcggagagggcccgggtgagggctctggaggcgctgagcagggccgggagccacgggacccgcagagggcgcccgtccgcgtgggggcagcagcgtctggagggaggtggccccggccgccctcagaaatcaggctcagcccgggggtccctggct

SEQ ID NO: 90182 - DNA, 30 bp, Homo sapiens
  chr3:129221988-129222018
  hypo
atgttagtgtgaacacgacagctccagtgc

SEQ ID NO: 90183 - DNA, 30 bp, Homo sapiens
  chr3:129240328-129240358
  hypo
tgcccactggagggacgcagacactgagac

SEQ ID NO: 90184 - DNA, 30 bp, Homo sapiens
  chr3:129240597-129240627
  hypo
taggatttccattagcgcatgacttcaact

SEQ ID NO: 90185 - DNA, 30 bp, Homo sapiens
  chr3:129324172-129324202
  hyper
tggatgttgagcttgcgctcacaggccggt

SEQ ID NO: 90186 - DNA, 92 bp, Homo sapiens; identical to SEQ ID NO: 28362
  chr3:129324567-129324659
  hyper

SEQ ID NO: 90187 - DNA, 152 bp, Homo sapiens
  chr3:129324893-129325045
  hyper
gcagaactagccccacggtggacgcgttcgggtggttggccgccacgttcagcatgctggggaacaccgtgacgggctcggcgggcggcgcggcgggcgggaagcgcacggccacggccgagatgttgccccggcgccgcagctggcagaag

SEQ ID NO: 90188 - DNA, 126 bp, Homo sapiens
  chr3:129346438-129346564
  hyper
ctctgggaggctatgcgccggcaagaagcagcggggtggaggcagccctgcgggagtcggcgagggccgcgtggatgtgctcggtggttttgaggccagtggctggaggggcgtgagagtgggaga

SEQ ID NO: 90189 - DNA, 163 bp, Homo sapiens
  chr3:129626946-129627109
  hypo
tgagcaacagagcagactccatcttggggaaagaaagaaaaaaaaaaagaactatacatctaccaaaagcttcagttaaatgtttgggtatattgaaaacacactggatataaatttgaaaccactgttaaacgtgtgacaggaaaatcgagttgagactgcc

SEQ ID NO: 90190 - DNA, 129 bp, Homo sapiens; identical to SEQ ID NO: 28365
  chr3:129693071-129693200
  hyper

SEQ ID NO: 90191 - DNA, 195 bp, Homo sapiens; identical to SEQ ID NO: 312
  chr3:129693304-129693499
  hyper

SEQ ID NO: 90192 - DNA, 345 bp, Homo sapiens; identical to SEQ ID NO: 28367
  chr3:129693954-129694299
  hyper

SEQ ID NO: 90193 - DNA, 30 bp, Homo sapiens
  chr3:12977045-12977075
  hypo
ggtctgcttgctgagcgtctgctcccgcag

SEQ ID NO: 90194 - DNA, 71 bp, Homo sapiens
  chr3:129983032-129983103
  hypo
ctcctggcagcccctcggccgcggaaggcacaagtcctcttcgccatcgtggccagcgagacaagtagctg

SEQ ID NO: 90195 - DNA, 159 bp, Homo sapiens; identical to SEQ ID NO: 6976
  chr3:130064451-130064610
  hyper

SEQ ID NO: 90196 - DNA, 68 bp, Homo sapiens
  chr3:130064780-130064848
  hyper
cggtttccagggtccggagtgtcccctgaccccgggaaagctgggtaagtatgcggtgcggggacttg

SEQ ID NO: 90197 - DNA, 85 bp, Homo sapiens
  chr3:13008938-13009023
  hyper
gcaggcaccacatggcggccgcagtgggagcgggccgggccgggagccgggacccaggcccagcagaggccgccgactcccgcca

SEQ ID NO: 90198 - DNA, 162 bp, Homo sapiens
  chr3:13009525-13009687
  hyper
ggaaggaggactttgcgcagcccctccaacactggcgcctcccgggagccatgtcttcctctccagcgtgtaaccacaacaaatgcacagcgccaaacccccaaccagagcctactccgctgatgcctactcaacatctgcctatcccgattttgccttcag

SEQ ID NO: 90199 - DNA, 42 bp, Homo sapiens
  chr3:13021222-13021264
  hypo
atgtcatcagaagggcggaaagagcaccggaaggagaactct

SEQ ID NO: 90200 - DNA, 88 bp, Homo sapiens
  chr3:130235499-130235587
  hyper
tggggaggtagggggcgttgagggtgggatgaggtggtggctctggaccttaatctcacggtcttcgttcccacggaaaagggaggag

SEQ ID NO: 90201 - DNA, 271 bp, Homo sapiens; identical to SEQ ID NO: 28371
  chr3:130235793-130236064
  hyper

SEQ ID NO: 90202 - DNA, 30 bp, Homo sapiens
  chr3:130236173-130236203
  hyper
cgtccagaggaaatccgccccgggctttcg

SEQ ID NO: 90203 - DNA, 30 bp, Homo sapiens
  chr3:13028860-13028890
  hypo
ctcaccaaatggtgccgggccacctgggaa

SEQ ID NO: 90204 - DNA, 34 bp, Homo sapiens
  chr3:130323372-130323406
  hypo
aacaaaggtgctatgcgatcgtttctagagatat

SEQ ID NO: 90205 - DNA, 28 bp, Homo sapiens
  chr3:130341407-130341435
  hypo
atacagactttgagccgggcgtggtggc

SEQ ID NO: 90206 - DNA, 227 bp, Homo sapiens
  chr3:130474409-130474636
  hypo
tagcagtaacatagtcgtttattgtcattaccaagtattctgtattgtgcatagttgtatgtgctagactgttatatgactggcaatgcaggttattttgcaccagcatcaccacaaacaggtgagcaatagaaatttttcagctccattataatcttatgggacgttgtatatgtggtccatcattgaacacatttttatgcggccattggcggtacttgtttttc

SEQ ID NO: 90207 - DNA, 35 bp, Homo sapiens
  chr3:130492203-130492238
  hypo
tagtggagacggggtttcaccgtgttacagatctc

SEQ ID NO: 90208 - DNA, 39 bp, Homo sapiens; identical to SEQ ID NO: 40006
  chr3:130519901-130519940
  hypo

SEQ ID NO: 90209 - DNA, 46 bp, Homo sapiens
  chr3:13083152-13083198
  hypo
ctcggaagaacctgccggaggtatgaacattcgggcttgtggtgcc

SEQ ID NO: 90210 - DNA, 120 bp, Homo sapiens
  chr3:13083986-13084106
  hypo
tcacatggcccagcccgcccggcgcagcttgtacagtacacgcctccaatacaaagagcagccagcacaaaagcctagcaactcattcacgcagctcgcctggcccggctcatgctgctg

SEQ ID NO: 90211 - DNA, 61 bp, Homo sapiens
  chr3:13096348-13096409
  hypo
gaagccacatgaccccgcctgagcctcagtttcctcatttgtaaaacggggctgatcagag

SEQ ID NO: 90212 - DNA, 33 bp, Homo sapiens
  chr3:131081158-131081191
  hyper
ctaccgcagctctcacgccggatcaaggccacg

SEQ ID NO: 90213 - DNA, 40 bp, Homo sapiens
  chr3:131447460-131447500
  hypo
attggattgtgtggccgggcgcagtggctcacgcctataa

SEQ ID NO: 90214 - DNA, 21 bp, Homo sapiens
  chr3:131593216-131593237
  hypo
ccaccgcgcctggcctcagtt

SEQ ID NO: 90215 - DNA, 198 bp, Homo sapiens
  chr3:131752588-131752786
  hyper
tagcctgctcctcaccggatggtaatcagcactcgcttgacttggcgtggaccacctcctaattatctccattggattcagccctaacagttctcgtgtgtctgtgataccacgcggggtcgtgatctccttactcagctgtggcttggtttcagtggtccctccagtcccgtcccctgtccccgtccccctttcctt

SEQ ID NO: 90216 - DNA, 101 bp, Homo sapiens
  chr3:131753055-131753156
  hyper
cccgattttgaaaaccgtaccccttcttccgccttcgggacttccctgacctatccctcacccgtgccatgctgtcccctcccctccgcggtctttctccc

SEQ ID NO: 90217 - DNA, 180 bp, Homo sapiens
  chr3:131753972-131754152
  hyper
ccgcccaggccttggcggcggcgctctccgtggtcctgccgcgcccgcagtctgggctttctgctcagctttgtcgctcaactgagctcctggggacacttgatttagatctccaagtgcttggtctccatctccactctagggtggagcggtcgtatcgcggcgcgggtgtggggggaa

SEQ ID NO: 90218 - DNA, 30 bp, Homo sapiens
  chr3:13177731-13177761
  hypo
acaactgcgtgtccacgtgggaaatgaagg

SEQ ID NO: 90219 - DNA, 256 bp, Homo sapiens
  chr3:132440027-132440283
  hypo
ttgggattacaggcgtgagccaccacgcccggctgctttacatactattttattgaattataatggacctgctacatggagggcatgcaataattgcttttagcgtaaattaatcaaatggactagggaaatttgactacatctagagaaggttttcaaccatggtgagatcaggaggcttccagaaattttcatgtcaagaccattaaaatgcaagagcgatgaaactttacaaagaaaccgacacttgagcccc

SEQ ID NO: 90220 - DNA, 30 bp, Homo sapiens
  chr3:132502767-132502797
  hypo
ggactgagaatttgccgttctaacaagttc

SEQ ID NO: 90221 - DNA, 165 bp, Homo sapiens
  chr3:132756312-132756477
  hypo
tgactgttagcttcccggatgttttctccacatgcttctttctgaactagcctgtatagttctacaacaaattgttacgttttgagaagcagggaccacttataccacttctctggccaagtgtctggcaccgcgccactcagacacacacgcccaaccctttag

SEQ ID NO: 90222 - DNA, 510 bp, Homo sapiens
  chr3:132756970-132757480
  hyper
gagaccctttgtgcccgcctcgcacccgctctgctaggtagcaaccgaacccccagagacatcggagcgggcgctgccgagggcaatttggtgattggctggtctcaccacgtgaccggcgctgagccttccgtgcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtga

SEQ ID NO: 90223 - DNA, 372 bp, Homo sapiens; identical to SEQ ID NO: 28376
  chr3:132757536-132757908
  hyper

SEQ ID NO: 90224 - DNA, 30 bp, Homo sapiens; identical to SEQ ID NO: 40007
  chr3:133101687-133101717
  hypo

SEQ ID NO: 90225 - DNA, 135 bp, Homo sapiens
  chr3:133217920-133218055
  hypo
aggcatgagccaccgtgcccggcctgttctatgtgttcttatagtgcaaagcatttgtggaaaacgtgcccttgttagagagttatgttcttctgtactggtatctttgtatgccttttgcgttctaatcattta

SEQ ID NO: 90226 - DNA, 606 bp, Homo sapiens
  chr3:13323423-13324029
  hyper
cctgccccagatgggcgcccgaaggtccacacggtgaggctgctccgggtttcgacaccgacactcatgggaggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctggg

SEQ ID NO: 90227 - DNA, 114 bp, Homo sapiens; identical to SEQ ID NO: 2205
  chr3:13324234-13324348
  hyper

SEQ ID NO: 90228 - DNA, 255 bp, Homo sapiens; identical to SEQ ID NO: 28075
  chr3:13324419-13324674
  hyper

SEQ ID NO: 90229 - DNA, 202 bp, Homo sapiens
  chr3:13324740-13324942
  hyper
gaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcggacgattttaggaaaag

SEQ ID NO: 90230 - DNA, 22 bp, Homo sapiens
  chr3:133332636-133332658
  hypo
tttttttttttgagacggagtc

SEQ ID NO: 90231 - DNA, 30 bp, Homo sapiens
  chr3:133545624-133545654
  hypo
tttcttatttcaacacgttgcagtactttt

SEQ ID NO: 90232 - DNA, 42 bp, Homo sapiens
  chr3:133556962-133557004
  hypo
caccgtgccgggccccgtgccgggccccgtgccaggtgtgtc

SEQ ID NO: 90233 - DNA, 30 bp, Homo sapiens
  chr3:133560299-133560329
  hypo
ggggactgggagagccgggctctgcaatgc

SEQ ID NO: 90234 - DNA, 68 bp, Homo sapiens
  chr3:13357887-13357955
  hypo
tgaagggagcttgtgcgggatcccgtcatcctggactctccacacagcgtccacgcatggatggccat

SEQ ID NO: 90235 - DNA, 72 bp, Homo sapiens
  chr3:13359589-13359661
  hypo
aatgcaatgcagcctcgggcaagagcgccacaggaacaaagaccccgaggggagcagcgattctgcagtgct

SEQ ID NO: 90236 - DNA, 245 bp, Homo sapiens
  chr3:133613668-133613913
  hyper
agcagagacaggtgtcgctcttttctccccggtggctgtttgtcccacgccctggacgtgccctttcgcatggttcccagcagggtccgcagggaacacccctccagtgcagcggagtgaggcccggccagaccccagcttcgcttcgttctccaaggggggcgcccgtcgctctccccacccccgccagcacccagccacctgcgcggtcgcccgcagccggtgccgcagtgtgagctagccag

SEQ ID NO: 90237 - DNA, 20 bp, Homo sapiens
  chr3:133613942-133613962
  hyper
cgccgcggagccagccgccg

SEQ ID NO: 90238 - DNA, 66 bp, Homo sapiens
  chr3:133614601-133614667
  hyper
gcgctgggagagaggcgcgggcggagcggggcgcagggacggcgcgcggggcggaggagcgctctc

SEQ ID NO: 90239 - DNA, 114 bp, Homo sapiens
  chr3:133615019-133615133
  hyper
gtccgaccgacagggcggaaaggaacgaaggtgggggagagccagggtgtggcgaggcccgtcagggcggtcagacctagggaaacctggcgtacttggcgcagatggggctcg

SEQ ID NO: 90240 - DNA, 160 bp, Homo sapiens
  chr3:133646291-133646451
  hyper
gagaggaagttttctcgaggctgtgtcccgtgagcaggcgccggtgggctcagccgccgggccctccgagtaggggaaggcgtgcgtgcgtgcgtgcggtgggcgcggggagccccgcaggcccgagggcgccccggcggggaagcgggctatcggaggc

SEQ ID NO: 90241 - DNA, 52 bp, Homo sapiens
  chr3:13367368-13367420
  hypo
cacccgtcttggggtcgatgtggaggatgctgttggccgaggagctccaggt

SEQ ID NO: 90242 - DNA, 42 bp, Homo sapiens; identical to SEQ ID NO: 39868
  chr3:13373208-13373250
  hypo

SEQ ID NO: 90243 - DNA, 98 bp, Homo sapiens
  chr3:133748007-133748105
  hyper
ccccgcccccgttggcgggagaagaaagcctggggaaggagaacatcccttaggccacccaccccaggacgagggggctcggacgagacacagtctgt

SEQ ID NO: 90244 - DNA, 46 bp, Homo sapiens
  chr3:133748648-133748694
  hyper
ctgcgggcggctggccgggcgcggagtggcgcggggtcggggcgcc

SEQ ID NO: 90245 - DNA, 376 bp, Homo sapiens
  chr3:134032195-134032571
  hyper
gcagccgccggggggcgcccgcaagggctagggctcggggccgggtttgggggcgggtaggggcgggcaggggcggggcaggagccggggctgcgagctggccgcggcgcaaggaatgcggcctttggctggtcccgggccggcattccggccggcgcaggaatgtgagcagggtgttcactgcgcgctctgagcgcacaagtttgttctcctctccttggagaacgccggcccgctctgtgccaccctctccccaagcccccggtacgtccgtctgtccgggtggaggacagggccccgagggccgcgaccaggagggactcgcaggaggcaccggacaggggtgcggcgagaccagtcgcgctggaggaaagga

SEQ ID NO: 90246 - DNA, 79 bp, Homo sapiens
  chr3:134092564-134092643
  hyper
ccggtgagggtagcccgaggcccggagaggtctttaagcatcgcgggtccgcctccctccctctcgagccctctttgtt

SEQ ID NO: 90247 - DNA, 30 bp, Homo sapiens
  chr3:134093118-134093148
  hyper
gctttggctggggcacgtttctgtggcctc

SEQ ID NO: 90248 - DNA, 578 bp, Homo sapiens
  chr3:134125220-134125798
  hyper
catctgcatttgaaacgggctcccggggctcttcaaggaggcgagcggccgctgcagggctcctctaggccagattacatcccagaacgcccaggcaggacgctccggctcagattgtgaaccctgggactctgcgtccaggaggggcccctaaaccctgcgctaaaagccagaggtccggggagcaggcggatgccctcagacttggctattttgcttaaggtcacctccaaacgggactggaataaaccctccttgtttgcctctcgccaggcctaagccccgggtccccttgggtgtcgtccaggacgccaggcgcggctgcttacaatggctctcagacgacagatggcgggcaggaagggagggggcgccgggcaggtgcgcgggggagacgcgccgcggcagcgccggacgccaggctgcagggtgaatagatttgcagcccgccggctgcaggcggcggccgccgagccctgcaaacaataagtgaattctccgaagcgactgaaaccccccgggctgggccacgcgccagccggggagggcggaccattgtgctgcgcaggctgaagctg

SEQ ID NO: 90249 - DNA, 37 bp, Homo sapiens
  chr3:134202929-134202966
  hypo
aatggctcacagggccgggcgcggtggctcgcgcctg

SEQ ID NO: 90250 - DNA, 220 bp, Homo sapiens; identical to SEQ ID NO: 40008
  chr3:134320427-134320647
  hypo

SEQ ID NO: 90251 - DNA, 70 bp, Homo sapiens
  chr3:134369449-134369519
  hyper
aaactggggcaatcacggggctgcgcgttgccacgggactgcgcgttgccacgggacgccggtgccactg

SEQ ID NO: 90252 - DNA, 367 bp, Homo sapiens
  chr3:134369552-134369919
  hyper
cgggttcgctgacctcgttcgggggagcaatgggcgccccccggcgggcaggcccttgtggcaaggaggccaaggtgccgggggacccggggacccgggtcgggcgcgcgttacctcctccgcgctgcagcagcgagctcgggttcgcctgctggtctgagagcgtaccctgtgcggcgcgccgcttctccgagtgcacgatcagcagcatgtcgatagatacagcgttgatgtccttcttcagctccatgatgccgcctcctttccgacctgggcgccgcggccgcacgctaggctgcttgcgctgcaaatggccccgtgcgcgcagctgccccacacgggagagggcgagggcgcggaagagggc

SEQ ID NO: 90253 - DNA, 19 bp, Homo sapiens
  chr3:134369920-134369939
  hyper
ctcccccgccgctggagcc

SEQ ID NO: 90254 - DNA, 188 bp, Homo sapiens
  chr3:134369940-134370128
  hyper
cagggcgctgcttttcgctgactctgccaaacacgccattagggcccgcctgggagggcgctaccctaatgaagcggctctaagtcacctttgaaaggaaatccccgggcccaagccttgacctgcaccggggccatagtcagcaggggcggccggtccagagcctccctccctgcgcccctgcctcc

SEQ ID NO: 90255 - DNA, 15 bp, Homo sapiens
  chr3:134370181-134370196
  hyper
cgctgcctcatcccc

SEQ ID NO: 90256 - DNA, 86 bp, Homo sapiens
  chr3:13442743-13442829
  hypo
agtgagactctggctcaaaaaaaaaaaaaaaaaaaaaggcaatggtgcggaacacacctaggcagatgtcccgccttctggctgga

SEQ ID NO: 90257 - DNA, 718 bp, Homo sapiens
  chr3:134514070-134514788
  hyper
gatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggtaacgtaccctccacggagcaagttggctgctggtgccggccgccttgggactgctgtgctccgcggttcgcggggttcctctggctgctttgcggtgcaggcatcccgggacccgagggcaaggaggtttgggagcctcggccgctgccgagcgcggggcttgggcggcacccaccagagcgcccccggctggctcttagcgcccgaaactggctcgcgagtcccccggcttcctcgccccggcactccctggta

SEQ ID NO: 90258 - DNA, 1288 bp, Homo sapiens
  chr3:134515035-134516323
  hyper
actgcgcgcgggggccggagaagctctgccgtggtatcccgcaagtggccgccgaaggagaggggtggagttcattggccgtacccttggggaccagtctggtggtccgggcgcctgcgggactgcaggtttccagggtcagtcggggagaggtggaaacccttttcgcctcttgagccttggaacaggagtgggctggggtgagtggtcggtcctacctaaagtctcccagcctctccaccaccccggagaggatactcggcggccgggagtcgtcgggcagcgtcactctctgccagctcagacttggcggtgcctccggcttggtggctgggaaagcgcgctccaaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctgggaacacagctccgcgggagagcggagttggagttgtcgggagaaaaccaactctaggggtgatgcgctgccgcagtccggctagcagccccactttccggtgtcctgctccggatggaactcctctgggggactccaagccggggaggagcagctcttggcgaccgcgcagcgttcccatctgggagctcgctccgcttgttactcgttcctcgcgaaactgtgaccggttgcccagtggaaactcccccaaacacgatggtttggtgccccccgccattccggaaagctctgcccttctggaagtgaagctggaggggcattccgggccctgaggcgcggctaagattcccttcccttttggcgaagaccaccgcatcccacgtttgttctggtggcggcgtgggggtgcggcgattaatgcctagaaagctctcgcttgcttttccgaaggtggctttttgtctgccctcagtctcctgcttccctcagggactgctgggctttgtagggaggggagcaaggaggggtttgctttttggaacgtgcaggagaagactggagccgtgtggagtgccgtcaacaccctggcgcagggatgcctgggtttgacttattgagagacacgtgtgggagcagttgaaattggaaattcaaggggatatatacccccaaaccgggcaggaaagccagggtgagcgcatttgcaagggcaattccagactggacttgcagcattggggtggcgtcatgcaggtccgaggctcggtccggcccgcggctctttgcgccc

SEQ ID NO: 90259 - DNA, 157 bp, Homo sapiens
  chr3:134565144-134565301
  hypo
ggttcattgcttgcacgttgcaatctgccggggcagggctccgaggccccatttggaggaatgttagtgcagcccagtggagcccaggttgcccataatgctgcctttgcgataccttccaagccttgcattattccctccacgcacatcagcaaga

SEQ ID NO: 90260 - DNA, 30 bp, Homo sapiens; identical to SEQ ID NO: 40009
  chr3:134624264-134624294
  hypo

SEQ ID NO: 90261 - DNA, 30 bp, Homo sapiens
  chr3:134967156-134967186
  hypo
ggtcatcaatgccatcgagcaggactaccg

SEQ ID NO: 90262 - DNA, 177 bp, Homo sapiens
  chr3:135172075-135172252
  hypo
ctgctttcctgtgaacgtcactgtctgcgtgcagaattacactgctgaggagcaagcagaatggatgatggaggctgacaggccacgagaccccagagcaatttcacctggttttgattcatggcttgtcagagcgctaaccaaatattccattttcattttcgccctccactctct

SEQ ID NO: 90263 - DNA, 26 bp, Homo sapiens
  chr3:135298460-135298486
  hypo
aaggggaaattaggccgggcgcagtg

SEQ ID NO: 90264 - DNA, 30 bp, Homo sapiens
  chr3:135309812-135309842
  hypo
atgcaaatcagacaccgcctcctccagcct

SEQ ID NO: 90265 - DNA, 152 bp, Homo sapiens
  chr3:13546000-13546152
  hypo
atggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcaga

SEQ ID NO: 90266 - DNA, 30 bp, Homo sapiens
  chr3:135627324-135627354
  hypo
gcgctgctgggcaggcgcacaaagacactg

SEQ ID NO: 90267 - DNA, 538 bp, Homo sapiens
  chr3:135684904-135685442
  hyper
ctcggcgcggccggccggtcccgggacacggcaccagggaggtgtggaaattgcctgccccaggggcgcccgcggaggagggtaggcgggggcggcctgggccctcccacttttcagggctcctgggccagttcgcccgcacagccctcgggaacttgttaacaggaaagcctggcagagaaacaaatgccagcgttttggaagaactgagagtcacgtcgttaggcgctgaggctttcttttccttccccgccccctgcccaacctcggcccgacttggccaaagaaggatgtgtcaccagctccgggccgcggacgggattcccggcccgccaggagccggggtacctgaaacaaaggtaaacggaggccgggcggcccctggtcctgcaccgcggccgcgctggagcgcctcggtgggtctctcccgcgccgacctggccgccgccgccgcggaggggcgttctcctgggggacctctcgatggaaaccagctggccgggcttggagttgatgttgcatccgaactctgttgtgc

SEQ ID NO: 90268 - DNA, 194 bp, Homo sapiens; identical to SEQ ID NO: 290
  chr3:13590447-13590641
  hyper

SEQ ID NO: 90269 - DNA, 78 bp, Homo sapiens; identical to SEQ ID NO: 28078
  chr3:13590973-13591051
  hyper

SEQ ID NO: 90270 - DNA, 56 bp, Homo sapiens
  chr3:135996415-135996471
  hypo
atgtgtggggaaagccgtggctcctatgagggttgggggggcggttctcaggtcat

SEQ ID NO: 90271 - DNA, 332 bp, Homo sapiens
  chr3:13612009-13612341
  hypo
gtgcctgctgtgccacgtgtgtgcagcagggctgcgcctgcgagggctaccagtactatgactgcctacagggtggcttcgtgcgcggccgcgtgcccgccggtcagtcctattttgtggacttcgggagcactgagtgctcctgcccaccaggcggcggcaagatcagctgccagttcatgctgtgcccggagctgccgcccaactgcatcgaggctgtagtggtggctgacagctgcccacagtgcggccaggtgggctgcgtccacgcgggccacaagtacgccgctggccacactgttcacctgccgccctgccgggcctgccactgc

SEQ ID NO: 90272 - DNA, 135 bp, Homo sapiens
  chr3:136254713-136254848
  hypo
taataaataaaaaaccgaattcctactatctggctttagctgaaaaatctaatacatcttaataataattaacaaatataaatgtgatttatgtgaatcactgtaaaatccaattttgtacgagttttaaaacgg

SEQ ID NO: 90273 - DNA, 38 bp, Homo sapiens
  chr3:136366118-136366156
  hypo
aatatctttcctggccgggcatggtgactcatgcctgt

SEQ ID NO: 90274 - DNA, 588 bp, Homo sapiens
  chr3:136537591-136538179
  hyper
cggaccacgattttccgatgctggacacatatttaaacatgaaggaatagacttgcgacttttaagcgcaaacaatgggtggaaatggacagaaactgcctccgtgcccacttgcagcggactacgtagccctggcagacaggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccaca

SEQ ID NO: 90275 - DNA, 215 bp, Homo sapiens
  chr3:136538621-136538836
  hyper
attttcgtggtacatcgacggtttgtagacatcttttcccaagggaagacgagggcaagggttagtggaggaagggcctcgtcacggccgagagtggcggagaaggctcagggcaagtccgcacagcctccagcagccacggggaggaaaaggcgaatctttcctcacagtgctctgggcgctgtagaatttctacgccacgtgcacccatttgg

SEQ ID NO: 90276 - DNA, 120 bp, Homo sapiens; identical to SEQ ID NO: 40010
  chr3:136582940-136583060
  hypo

SEQ ID NO: 90277 - DNA, 373 bp, Homo sapiens
  chr3:136751376-136751749
  hyper
agtggcattgtttggcgtctctgaacgcggctttggcagagccctccggagccagctgtagttcccggagacgccactaggtgacaatgtaggtcttggttggtcaactgcaggctacggttgatttggttgggtcccagcggagccttagcgtcctctccggcaaaataacaaatgtccgtcgtgcagggcactttcttcgggaaggactcctgggagctcaggagtttgcatacgaagccgagggagcgaggggcttctgataatgatattcagcgtcgaacagagtcgctcatatgcagagccggagtctctcccagctttgatatatgagattattatggagagtaatgcaggccgagtgatgcttgct

SEQ ID NO: 90278 - DNA, 312 bp, Homo sapiens
  chr3:13679132-13679444
  hypo
agctcaacttccagacgggcctcctggtgcctgcgcatatcttccgcattggccccgcgccagccttcacgggggacaccatcgccctgaacatcatcaagggcaatgaggagggctactttggcacgcgcaggctcaatgcctacacgggtgtggtctacctgcagcgggccgtgctggagccccgggactttgccctggacgtggagatgaagctctggaggcagggctccgtcaccaccttcctggccaagatgcacatcttcttcaccacctttgccctgtgaggtgccagcacgggccacctgcggg

SEQ ID NO: 90279 - DNA, 30 bp, Homo sapiens; identical to SEQ ID NO: 14522
  chr3:13680779-13680809
  hypo

SEQ ID NO: 90280 - DNA, 16 bp, Homo sapiens
  chr3:136916207-136916223
  hypo
tgggcagaggccgggc

SEQ ID NO: 90281 - DNA, 395 bp, Homo sapiens
  chr3:13696627-13697022
  hyper
cggcgctgcagcaggagtgtccctgatcccgggtggtcgctctccagcccgccaggctctccgacgggctcaacccgcagcccctggccggggctggggccgggacgccaggcccctgtggggacggttccctccagcagttggcgaggctcggccggccaaggggccggttcctcccgctggcagccgcccggccgccgccttccgcccttgcccgcccgcggccgtccccgagccgctcccggccgggccttgagcgccttttcctcttcccggcgccccggccgcccggcgcgtccagctaagcaggaagggcccgcccgcgcccaaggccagggcctcagccggaggtcgcccgccgccaggggccgctgcggcgccggggacgcgcgagg

SEQ ID NO: 90282 - DNA, 1634 bp, Homo sapiens
  chr3:137479130-137480764
  hyper
cttgggggggtgggccggattaactgtcttgtctctaaacacctgggtgcgctggcgctcactctcagctgcgagctgaagcccacgctgctctcaggcttcccgcaacaggcacctgcgacttcgctcaccaaaatcttccagtggccacagtgagcgggcaggactggtgccagcaagccccaagcatcccaggccctctggacgcaggtgactcttctggcctctttggaaagccattggagctcgagaggcatagccagctgcctcctttccgtccatccccaaccgcgttctctaagccacgttctgtgcgccttactcccagcactcagccattccccagccccagaggccttggagtagtgacctctgcccaccagagaggagggggccggagggtggggcggagccttgtggcaaggcaggtgggtgcaggcctctggggccccagactgccgcgtctggctctaccaggctgtgtctcgggccccgtgcctgcagctgcaaggcggggaaagacctatcgggaagatccacctcggcctgggcagaaggaaactttactgagagtcttctctgagtttggaattatgcggaaattgaacccaagatgaataacacgcagccacagccccagagaagctcgaagtctagtgggctgcaccgactgcgacagggacccaaaagaggctggggaacagggattgaaatggaagtgtgagagtgagagcatagaaggggtcctagcccagcccaggaaacagaaaagtctccccatagacagtgagaggcttgtactgatacctgaggtacgcgcaggagctgcgtgaaaggagaggcccagagccagaaaagaggaaggcgcatcctggacgctctgcgccctggagggagacgaaaggcccggagagaagcagattaggtcggtgcccttagaggcctcttccttcacttccgggaaacagcggcggttccctgacaaaatccctgttgctcgggggttcggacgccttgctaaggctggcacgcagcggaccttgagtagctgcgctgtgtactgaacgtgtgcacagcttctccaggcaaatgtgcaagcggaaagacctcatccaagcgttatctccagccctggaggagaatgaactggtagcctggggccaaacttcaggccgtggacaaagcaggaggagtatttaggcaacctctgtcctaatgcttgttctggttgtgaccgaagttgctgactctcctcaggggtcacgtctccaggacgtgctacccggtggtttagacccgtcagggaggcacagcgtgaagggacagcgcagcgcagtagaggcacctgctggagacagcaccaggccagaccccaggatcacgggaactcctgctcccgccacagctctaaagagtgttgaataaaccggtggtcaccggtactgcgtaaggggtgtgcgtggctttgcagttcgcctaggagacaagctgatgcacggcctggaaggtgcagccctcatccctgcgttccctccccgcgcggagttcctgtctcaaggccaagacgcgcagcgctgatgctggccccttcctaggtcagtgcagctggaccaggcaatcggggtctccgaaac

SEQ ID NO: 90283 - DNA, 227 bp, Homo sapiens
  chr3:137481120-137481347
  hyper
cgggtcccctccgaacgctggatctcgctgcagatatcagtatttctctcattccttcccaaagccgtcgggatcgcccagtagaattagaattgggtgattcctgaatctcctatccctggctggctctgaatatagcgcaccgctggtcagacctgagtaggggttgccagcgacgctcggaaaccctttccagactgggctgaaaagtgcgtttgcttcctgag

SEQ ID NO: 90284 - DNA, 99 bp, Homo sapiens; identical to SEQ ID NO: 28395
  chr3:137481774-137481873
  hyper

SEQ ID NO: 90285 - DNA, 232 bp, Homo sapiens
  chr3:137481935-137482167
  hyper
cgcgtttctggccggtcctcccaagagagaatggtgcaaaagccaataagcctggaacacacgcaggtcccgccgggcctgggacaatggtttccatttaataaatatttcccccaagggcatttcacatcgggcaggcaattattcaaaggaaacaggcgcgcaggttggctctgcgggttatttcgtcctctttacccgaagaatgctcatttgacgcaagaaacgagtc

SEQ ID NO: 90286 - DNA, 30 bp, Homo sapiens; identical to SEQ ID NO: 28397
  chr3:137483214-137483244
  hyper

SEQ ID NO: 90287 - DNA, 377 bp, Homo sapiens
  chr3:137483649-137484026
  hyper
caagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcgg

SEQ ID NO: 90288 - DNA, 604 bp, Homo sapiens
  chr3:137484084-137484688
  hyper
cgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 90289 - DNA, 548 bp, Homo sapiens; identical to SEQ ID NO: 28401
  chr3:137485061-137485609
  hyper

SEQ ID NO: 90290 - DNA, 441 bp, Homo sapiens
  chr3:137485869-137486310
  hyper
ggagtttttaaaaatcgtaaaaaatcaaataaaagcacagcccatgacgttaaacaaggaaaagagtccttttctttcccctccgggtgaatgttttcttgaagattattgtctttcctgagaaaggaccctccgatgttatccagcaaaactctttggaatttgttctcaaaatcgaagggtgctttccacccttggtcttggagtctcaccccaaaagccgcgctcacgcgtggttttccttaatttgcgtgcttttcccactggctttgatatgctgtggggtgggaggtggggcagcctagaggtttgtgggctttctgctgctgttgagagatttgtacgcttgcctccgctgtttccaaaggagtcggtggctcgaagtgcacgggaaacgttgtcaacagacaccaaagccgaaacccgcggattagcatattg

SEQ ID NO: 90291 - DNA, 304 bp, Homo sapiens; identical to SEQ ID NO: 28403
  chr3:137486516-137486820
  hyper

SEQ ID NO: 90292 - DNA, 56 bp, Homo sapiens; identical to SEQ ID NO: 28404
  chr3:137487025-137487081
  hyper

SEQ ID NO: 90293 - DNA, 17 bp, Homo sapiens
  chr3:137487082-137487099
  hyper
gacggtggctgaagctg

SEQ ID NO: 90294 - DNA, 485 bp, Homo sapiens
  chr3:137487303-137487788
  hyper
ttggccatcacacttcgtttccttccttctcagactggccttccccagccatctgccctccttagacctggtcccaacctctgcccccacccccatccccgcaagagcctgcctcagctttgcctccgtcgccccgagggctgcggagcgtccgccgaggtgcgcggccgcgactcgccctaacaaacagccaaaatcctgctcgtcacgccgctgacaggggccgattactgactttgaagtcaggcgcagacaaaaagaaatcccctggggggtgtgggggggcagcagtccctgtcaaacctgtttgctcacaactgtctctttctttcaagaaaatcattaaagcaaacctgtagggagaggagcgccccgcccgcccggagtggagaagagccgcttctcccgagcgcgcgtcgcgcagcaaagagcagccaagagttgccctggacagactcctggcatccggagaacctgaactccgg

SEQ ID NO: 90295 - DNA, 154 bp, Homo sapiens; identical to SEQ ID NO: 28407
  chr3:137487850-137488004
  hyper

SEQ ID NO: 90296 - DNA, 245 bp, Homo sapiens; identical to SEQ ID NO: 28408
  chr3:137488337-137488582
  hyper

SEQ ID NO: 90297 - DNA, 892 bp, Homo sapiens
  chr3:137488807-137489699
  hyper
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctacaaagtggagaagttgctctactctggagggcagtggccttttccaaacttttccacttaggtccgtaagaaaagcaattcatacacgatcagcgctttcggtgcgaggatggaaagaaacttcagaaaaactctcgccagacaacccggcagcacttggccccggaacagagaggagagaaagacctgac

SEQ ID NO: 90298 - DNA, 1303 bp, Homo sapiens
  chr3:137489875-137491178
  hyper
cggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatcccatctttcttatctctcgaagactcctttcaggctgagatcagagagggagggaaaaagaagagagaatcattgttcttctttttttaatttaatataccaagccaccagctcaggtcatttatatgcttaatttagtgataaaagtcaataagcggaatcacagggtt

SEQ ID NO: 90299 - DNA, 17 bp, Homo sapiens
  chr3:137561189-137561206
  hypo
agtctagctattggccg

SEQ ID NO: 90300 - DNA, 222 bp, Homo sapiens
  chr3:137717830-137718052
  hypo
acagctgttttcaactaccaggggctgtggcgctcctgtgtccgagagagctctggcttcaccgagtgccggggctacttcaccctgctggggctgccaggtaagggccaggtgtctggctggctggagggagagattggaggtggagaggaaactgcaggctctgtctgggcaccacgacagggactgctggggagggaggaactgcgattcgtgtttgac

SEQ ID NO: 90301 - DNA, 21 bp, Homo sapiens
  chr3:137945120-137945141
  hypo
ccactgcgcccagcctaacat

SEQ ID NO: 90302 - DNA, 120 bp, Homo sapiens
  chr3:138058967-138059087
  hypo
agccaccgcgcccagccagcatcaagattgtttctaaatccaccacctcaaacaatgctattcacttaaacattatttgaaactctcagctatgcgctgtggctcacacccgtaatccca

SEQ ID NO: 90303 - DNA, 234 bp, Homo sapiens
  chr3:138066780-138067014
  hyper
tctttatttttttaacggggggaaaatgacgccgctggagaggagttagcggaactgaaacaatgaaatggtgcgcgagtgtcgcctgtccccgtcgcatccatcccaacgaagtttgggccctggaacggtgcacccagaaggcctgcggggagagacgctggggcatgatctggaagaaagacgtctcaggattcgaagggaatgcagctaaggtggcggcggaggttcgcc

SEQ ID NO: 90304 - DNA, 461 bp, Homo sapiens
  chr3:138153816-138154277
  hyper
aacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctgggtgagccaagccgggtgggagtgggaggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaaggg

SEQ ID NO: 90305 - DNA, 182 bp, Homo sapiens
  chr3:138157733-138157915
  hypo
aggcagggtggcccccgcagctcacccttgaacagagggttcaagaggctgcatgtttacatgcggatgctcctctcacacagtgtttatgtgtacttttgaaggaattaagagccgcctcagctgtccttgtcgggtagggactgtgtatagcacagtgacaagcacggagcccttgatat

SEQ ID NO: 90306 - DNA, 163 bp, Homo sapiens
  chr3:13860677-13860840
  hypo
gatgtacaccaggtccgtgtccatgggcttgcggtacgacagtggcttcttgatcttcaggaaggtgggccgcttgttgcggctggcacgcacaggctccacgtgaacggcctcgttgtacttgtccttgagcacgtagcccagctcccgaaactgtggcagt

SEQ ID NO: 90307 - DNA, 342 bp, Homo sapiens
  chr3:138655796-138656138
  hyper
gggcattgtgggctccgagtctcgtaagggcgctagggattcgagacagcaggaatttcctcactgctccagcaaccctgggttcctgggtttgtaggtgggctgaaaggatcctttcatcgcacgtttgcctggcgtggctgctttagagaccgaggcccgccaggctttgcaacccagttgcgcgtggtcagccatggccttggaaccgccgggatcgcctcagcggcactccggccagctcccgacttcccgccctgggcactagggtcacccagctccagaagatagtgcttatcagcacaggaattgagaccccacacccggcgcagtgggtctccc

SEQ ID NO: 90308 - DNA, 278 bp, Homo sapiens
  chr3:138656668-138656946
  hyper
gacaccgtatggcaccggaggagctgctcagccgtcggtgccacctgggaagtagggtttcgggtgctgctctggagcgcgggaaagtccggatccgggtctgctggtcagcgcttcggcgccgccgggctcctttatctctcatccgccggccggtgagcggctccagtttcaagacccccgatcctgccggtgaggggagggagcgagaaggagtgcgctccgggcccaagaggctgcagggccccactccccaggtctgtcgtccttcctttatc

SEQ ID NO: 90309 - DNA, 30 bp, Homo sapiens
  chr3:138657192-138657222
  hyper
accgcaccggcaggccgccgggctcgtcct

SEQ ID NO: 90310 - DNA, 63 bp, Homo sapiens
  chr3:138657432-138657495
  hyper
cggctgacaggagagcgttgcgcagaaaattcgaggccgggcgctggaggagtctccgcggcc

SEQ ID NO: 90311 - DNA, 680 bp, Homo sapiens; identical to SEQ ID NO: 28416
  chr3:138657617-138658297
  hyper

SEQ ID NO: 90312 - DNA, 161 bp, Homo sapiens; identical to SEQ ID NO: 319
  chr3:138658703-138658864
  hyper

SEQ ID NO: 90313 - DNA, 40 bp, Homo sapiens
  chr3:138659080-138659120
  hyper
cgtgcgcctggccccggaaggtgctcgcagggggtgcctg

SEQ ID NO: 90314 - DNA, 93 bp, Homo sapiens; identical to SEQ ID NO: 2277
  chr3:138662087-138662180
  hyper

SEQ ID NO: 90315 - DNA, 167 bp, Homo sapiens; identical to SEQ ID NO: 2278
  chr3:138662281-138662448
  hyper

SEQ ID NO: 90316 - DNA, 50 bp, Homo sapiens
  chr3:138662799-138662849
  hyper
agtcctacctacagtcgcgccttgtgaacgaaccacggcagaaaaagtct

SEQ ID NO: 90317 - DNA, 37 bp, Homo sapiens
  chr3:138663076-138663113
  hyper
aacacaaaatttattcgggaatcgacaaggcaaaaaa

SEQ ID NO: 90318 - DNA, 25 bp, Homo sapiens
  chr3:138663703-138663728
  hyper
aaaacattagccagccgccggggcc

SEQ ID NO: 90319 - DNA, 242 bp, Homo sapiens; identical to SEQ ID NO: 28424
  chr3:138664141-138664383
  hyper

SEQ ID NO: 90320 - DNA, 68 bp, Homo sapiens; identical to SEQ ID NO: 28425
  chr3:138664701-138664769
  hyper

SEQ ID NO: 90321 - DNA, 534 bp, Homo sapiens; identical to SEQ ID NO: 28426
  chr3:138664802-138665336
  hyper

SEQ ID NO: 90322 - DNA, 132 bp, Homo sapiens; identical to SEQ ID NO: 28427
  chr3:138665396-138665528
  hyper

SEQ ID NO: 90323 - DNA, 978 bp, Homo sapiens
  chr3:138665539-138666517
  hyper
cgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtggggagagctgctctgaggctttgggaaagtcagcccagaaacgggtgtgactgtacgaagaagcctcggcctggcctgtccctcgcgctctcagagtgac

SEQ ID NO: 90324 - DNA, 89 bp, Homo sapiens
  chr3:138668596-138668685
  hyper
gaatcctctccttgccggcccagccagaggtgggtgaaccgggcgctccaggaaacggtgcggggcgccctgatttacttctcaacctt

SEQ ID NO: 90325 - DNA, 352 bp, Homo sapiens; identical to SEQ ID NO: 2282
  chr3:138668757-138669109
  hyper

SEQ ID NO: 90326 - DNA, 403 bp, Homo sapiens
  chr3:138669140-138669543
  hyper
cgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccac

SEQ ID NO: 90327 - DNA, 145 bp, Homo sapiens
  chr3:138679148-138679293
  hyper
aatgttaggggtcctcgtatgtgttcatggatagtgaggcagtagcatgaagaggcgggaaattcaggatgggagagggctgcaggacaaagactgcgggcagtccggccgggttcctgggtggaggaaggaaggcacgtttccc

SEQ ID NO: 90328 - DNA, 222 bp, Homo sapiens
  chr3:139059248-139059470
  hypo
cacaaaggggaatttcggccatggaatttgtgtctctgtaggaacatgtaagaggtttggactttgaataggggccagaagaataaaaactctgggtgaagtcaaaagtggggtggatgtggaccttttgggaggcctcaaggatagggaattgaagacttacagaagtcacatgagtgtggttgctggagaccgcaggggttcttgcgttgtccagactgt

SEQ ID NO: 90329 - DNA, 1122 bp, Homo sapiens
  chr3:13919657-13920779
  hyper
ccaatccggggaggccgcggcgccggcgggagggcggcccgcgggcgggcggggcggccaggggaggttattttctgctgttttccctttctgtctcccccgccacccgtgtccctcctccccgtttctaattaaaaaggagataaagccgcacgcggcccgagtcaatcggctcgagccaatcggccctactggcttcctggatgctgaatgtgcgcggggcggcggggcgcgggccaagatgaagattaaagcaggggaaaaaaaggaaagccacccagacgcgggcgaatcaataacacttaaaacacaccggcaggctggcggtactggcgcgagccccgcagccgcctctccgccgctggtcgggctggcggcccctggtcggctctgcacgcacctgctagcggccgcggccggacaacttgcgaaatccccgctccagagacgtggactggggaagtgacggggtaggggggtagtagtgacaaaacacaaagggtctgccacgcacatcccctcgccgcagcccctgcggtccacccctcctcaaaagggatggtaatgggttcactgctgggggctggaggggcagggtgtgtgagacctaccaagcgggcccttcagcgccagaacctctatccatgcccagatccccccgcccccacaccgctccgagcctcacacgcgttgtcttaagtacaaagggtgaccggctttgcacaagcagctccaggacgcgtcccgagctgccccctcccaccttccagccagagcgcccccgagccccacctccacagaaacgctaggtgaagccggagggctgctcgcgcgcccggccgcctctgctgcccagttccagggggcggggtgtcccgcctctctctagcgcttgtctccctctgtgtctcagaccgcctctcgtcccacctttgtgtgtgtttgttgggggtgggacgtgctgtccccttggcccgggaaggggctctgggagtctaagggcccctggaaattgggtggtgccaaggctccgagcggcggtttatgtttttgccagcgaatgtccttcctcctgggtacctgttccctgtttgcacggaccggccccgccagccacctggg

SEQ ID NO: 90330 - DNA, 923 bp, Homo sapiens
  chr3:13920980-13921903
  hyper
ctggagcgtccctaccggctgtctctggtcctgggggattccagactcagacgtcctcaggatggccagtccccctgcctatatctcctggggtgtcctgcggggggcctttgtgcgtccaccgctcccacaccgcacccacccggcctctcagagaagctgtggaagttggccggcagaggctcgcaggcggcacacctccctccccgggccgtgccaactttgtcgaaacacgcgcggaaagggcgcaggcagcccttacccgatccggaggtagaccatgcccaggctgagaaagaggtggcccaggcagcgccgcgctttccggttcatagtcccgattggccgccggggccgcgggccgggctgtgctgatcccgcgggccggccccggcggggcaatcaacatagcccgcccgggaggcgcgagccgaggcgtccccggggccgtctgtcggtgcgcccgtccgcgcgctccgcgcctgagcctcgccaggagcacgggagccacggagcgggaggagggagggaggagcgagcgcggcgtggggcgacgccgggctgcgcgcgagcgaccggtgcaagtgtgcgagacgcggggagtgcgggggcgctgctgcctccagcccccgcccctccctcctttcccccgtccctcccccgccccctcccccgcccgcctccccggagcgcccgcccagcgcccctgcgcccgcgggacagggccgcctgcacaaggcgcgcgctcgcgcctttccatgcgcgctcccgggggccccctccctgctccggggtgcaggtggcaggctggggagcacagcccggttggaggcggtaggagcccgctcgccccccacccgtcactaacttgcagattgcagggcgagtgggcgtccagaggctgccctcgggtggagtggacc

SEQ ID NO: 90331 - DNA, 492 bp, Homo sapiens
  chr3:139258180-139258672
  hyper
ccgggggcaccggaccgcggctcgccgggatggaggcaggcaggcagcgtctcgggagggctctagggagcggcccggagctgctcggcggggcgcccagggcgcagcgggcagcgcttaccgagggcgcgcaggtactcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctgcgggaggatccattgtagcggtcgctcctccccgcttagcgagggcgggcgcaggggcgggggatgtcgaagggtcaggtttgtccaggccgcgccaccttcgtttcagacgttcagttcgtttc

SEQ ID NO: 90332 - DNA, 30 bp, Homo sapiens
  chr3:13937220-13937250
  hyper
tggattcccctgacccgagttgtaaccacc

SEQ ID NO: 90333 - DNA, 448 bp, Homo sapiens
  chr3:139396418-139396866
  hyper
tccgccgccacctgtcgccccagcggggactcccaggactcagttaggggccaggagtcacgtgggcccgggcattcagccgcgatccaggtcctagtgggctgacgaggggcccacgctgcgcttacctgctatttgcagggctcagcaacggcgctcggcgagtctcgggggactgcgggggactaggggacctgctgggcctagcaggggctgtcggtcagcgcgcggcccggcgcccgaggtccgagagggaaacgacgtttggtctcgggactcaaggctgcctccggcccgggcagcctcaggtctagatcccctagtacctgagctggaggcggggccaaggcgaacttgaccttgcgctcccttagcggccccgggcagatggagtctgagggaaacagatctgcgccccgccccttcgctggggcgggccctaaggaga

SEQ ID NO: 90334 - DNA, 128 bp, Homo sapiens; identical to SEQ ID NO: 28435
  chr3:139653445-139653573
  hyper

SEQ ID NO: 90335 - DNA, 298 bp, Homo sapiens; identical to SEQ ID NO: 323
  chr3:139653574-139653872
  hyper

SEQ ID NO: 90336 - DNA, 1228 bp, Homo sapiens; identical to SEQ ID NO: 28437
  chr3:139653873-139655101
  hyper

SEQ ID NO: 90337 - DNA, 99 bp, Homo sapiens
  chr3:13975514-13975613
  hypo
tgggcttcacatggacggacggaactatctgcagcgtcccctgcaagtggtgtgtaggagactctgaatggaaataaagttaatcgtactttttctcct

SEQ ID NO: 90338 - DNA, 30 bp, Homo sapiens
  chr3:139884168-139884198
  hypo
tgctggcaaggaaaacgtgtgctcactttg

SEQ ID NO: 90339 - DNA, 120 bp, Homo sapiens
  chr3:140434129-140434249
  hypo
caaacaccgcctcctcaaacctgactataaaatccagcacatctgccgtccaccagccttttccacatggagacccgcttctctatagagagagctatttctctttctcttcttttctgt

SEQ ID NO: 90340 - DNA, 22 bp, Homo sapiens
  chr3:140732060-140732082
  hypo
aaagcccttagtggccgggcgc

SEQ ID NO: 90341 - DNA, 866 bp, Homo sapiens; identical to SEQ ID NO: 28438
  chr3:140769436-140770302
  hyper

SEQ ID NO: 90342 - DNA, 183 bp, Homo sapiens; identical to SEQ ID NO: 326
  chr3:140770407-140770590
  hyper

SEQ ID NO: 90343 - DNA, 40 bp, Homo sapiens; identical to SEQ ID NO: 327
  chr3:140770643-140770683
  hyper

SEQ ID NO: 90344 - DNA, 1292 bp, Homo sapiens
  chr3:140770684-140771976
  hyper
cgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagtattattattagctttgcgagcccaagcttgttatccaactttccgaagctgcagcagttccgtcgtccgtgtaatggggacaataattcctgggggtctgttcgtccggggtattcggagaggtggaagtaaagcacgggtcacgcaataggcaccggtggctgttgttaccgtttattcctgactctggggcagtgaggctggtcgcctggcccgagagcgactcagggaccagtcctggccttgcttgaatacaaacttgtctatgctcgggaagggagggggttgggagctcaggaaaccctaggcgcagggctctgggaaggagggagggggtcagagacttgagcgcggcaaatgtgtccgccctggtcgctctgtacgcgccaggggctccaagccagaaggggacgccgagcccccgacctctgactggcgggagaaccgggggagtggctgctcccgccggcccatggccaagcgcagacggctgccggcaggaaggagaggagggcacttttctgtaccgctgtcgcgagaaggtggagagttctcagttctggagtcaggcttgggttcgaatctgtctccaccaccagctcgcggtgtgaccttgggcaagttctctaacctccccccgcttggtttcctcttctgcgccccactctcctc

SEQ ID NO: 90345 - DNA, 43 bp, Homo sapiens
  chr3:140785562-140785605
  hypo
gcaagaagctgtacccggtggtgagtgccgtgtggggccactg

SEQ ID NO: 90346 - DNA, 375 bp, Homo sapiens
  chr3:141174296-141174671
  hypo
ggccgccattttcgtcgtctcttatcacgatgggaatcagcgttctctgctgctgctcctgctgaacacgacgacattccagccaccgggaactgctcgggactcagtatcattctcagacctaggcaggagcgttccgtgcttgccctcctccacaggtgccccgccgcacggggcaaagagtctgcagggccaacagggatgtgcccccgcaatgtccacgccatccccagagaccgcattctggtacccagaacctgagaattccctgcagactttcaaggcctgttctggccgcttccttgccagtgccacacccctggggcagccaaagggcagctgtttgcaggggttgtggaccgagtttgtgatgga

SEQ ID NO: 90347 - DNA, 482 bp, Homo sapiens
  chr3:141378730-141379212
  hyper
cgagagcgtccctgtcgcctgcagctcctgctgggtgatgcggggacgcggctccctgggaaatcgtgttagcggctccagggctggtccacggcggccttgggagcggcggcaacaggctggagcgtccacgcttcggaggcctctgtctccccaagattccccactgatgaacagggacgccggtccgccttcctcaacttcccctgttccctgccaggcagcgtccctcgcagcgacgttggctgcgacaagtttgacctgcagcgaggacaccaggatttctcagtttctccaaatccaagcccgagcccgagcccgagttccgaccagtcctgacactgcttcccgccgccacctgcctcctcctccagctcccgctgtctccccggcgccggcgccctgggtggccacagtccctccagcctccgcccctcgccgcagtctccagggcgccggacgccacgcgggcagccggcccg

SEQ ID NO: 90348 - DNA, 138 bp, Homo sapiens; identical to SEQ ID NO: 40015
  chr3:141481968-141482106
  hypo

SEQ ID NO: 90349 - DNA, 30 bp, Homo sapiens
  chr3:141508206-141508236
  hypo
acgggagccaccagtcgccccatacacttc

SEQ ID NO: 90350 - DNA, 665 bp, Homo sapiens; identical to SEQ ID NO: 28443
  chr3:141516079-141516744
  hyper

SEQ ID NO: 90351 - DNA, 86 bp, Homo sapiens
  chr3:141549437-141549523
  hypo
aaccagattggatctcggtgaacgctgttttaacaaatgccagtggaatgagtgggagaaggctaatctggcgcatgtcataacca

SEQ ID NO: 90352 - DNA, 77 bp, Homo sapiens
  chr3:141637559-141637636
  hypo
tgagccactgcactcggcccccttaaggttttaaatgcatttttcttcttgtttatctattacgtatcctttgcttc

SEQ ID NO: 90353 - DNA, 30 bp, Homo sapiens; identical to SEQ ID NO: 39874
  chr3:14197900-14197930
  hypo

SEQ ID NO: 90354 - DNA, 30 bp, Homo sapiens; identical to SEQ ID NO: 40016
  chr3:142337360-142337390
  hypo

SEQ ID NO: 90355 - DNA, 305 bp, Homo sapiens
  chr3:142443546-142443851
  hyper
agcttttcttgctggcgtgcgacaagggtgagagttaggcccctttctcctctggacgcccctgtcctccagacctttagtcctctcccccgcctcaacttatatcggggcattccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagcccc

SEQ ID NO: 90356 - DNA, 30 bp, Homo sapiens
  chr3:142499588-142499618
  hypo
gttgctgagtaaaaacgtttttagtgaata

SEQ ID NO: 90357 - DNA, 30 bp, Homo sapiens
  chr3:142499820-142499850
  hypo
agaatgaatttaagtcgtctaaaacttgct

SEQ ID NO: 90358 - DNA, 466 bp, Homo sapiens
  chr3:142607418-142607884
  hyper
ggccatccggcaggccgggctggggacccaggagggagccccgcgagcaaggatgggtcccgaagtcccgggcttagcctacccgagggtggcggacgcctgcaccgcgcgggagcgcagggtcgagcgctgggtcacccaggcgcgccgaagcgggttgagtaaagcagcaggcgaggctgcaggggtggaggaagggaaaggagagaaagggagcccgggcaggggtcgcgttacctctctggggactgctgccgcgagagctgggtggcggcagccagcagcaggcagagtggcgcccaggcgttcgcgcccctcatggcagcgtagacgctcggggtttgcaccccacggcgcgcgcgccggcacacacgcccctccgcacccaccgcgctcacaccgccgctcacactggcagcagcgctggctcacaccggcgctcggctgcccgcgcgctccctctcac

SEQ ID NO: 90359 - DNA, 163 bp, Homo sapiens
  chr3:142681832-142681995
  hyper
ggtggaagggcacgtcgccgccgctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcc

SEQ ID NO: 90360 - DNA, 1192 bp, Homo sapiens
  chr3:142682049-142683241
  hyper
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgccctgt

SEQ ID NO: 90361 - DNA, 22 bp, Homo sapiens
  chr3:142718194-142718216
  hypo
gggcgcggtggctcacgcctgt

SEQ ID NO: 90362 - DNA, 21 bp, Homo sapiens
  chr3:142718456-142718477
  hypo
gcgagacgtctcaaaacaaac

SEQ ID NO: 90363 - DNA, 44 bp, Homo sapiens
  chr3:142791151-142791195
  hypo
atattaagactgtcacgcgcgttcgtgtgaagagaccaccaaac

SEQ ID NO: 90364 - DNA, 17 bp, Homo sapiens
  chr3:142802592-142802609
  hypo
agcgtgagccaccgtgc

SEQ ID NO: 90365 - DNA, 488 bp, Homo sapiens
  chr3:142837831-142838319
  hyper
ttctgcaaattagaacggggcgttcccctcccccatcaccccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgca

SEQ ID NO: 90366 - DNA, 168 bp, Homo sapiens; identical to SEQ ID NO: 2294
  chr3:142838479-142838647
  hyper

SEQ ID NO: 90367 - DNA, 197 bp, Homo sapiens; identical to SEQ ID NO: 28451
  chr3:142838876-142839073
  hyper

SEQ ID NO: 90368 - DNA, 322 bp, Homo sapiens; identical to SEQ ID NO: 28452
  chr3:142839204-142839526
  hyper

SEQ ID NO: 90369 - DNA, 16 bp, Homo sapiens
  chr3:142839562-142839578
  hyper
cggcccgagtcccggc

SEQ ID NO: 90370 - DNA, 110 bp, Homo sapiens; identical to SEQ ID NO: 2298
  chr3:142839579-142839689
  hyper

SEQ ID NO: 90371 - DNA, 119 bp, Homo sapiens; identical to SEQ ID NO: 2299
  chr3:142839783-142839902
  hyper

SEQ ID NO: 90372 - DNA, 47 bp, Homo sapiens; identical to SEQ ID NO: 2300
  chr3:142839944-142839991
  hyper

SEQ ID NO: 90373 - DNA, 136 bp, Homo sapiens; identical to SEQ ID NO: 2301
  chr3:142839992-142840128
  hyper

SEQ ID NO: 90374 - DNA, 68 bp, Homo sapiens
  chr3:142840221-142840289
  hyper
cgaggtgttctttctctacgagccagtgtggcatgtatggcaaaaactgtatccgggggacgccgttt

SEQ ID NO: 90375 - DNA, 24 bp, Homo sapiens
  chr3:142853160-142853184
  hypo
gggctcaagcgatcctcccatcta

SEQ ID NO: 90376 - DNA, 30 bp, Homo sapiens
  chr3:142859875-142859905
  hypo
gaactctcaagtcaccgctgtcctctattt

SEQ ID NO: 90377 - DNA, 451 bp, Homo sapiens
  chr3:142895864-142896315
  hypo
gctatgatgatgctgcgctcccgtttcctggatgccagacgaaagcgccgtaacttcagcagacaggccactgaggtcctaaatgagtatttctactcccacctgagtaacccatatcctagtgaggaggccaaggaggagcttgccaagaagtgtggcatcaccgtgtctcaggtctccaaccggtttggcaacaagaagattcgctataagaaaaacatcggaaagttccaagaggaggcaaacatctatgctgtcaagacagccgtgtcagtcacccaggggggccacagcagcaccagctccccgacacccccttcctctgcaggctctggcggctctttcaatatctcaggatctggagacatgtttctggggatgcctgggctcaacggagattcctattctgcttcccaggtggcatcactccgacgctcgatggggccagggg

SEQ ID NO: 90378 - DNA, 22 bp, Homo sapiens
  chr3:142913215-142913237
  hypo
aaagtctcactttgtcgagcag

SEQ ID NO: 90379 - DNA, 22 bp, Homo sapiens
  chr3:142913477-142913499
  hypo
caaagtacggggattgcaggcg

SEQ ID NO: 90380 - DNA, 30 bp, Homo sapiens
  chr3:142957298-142957328
  hypo
tgtcttggagaccctcgatttccttgatta

SEQ ID NO: 90381 - DNA, 21 bp, Homo sapiens
  chr3:142957630-142957651
  hypo
ccaccgcgcctggcctgtaat

SEQ ID NO: 90382 - DNA, 260 bp, Homo sapiens
  chr3:142973621-142973881
  hypo
gccacatgaactccacgtgactacttgaatggtttctcccagagtgaagatccaagaaagcaaggcggaagctgaaatgtgttttataattatgaaccattatctccatgtatcctattagctacacaggttaacgcgggagggagcaacacaaaagacttgatgtttgctcactgcaggagccacggatgaaagggttctgcttgatcctccagaggatgggcatgtgctgtaggctggcaggccgagtaactgcctct

SEQ ID NO: 90383 - DNA, 200 bp, Homo sapiens
  chr3:143024050-143024250
  hypo
tattaagcatttcttcgttatgttctagcaggtgactcgtgttccctcctcttaaccccctcactgaatcgcagtcacttggttagatcagctgctgctgatgggaatggacatgctgagtgctaagcccttgatgttcgctaccacattcattctccttgacagtgatagaaggtagatgataccgtttcatagctgag

SEQ ID NO: 90384 - DNA, 37 bp, Homo sapiens
  chr3:143036841-143036878
  hypo
tacaggcctgagccaccgtgcccggcctcattttctt

SEQ ID NO: 90385 - DNA, 45 bp, Homo sapiens; identical to SEQ ID NO: 14579
  chr3:143092973-143093018
  hypo

SEQ ID NO: 90386 - DNA, 34 bp, Homo sapiens; identical to SEQ ID NO: 40026
  chr3:143151477-143151511
  hypo

SEQ ID NO: 90387 - DNA, 101 bp, Homo sapiens
  chr3:143166561-143166662
  hypo
aggagaatagagcatcgttgtctgtctaaagatggcagaaacatactttgttcatagccccgctgtctaccccaatttgaagaacacgtgcttgtatcgac

SEQ ID NO: 90388 - DNA, 30 bp, Homo sapiens
  chr3:143189998-143190028
  hypo
gcacgcacggcactgcggcactggaagcac

SEQ ID NO: 90389 - DNA, 38 bp, Homo sapiens; identical to SEQ ID NO: 40027
  chr3:143210840-143210878
  hypo

SEQ ID NO: 90390 - DNA, 30 bp, Homo sapiens
  chr3:143346055-143346085
  hypo
ttgaaggctattgcacgtgtttttgagaga

SEQ ID NO: 90391 - DNA, 29 bp, Homo sapiens
  chr3:143367116-143367145
  hypo
accagggaactgtttcgtggaaggcgatt

SEQ ID NO: 90392 - DNA, 15 bp, Homo sapiens
  chr3:143566691-143566706
  hyper
caaaaacaaacagct

SEQ ID NO: 90393 - DNA, 156 bp, Homo sapiens
  chr3:143566766-143566922
  hyper
cgtgtgagaacatgactgtgacatttgctctcgtgacatggcaaatttcggcggcttgtctgtaaagagattagcattcgttacgctgcagcacctttcatcaaactaatgacatttcaatcagcacattttctccagtttcggtactttgctatc

SEQ ID NO: 90394 - DNA, 30 bp, Homo sapiens
  chr3:144206683-144206713
  hypo
ctatttctgttctatcgatctatttgtcta

SEQ ID NO: 90395 - DNA, 184 bp, Homo sapiens
  chr3:144314841-144315025
  hypo
ttatcaacatgatgtcgtagatattcttcctttttctttctcattatgatatatattatacgttaggtaaatatgtagaattgacatatggcatatgttatgcaagtgtgtgtatgtatagaaacacatatatatacacacacttttcattgaattggccatactgtatcgcattgtgtgatta

SEQ ID NO: 90396 - DNA, 161 bp, Homo sapiens; identical to SEQ ID NO: 39875
  chr3:14443179-14443340
  hypo

SEQ ID NO: 90397 - DNA, 30 bp, Homo sapiens
  chr3:14552752-14552782
  hypo
gggcagttgtccaggcggatattgtcaatg

SEQ ID NO: 90398 - DNA, 167 bp, Homo sapiens
  chr3:145878028-145878195
  hyper
aacgagagacagcaccgggctcaagaaaagggtaggtaaggggagcagctgtgtgtccacagcttccccttcagatcccaaaggaagaaagctgccgcctggaggtactgggtagccaggcagccttactgaaaacaactaaggttttcgagcgagcgttgtttttg

SEQ ID NO: 90399 - DNA, 64 bp, Homo sapiens
  chr3:145878489-145878553
  hyper
ttccccagggaccagcgccgcccgaccgcaattctggggaagaccccggcggtcctggagagga

SEQ ID NO: 90400 - DNA, 69 bp, Homo sapiens
  chr3:145878868-145878937
  hyper
gccgccgattgcgggcgggagccggcgggcaaggcgcgcggccggcagccggagcggcgcgtaacgcag

SEQ ID NO: 90401 - DNA, 28 bp, Homo sapiens
  chr3:145908278-145908306
  hypo
aagtctatcctggcccggtgcggtggct

SEQ ID NO: 90402 - DNA, 84 bp, Homo sapiens
  chr3:145968319-145968403
  hyper
agttactataaatagcgtttttacctgcgagtggcctggcctgagtccgtgagagccgcgccgtagaaacgccagagacccatg

SEQ ID NO: 90403 - DNA, 19 bp, Homo sapiens
  chr3:145970676-145970695
  hypo
tccccgactgagctggtct

SEQ ID NO: 90404 - DNA, 39 bp, Homo sapiens
  chr3:14615548-14615587
  hypo
agttctcctgctgcacgtacttgacgttctcgtagaccc

SEQ ID NO: 90405 - DNA, 58 bp, Homo sapiens; identical to SEQ ID NO: 40028
  chr3:146187920-146187978
  hypo

SEQ ID NO: 90406 - DNA, 37 bp, Homo sapiens; identical to SEQ ID NO: 40029
  chr3:146188305-146188342
  hypo

SEQ ID NO: 90407 - DNA, 883 bp, Homo sapiens
  chr3:14643752-14644635
  hyper
gtcagacaacaggtacgcggggagcagcccgggcggccccgcgcaggggttgagccgcagcgctgctgtgcaggggcaggcccgggcagggggcagtgcggcgagtcagccccctccctggcctcctcgcaactttgagtaaccgcggactccggggtcggcatgggggtggcgccgggcgttcaaaggaaagttgggtgcgacggaccgcagcctcgggggccaaaggacccccaccgtgagcgcggccacctcccgacacccggcgggctggctggagggagcaggtgaggcacgtggccgcctcgccaagccagggctccctccaggagcccgacccgccggccgggccggtggatgccccctcgagggctcagacccttcgctccagcccccggcgggcgccctgccccgggtcccacactcccgcgccccgtgggccccactgctggctttccgggaccaggctccgctccgcagctcgcgtcctgaggtgatcctccaggctccccactttgggaccccctcctgcgcctcgggtgccggcgcctgtcttcgcctcccgcggggaccctccccggcgccccaggcgtgtgcgccccgggccagctcagctctgggtccgccctccgcaccccgcgccgcgcgcgcgctcaccggccgggcagcggccgcgtcttaccttcgtccggcagccgctgcaggcagagcgcgaggttcctccgccagccccgcatccccgcggccgccctgcggcccggcccggcctcgccagcccggccccggccccgcccccgccgggcagggcggcgcagcgcagcgctggggagggccgcgggcccagggagccgcgggcatggacggccgccgagggtgggggtgc

SEQ ID NO: 90408 - DNA, 30 bp, Homo sapiens; identical to SEQ ID NO: 39876
  chr3:14676121-14676151
  hypo

SEQ ID NO: 90409 - DNA, 116 bp, Homo sapiens
  chr3:147072554-147072670
  hyper
tggctcggcccccaacggcggttttcaggtggctgagagacccgccgccttccgagcgcgagtgatgaaaaggggagggaggccgcgccgggcgggccggccgctcacaatggagc

SEQ ID NO: 90410 - DNA, 30 bp, Homo sapiens; identical to SEQ ID NO: 28462
  chr3:147073006-147073036
  hyper

SEQ ID NO: 90411 - DNA, 30 bp, Homo sapiens
  chr3:147073354-147073384
  hyper
tggaggtagtggaggcgatgccagagcgat

SEQ ID NO: 90412 - DNA, 144 bp, Homo sapiens
  chr3:147073957-147074101
  hyper
tttggaggaagactgcgacagcttaggccaccggaaaatgacccagaagttcaacttctgcgctctccggggaggctgggtcagagctccagctcaaaaatgtcttaaatccgttcgggaagatcatctcgcactgaggccatt

SEQ ID NO: 90413 - DNA, 176 bp, Homo sapiens
  chr3:147074915-147075091
  hyper
caagctgggcagtcccgcttccaacccagagagggcgagggtagcgcttggaattttgagattgggctgtctggcgcggcttccaattccagtcttttccgccaggcgcggctccagtttagaccgcggcggtggtctaaattcttcgcctaaggaaccaccgcctaaggaacgat

SEQ ID NO: 90414 - DNA, 368 bp, Homo sapiens; identical to SEQ ID NO: 28465
  chr3:147076998-147077366
  hyper

SEQ ID NO: 90415 - DNA, 287 bp, Homo sapiens; identical to SEQ ID NO: 28466
  chr3:147078959-147079246
  hyper

SEQ ID NO: 90416 - DNA, 793 bp, Homo sapiens
  chr3:147087044-147087837
  hyper
ctagcttgctgcagacgcttgcaggtactcaaatgaaggattgctcattgctggcgtctgaatatccatgccatgcagaaaaacaatattatttaaacctcagaatcgaatctcaaagctgcaggttagtggcaggaaagtgcatttgtaacacacgtttgtggaaatgtggtatgcgcgcgcactgggagccgcgtttctttgggacacttccctacgttcagcgaatacagggcatcactttccagtgaaatatgcctcccccaccaatatatctacaccgtctcccacagataatgccagttatttttccagcccctaaaaaaaaatacaaatgatttcaagtggatgtcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaaccccagagtcgcagctgtgcgcatccacaggcaagtagtttacacgtgcaaaattcattcctgagtcaggcgagccacaggctcagctgcggcgcggtgcggcgcttgcctggggctagagagtccacgacttgttgcctctgcgacccgaaagcggctctccaaaccctggccactcagaatttgagggcctctgggtctatgatgacagggctctaggagaaagcgcctctctgtagaacacccacaaaaacagagcaaagtcgcaggaggaagtca

SEQ ID NO: 90417 - DNA, 326 bp, Homo sapiens
  chr3:147088241-147088567
  hyper
gtgtgtgcttgtgtgcgcgcgcgcgcgtgtgcggatgtgggcagttagttgcttttaaaaagacatcgttgtccttcagagtaataaaagtgtagcccccatctttgggtgtggggattttacatgcacttctcatttcagttaacttttttcgagctgagaaaagctgctagcttactttcgggagactttgctcgttattcatctgtttagtcgcctcagaggcacaaaagcggatctgcggcgttatgaaaaatggcctgggcgcggagaatgtcacagtggtcggcgtattattttagcccttcttaaaaaaaaaaaaaaaa

SEQ ID NO: 90418 - DNA, 26 bp, Homo sapiens
  chr3:147088627-147088653
  hyper
caaagctgcaacggaagagattttca

SEQ ID NO: 90419 - DNA, 94 bp, Homo sapiens; identical to SEQ ID NO: 28470
  chr3:147088939-147089033
  hyper

SEQ ID NO: 90420 - DNA, 407 bp, Homo sapiens
  chr3:147090416-147090823
  hyper
cctgatcgtgtgagacgcgacccagtcgggtctgggcaactccctccttcccttgcgctgggctgcagagccccctggaatacctgaggatatccccaacctggtctctcaaagatgccccgacactggaagaaacctttaaagatggactggagaagctcttttggaagacaaggcgctcacttttccacttttgggaagtaaaataagagaaccagaggaagacgtcgcggcgactgaggatcccgccagcgcacccagcctacttcaagttcacatctcaagtcttcccactcaagtatttttttgcagagaatgccgggaagaaacctcttctcccaggaggactgctgggggtctgggtagggagagtttggttcctgagtgggagtcgccacctccagctg

SEQ ID NO: 90421 - DNA, 114 bp, Homo sapiens
  chr3:147096028-147096142
  hyper
aggagtccctgaccccgtgccttggctggagcgccgtttccctggacgactgtggctgggatggcctcccggcagtaatcttgcgcaaacaccctgccacgcgcaaggacgcca

SEQ ID NO: 90422 - DNA, 30 bp, Homo sapiens
  chr3:147096695-147096725
  hyper
aatgataaatagcatcgcatagctaatcgc

SEQ ID NO: 90423 - DNA, 30 bp, Homo sapiens
  chr3:147098132-147098162
  hyper
cagtctttctggaaccgtgaaacgctgaag

SEQ ID NO: 90424 - DNA, 308 bp, Homo sapiens; identical to SEQ ID NO: 28473
  chr3:147098379-147098687
  hyper

SEQ ID NO: 90425 - DNA, 35 bp, Homo sapiens; identical to SEQ ID NO: 28474
  chr3:147102662-147102697
  hyper

SEQ ID NO: 90426 - DNA, 284 bp, Homo sapiens
  chr3:147102945-147103229
  hyper
tcccaccccaggagtcgttgtcttcccactccatccagccccttgctccaaccaagcccacgggaaccaactcctcaggagttaaaaaaaaaaaaaagtgtcaggcgaactgctcactgaggtggctcctgagcagtaggtgcagaggcaacaatgtatgcgggtatctagaggtccagtgaccacgcagtggaggagggaagatggctctggtgattcatttgaaataagtctcccagtggctgggccagataagagtgtgcgtgcatcggatgctaaaactc

SEQ ID NO: 90427 - DNA, 303 bp, Homo sapiens
  chr3:147105872-147106175
  hyper
gagtgaacccctaaacgtgggcaagtcgggttctagaaaggaagtatatactggagagcgcagtgacagtattaaatggcgtgaaagcaaaggtcagcgcaaatgtatcttaatagagtgtctgtagtgaagtgtgccgcctttgaagcggccgctccccgcgcgtatttccatggcgagcctaacgcggcatgctgatgcaccgtcaaactcacactttcaaccccaaaacccgactctttgaacaacccgagcttgattagacctttctccttttctttcccctcttacaaaccatttcct

SEQ ID NO: 90428 - DNA, 61 bp, Homo sapiens
  chr3:147106207-147106268
  hyper
cgccctctgatcaccgcagaaagcagaaacaaagggggctgagcggcgattcaagcggctc

SEQ ID NO: 90429 - DNA, 1000 bp, Homo sapiens
  chr3:147108766-147109766
  hyper
cctgggacttgtggccgcagtccgacgagggcgacacgagggcagacggtgtagccgaatcgtagccagagctgggcggcggcgagcgcccgtgcaccttcatgtgcttacgcagcgagctggggtgcgtgtagcacttgtcgcagccccgcaccttgcacgtgtatggcttgtcgctagtgtgcacgtgcgaatgcttcttacggtcgctgctgttggcgaagcgccgctcgcagccctcgaactcgcatctgaagggcttctcgcctggcggaggcaacgcagagacattagtgcttgtgggtcgtgttcccgtcaggtgcttgccaccctcccccattcgtctctcattttctggaaaagaactacaaaatattttcagaaatccctttccacggcgcctcaggtcgagcacccctttccctcgtgcagagagcgcccccggtgccctctcttgaacgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgtgtgcataaagtggattcgtgctgcagggagaggtattctgagcaatgattcacttcagaagagatttttacaggaatggagccccctccctctttccttctaccccctgagggcaaacatttagcagcattcttcaaatcttgcctaaaccttc

SEQ ID NO: 90430 - DNA, 105 bp, Homo sapiens; identical to SEQ ID NO: 28478
  chr3:147110010-147110115
  hyper

SEQ ID NO: 90431 - DNA, 497 bp, Homo sapiens; identical to SEQ ID NO: 331
  chr3:147110228-147110725
  hyper

SEQ ID NO: 90432 - DNA, 373 bp, Homo sapiens
  chr3:147110927-147111300
  hyper
ccccaacaaaaatcccgccaaacgcttatccgatctcgtgagcgcctcactggacattcacgtaaaacaaaaacaattatttcgctccagacgaggagcagaggagaaaacagcagtgcactgagtgataccggcagccgggaagttcgcaggcccctaggaggccaggtgaggccgcgccccagcttgctccggagctgcaggaggcgccctggtctctgcgcttgacatcacccccgccccccgccaacacccggcctccagtccttccccctccctccagctccctgcactgcgccctgggtgggtgggtgaatgtgaagaggcggcgttgggctaggcccctgcagcccgctcggagcgtcctaggccc

SEQ ID NO: 90433 - DNA, 378 bp, Homo sapiens
  chr3:147111965-147112343
  hyper
tttgagggaaatgcccgagcaggccagactctgtagttcgttgttggtcgtgtttgtttgtttgtttgtttttgtttgttgtttcccccaccccccaccgctaatgaatcaggaccgcgaaccgaaagaacgcacaaaattctgtcctgaaaacacgaaaacctgagccagccgtggcgcactgaacttgcttctctgctgtaggtcgactgtgctaagaatttaaccattttctgcttcacagaattcaaacagtgggccggcaaagagctgtaaaagtttgtttgtttaaaaaaaaaaaaaaaaaaaccctgtcattaaagatgagttccttctccagctcaggactgcgagtctaccttccgggtgtccgccgcc

SEQ ID NO: 90434 - DNA, 30 bp, Homo sapiens
  chr3:147112635-147112665
  hyper
gactccaacaattgtcgatgttccagcaag

SEQ ID NO: 90435 - DNA, 49 bp, Homo sapiens
  chr3:147114169-147114218
  hyper
cctggggaggctcctcgtggaggcccgggaacaccgaggggctggaggc

SEQ ID NO: 90436 - DNA, 269 bp, Homo sapiens
  chr3:147126945-147127214
  hyper
aaaggggatgtcaagcgctttacaatacctgggattgatgaggcgggcgggccaatgagctgcgcgcggcgcctcggcgcgccctccgttggcgcggcggctgagggcggggggaatgcgggcgcaccaatgggcgccagcgtcggcagcacgtgacacctcccccctgctcccattcatcaagggggggacggtgtcgtcctttcaattcatttatctgcaggaatgattgctgctatcagtctcgcgctcaccgcccggctgaggag

SEQ ID NO: 90437 - DNA, 237 bp, Homo sapiens; identical to SEQ ID NO: 28484
  chr3:147127676-147127913
  hyper

SEQ ID NO: 90438 - DNA, 138 bp, Homo sapiens; identical to SEQ ID NO: 28485
  chr3:147136863-147137001
  hyper

SEQ ID NO: 90439 - DNA, 296 bp, Homo sapiens; identical to SEQ ID NO: 28486
  chr3:147137075-147137371
  hyper

SEQ ID NO: 90440 - DNA, 96 bp, Homo sapiens
  chr3:147137428-147137524
  hyper
cggctgttctcatatccctagcccctcggagaagacttagcctacccctagtcagagctcaggccccaggtgaccgggcagcggcttgggggaggt

SEQ ID NO: 90441 - DNA, 231 bp, Homo sapiens; identical to SEQ ID NO: 2307
  chr3:147138768-147138999
  hyper

SEQ ID NO: 90442 - DNA, 327 bp, Homo sapiens
  chr3:147139250-147139577
  hyper
cgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagagtgcagg

SEQ ID NO: 90443 - DNA, 161 bp, Homo sapiens
  chr3:147141097-147141258
  hyper
agttcccagctactctctggtgaaagcgggagggcgaagcgaaattgtgttctagctctgagctccgcagccctccaatggctgacttccttcagctgctgtcctggggtgccgatcgctgcggcagacgcaattttccgcacctgcgtgttgttttttgc

SEQ ID NO: 90444 - DNA, 30 bp, Homo sapiens
  chr3:147636685-147636715
  hypo
gtaatagcaaaacttcgaaaaccaactaaa

SEQ ID NO: 90445 - DNA, 42 bp, Homo sapiens
  chr3:148337549-148337591
  hypo
taaaagaaaatggcccgggcgcagtggctcacgcctgtaatc

SEQ ID NO: 90446 - DNA, 538 bp, Homo sapiens
  chr3:148415302-148415840
  hyper
tgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgc

SEQ ID NO: 90447 - DNA, 209 bp, Homo sapiens
  chr3:148415861-148416070
  hyper
cgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggag

SEQ ID NO: 90448 - DNA, 47 bp, Homo sapiens
  chr3:148459165-148459212
  hypo
gtgtgtttctactcacgtgtctcagcattgatcgatacctggctatt

SEQ ID NO: 90449 - DNA, 24 bp, Homo sapiens
  chr3:148463858-148463882
  hypo
cgcgcccagcgtgaaggcttctat

SEQ ID NO: 90450 - DNA, 151 bp, Homo sapiens
  chr3:148472011-148472162
  hypo
gatatactacctacacgcatttggggctcattccaaaggttgcctggagaaaaacaccaggttagaattatgtaaataactaacacctggagtcttctgccactctcattagatccaggtaaaactgctgtgactccacctcatcaaccct

SEQ ID NO: 90451 - DNA, 391 bp, Homo sapiens
  chr3:14851814-14852205
  hyper
cccagaaacccaactcgctgagttctcgtccttcgaacccccagcgcctcccgcggtgcccatggccacggcccctttaaatgtgcgcagggacgccccggccctcgcctccctgaatctctgaccgagcaggggaaaaaaaaatccttcctcttcgggagcggaggaaatgtctaggagggggtggaggcgcggctgcggcgcaggcagaggcgcaggcggaggcacggcggccagagcgcagcgcgcccggagccgggagcggacgcgacgcccggcgctgccccagccgccgcccccgcgctcgcgccccctcctcctcccccgccccgcgcccccgcccggcggccccgccccggaggctcgcggctcgcgcccccactgccctgcg

SEQ ID NO: 90452 - DNA, 447 bp, Homo sapiens
  chr3:14852212-14852659
  hyper
cggagtccgaggcgcgccggggccgggcgggcgccagggggtgcgggccccgcggggcggccgcggagggaggcggtgtgcggagtcgcactgggacccgcggacggactgaaacgccgacggcggcccgggccccgcgcgctgaagatgaacagagcaggtaggaggcccggcgacctccggcgccgaggcacgagcgcgagggaccccggccgggcgctccaagttggagctcccggggagcccggggctagctgcccgaaatcctccgaccttccagtgccgctcggcctcggccaaagcatgcgcggctccggggtcctctcgccgaggaggctgagaaccgggggtccccgtccgaagcgccctgcctcagggaccttctcagccttggcgaggccgcgccctggccgtgcgcgccagtatcccactcgcacggcgttcccc

SEQ ID NO: 90453 - DNA, 346 bp, Homo sapiens
  chr3:14852660-14853006
  hyper
gagtgagggtcccttccacgacgaagaaagacgcccctttcgcaaaagcgacttcgtctggccccaaaacctttgccctccattccccagcgtcccggaccggtccttgctcatctctcaggggcaacacctgacccacggggcccgtcccggagctctcttcgactccgggaccagttcccagcccttcagtactcggcataccggaaggaggattcctgctcccttctctcctcctagaccccgaggcttggagcttactctccagatgagactaaaaagccctaaattaatccccctatagcgcacccctccctcgcagcgccctggtcgggggcctccattg

SEQ ID NO: 90454 - DNA, 27 bp, Homo sapiens
  chr3:148556008-148556035
  hypo
tgggcgacagagcgagactctgtctca

SEQ ID NO: 90455 - DNA, 51 bp, Homo sapiens
  chr3:148705411-148705462
  hypo
ccgaatggggggcctcgtctcggccccgctcggctccgccatgccgccgcc

SEQ ID NO: 90456 - DNA, 27 bp, Homo sapiens
  chr3:148802983-148803010
  hypo
actacaattatgggccggatgcggtgg

SEQ ID NO: 90457 - DNA, 26 bp, Homo sapiens
  chr3:148803250-148803276
  hypo
ggacgacagagcgagactccatgtca

SEQ ID NO: 90458 - DNA, 35 bp, Homo sapiens
  chr3:148804164-148804199
  hyper
ggatcgttttcgagccgcctcgatacgcctccttc

SEQ ID NO: 90459 - DNA, 30 bp, Homo sapiens; identical to SEQ ID NO: 28493
  chr3:148943086-148943116
  hyper

SEQ ID NO: 90460 - DNA, 33 bp, Homo sapiens
  chr3:149286506-149286539
  hypo
gtttgatttacaagtcgcattacaggaatacat

SEQ ID NO: 90461 - DNA, 459 bp, Homo sapiens
  chr3:149374947-149375406
  hyper
ggcaggatcttcttccgccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaag

SEQ ID NO: 90462 - DNA, 415 bp, Homo sapiens
  chr3:149375996-149376411
  hyper
ctgggtaagaggagacgggtgccccccacccactcctcccggccgcgcggacctctcccgctcagacctgcatctgcattcctttgagtttaccacggacttggggcgggatcaaagggaaagtggcctgagcctgtttcatcaaggggttgtggaccgaaaccaaggccgggggtggcggagggcacgcggatgaggggctcaggcctaggaagggccggtcctggacaccgcgccctcccctgcagccaggcgccgaggcctgcagcacccggagcgccgcactgacccgcgattctgcccgaaggccggcccgggtgcgccccggcgcggggagacaccaacaaggccagcttttccacgagaggctgcttagctcttgtgaccatatttggtctggcgaggaggcatcttg

SEQ ID NO: 90463 - DNA, 257 bp, Homo sapiens
  chr3:14963819-14964076
  hypo
caccctgcacagagacgcagggcagggctcactgggctctgcatctggctggtctcctggccacattccacattactcagccaattctgttgctgcagatacgagagaggctgggggttagccttggggagaggccccccaccctggtgcctgtcacacacgtcatgatgtgcatgaactgcggctgcgacttctccctcaccctgcggcgtcatcactgtcacgcctgtggcaaggtgagtcgctgcatctggggt

SEQ ID NO: 90464 - DNA, 165 bp, Homo sapiens
  chr3:149687803-149687968
  hyper
aaatcaatggcagttcgccatcttggagaatttaaaaaaaaaaaaaaaacaacctatagagctagagctgaagtcgagattcacgaatccacctacgcggtcggcgtacatctctcgcaagccccagaggcctggacatcggtaaacctacgcaaagtcgcttcg

SEQ ID NO: 90465 - DNA, 217 bp, Homo sapiens
  chr3:149956581-149956798
  hypo
tctgcacaccttgtccgaggctccgatgttatccaggtgattcatcatttaatgctgttggcttcaacatggatttaatggtaactaaaccaagtgcacactatgtgaagatctattcacttggaggtccttcatttcaggtcaccaggtatgcccctgggctcctgccgcagctgatcgggtgctaggtgctgaggatacacggtgagttccttct

SEQ ID NO: 90466 - DNA, 35 bp, Homo sapiens
  chr3:150062858-150062893
  hypo
ggattacaggcgtgagccaccgcacttggcctaaa

SEQ ID NO: 90467 - DNA, 161 bp, Homo sapiens; identical to SEQ ID NO: 14584
  chr3:150135175-150135336
  hypo

SEQ ID NO: 90468 - DNA, 88 bp, Homo sapiens; identical to SEQ ID NO: 40037
  chr3:150237908-150237996
  hypo

SEQ ID NO: 90469 - DNA, 258 bp, Homo sapiens
  chr3:150443222-150443480
  hypo
cgagaggtcagcgaacgggccctcactggcttcttttgcgttgatggcctggtctgtatttctgcactaggtggccctctcattgtcgccatgactgctggccagtggacacctgcaggaatggacttggggtaggcctgaggccccagtctgctggggtgctcctgggaaactgagtctcgcctcgcctagtctcatggtaatgtgcaagggttgttttgcatcagcttcttgccactggggcgagccagcaagcag

SEQ ID NO: 90470 - DNA, 56 bp, Homo sapiens
  chr3:150505714-150505770
  hyper
tggtgcagctgcaggcggtgccaccactaggggtcaggcgacgtcctgataaagga

SEQ ID NO: 90471 - DNA, 88 bp, Homo sapiens
  chr3:150583707-150583795
  hypo
tcctcacttaagttccgaactcacctagaattgcatcctctgagactgggcttttcttttttctttttttttttttttccgagacgga

SEQ ID NO: 90472 - DNA, 113 bp, Homo sapiens; identical to SEQ ID NO: 28495
  chr3:150802887-150803000
  hyper

SEQ ID NO: 90473 - DNA, 1871 bp, Homo sapiens
  chr3:150803025-150804896
  hyper
cggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggctgcggcggccggagtgaccccgccgccgccagccccagcccgctagccgcggaccaacaggtaaagtgttgggggttgggggcggaagggaagaggagctggggccgtggggaggcggcgggctggaggagcccgagacgcctgcgggctggctgcccccgtcggcgctcacagccatcgctcctcacccccttccccagcccctggagggactgtaaagggttaagtcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccaccggccgcatccctgcgtctcgcgccccctccagacctgcctctgcctgcactggcccggtccgtgtccaggtggcggggtctgcggggcgcgtggcggcgggggaagggtccctgccggggaagagaggcgggggcggtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgc

SEQ ID NO: 90474 - DNA, 161 bp, Homo sapiens
  chr3:150804936-150805097
  hyper
cgggggccaggctgggggtgctgggcgaccccccggcggcggagaccgagcggctgtcagtccccgcgctccactggggcgctcgctttccatgtgccggtcgctttcccgttgccgggccttgcacggcgccgccgggcgcttctcgggcttcttccctg

SEQ ID NO: 90475 - DNA, 30 bp, Homo sapiens
  chr3:150848389-150848419
  hypo
actcagcgacgccagcgacctgcctgcaca

SEQ ID NO: 90476 - DNA, 37 bp, Homo sapiens
  chr3:15105526-15105563
  hypo
caaatggctaggaagcggcttccggatctcttgaagg

SEQ ID NO: 90477 - DNA, 96 bp, Homo sapiens
  chr3:152107121-152107217
  hypo
cccacctcagcctcccaaagtactaggagtagcacaggtagcacaggcatgagccacagtgcctggccccgtatctcttaacgattgggatatgtt

SEQ ID NO: 90478 - DNA, 240 bp, Homo sapiens
  chr3:152320903-152321143
  hypo
aaagcctgtttggtggtctcttcacacggatgcgcatgaaagtaggtgctttattgtcacacctgccttcccttcctctccaacaatagattgggcagcacccatggattagctttttcctgcctccatcacagatgttctcattcagacacgaatgtgagctgcttcttctgcatagagctcagtatggttgcctgacaatctatttttttttttttaagacggagtctgactctatcg

SEQ ID NO: 90479 - DNA, 41 bp, Homo sapiens
  chr3:152321383-152321424
  hypo
gagccactgtacccggcccggacaatcgtaacaggatctct

SEQ ID NO: 90480 - DNA, 30 bp, Homo sapiens; identical to SEQ ID NO: 40039
  chr3:152332728-152332758
  hypo

SEQ ID NO: 90481 - DNA, 27 bp, Homo sapiens
  chr3:152540434-152540461
  hypo
ttttttcttttttttcgagacggagtc

SEQ ID NO: 90482 - DNA, 1337 bp, Homo sapiens
  chr3:152552388-152553725
  hyper
catgtgccagaaatccggtcccggcaaagctagacgctctgcaatgacaggcgttcccagctagggactcctggctgcttggagcttgaaaacacctggcgtggttctcgagggccctagaggctcctgctacggactggtcggctctggggttgtaggcagaaggctctaagcggtcggaagggtttcctgtgtgtcagcaacttcactttgccgagatagctggcggaagagggaaggagcgctcgcgggccaatcgcctgccagcagccaccttggagcgcacccctctccctcgccgccgactccggtagcagcgtgccggcagaggctgaacacactcggcctcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcgcgctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagtttt

SEQ ID NO: 90483 - DNA, 22 bp, Homo sapiens
  chr3:152671180-152671202
  hypo
acataaatgataggccggactt

SEQ ID NO: 90484 - DNA, 82 bp, Homo sapiens
  chr3:152707532-152707614
  hypo
agccacagtacacggtctataagtccattttaaaatccactgtagatagcaatcctgtttcagtttccgggattaagttgac

SEQ ID NO: 90485 - DNA, 26 bp, Homo sapiens
  chr3:152709701-152709727
  hypo
aagacacccaggtgccgaggcaagag

SEQ ID NO: 90486 - DNA, 27 bp, Homo sapiens
  chr3:152829598-152829625
  hypo
ggcgtgagcgaccgcacccagctgata

SEQ ID NO: 90487 - DNA, 45 bp, Homo sapiens
  chr3:152874399-152874444
  hypo
gctgagattacaggcgtgagtcactgcgcccggcaggaaaattct

SEQ ID NO: 90488 - DNA, 30 bp, Homo sapiens; identical to SEQ ID NO: 40041
  chr3:152877598-152877628
  hypo

SEQ ID NO: 90489 - DNA, 72 bp, Homo sapiens
  chr3:152894314-152894386
  hypo
acattatgtagattgcgtgtttattctgttgattgggaaacaagatttaattggttacgtgatcacaattaa

SEQ ID NO: 90490 - DNA, 30 bp, Homo sapiens
  chr3:152894853-152894883
  hypo
tactcacttatgaatcgctctatatagtag

SEQ ID NO: 90491 - DNA, 34 bp, Homo sapiens
  chr3:152919057-152919091
  hypo
agactgtgctgggcacggtggctcacgcctgtaa

SEQ ID NO: 90492 - DNA, 30 bp, Homo sapiens
  chr3:152961303-152961333
  hypo
cctttgggggtacatcgcagtctccttgaa

SEQ ID NO: 90493 - DNA, 25 bp, Homo sapiens
  chr3:152979662-152979687
  hypo
ccaccacgtccggccaactcatatt

SEQ ID NO: 90494 - DNA, 30 bp, Homo sapiens; identical to SEQ ID NO: 40043
  chr3:152999015-152999045
  hypo

SEQ ID NO: 90495 - DNA, 18 bp, Homo sapiens
  chr3:153018756-153018774
  hypo
aaaaatatgattggccgg

SEQ ID NO: 90496 - DNA, 30 bp, Homo sapiens
  chr3:153102203-153102233
  hypo
gaaaagcatcctatgcgggtggttaggcag

SEQ ID NO: 90497 - DNA, 19 bp, Homo sapiens
  chr3:153204811-153204830
  hypo
ccatgtcaggttgggcgcg

SEQ ID NO: 90498 - DNA, 26 bp, Homo sapiens
  chr3:153224197-153224223
  hypo
aggagccaagatggccgaataggaac

SEQ ID NO: 90499 - DNA, 22 bp, Homo sapiens
  chr3:153381610-153381632
  hypo
ctattggctaggtgccgtggct

SEQ ID NO: 90500 - DNA, 642 bp, Homo sapiens
  chr3:153838818-153839460
  hyper
tcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccccaaaacgctggagctcagaacccagctcaggtgcgctcgtcggtttcccagggagactggggctgattgtaggcacgcgggggcgggaagacagcttcttgcttctggctgcgatggaggcggatctgggcggggccgaaacgggggcggggccaagtgtgggggcgtagtcaggcgtgggggcgggccggcgccggcgccgcggtcggcggcagcgctctcctaagctctcgcggctgcgcttcggtcccggacccgggccacccacggggtagtgggtgctcctcggccccggacattgcaagccccagaaggtaaatttgcgtgggagccgcgcacctggagcgcgagggtacccatgatgagggcgggaggctggatggcgacagaagggagcgtcccgcggcgagtttcccaagaaagctgaactcgtcccaagtttcttgtgcctcggcttgcactcagt

SEQ ID NO: 90501 - DNA, 226 bp, Homo sapiens; identical to SEQ ID NO: 2308
  chr3:153839727-153839953
  hyper

SEQ ID NO: 90502 - DNA, 76 bp, Homo sapiens
  chr3:153840317-153840393
  hyper
cgctaataacgactctcctgggtcaggttcgcagtccggccggaaggcaaaggaccccgaacgggggctctttcct

SEQ ID NO: 90503 - DNA, 15 bp, Homo sapiens
  chr3:154145550-154145565
  hyper
caagccttttctcca

SEQ ID NO: 90504 - DNA, 241 bp, Homo sapiens
  chr3:154145627-154145868
  hyper
cggagctggctccctgtccttggtgatgggctcctgggaacggcggggcacacccccagggttgggaggggtttcagcttttgagtgccggatctgcgcccgctgcctattcaagactccaccagaaaggcacagtctacaacgtgggggacgctagctaggaaacaggcgtccgtgaaacccgcatctgattctccgaatggcctttgtcgcctccctggaccctcacctccgcccatgc

SEQ ID NO: 90505 - DNA, 526 bp, Homo sapiens
  chr3:154145869-154146395
  hyper
cgctcgtcacagtggggcgccactctgccacctcttaatcggcttcctcctggaaggaggaacaaaagcctgttttgttccctgtcttctccctccacaactgatctctcctcccctctatcccgccctgctggagatgggcgtcgtcctctctaggcgggaatggaacggcgagaaagggatgacagaaggttgtggggaaaaaaccttttaattccctctttccttttctgaatactctctgattttgctgtgtgagacaatatccttggccaccaccgatatggaaaactaagtcgctcgcgacggaaagcgatccccatgcccctgacttttgaaaggagaagcatttagtagtaaaggtttcgcagccaactagccctgtcccgaactgccttcttctaagtgcatgtctaaaacccagcgagatacacttggaagcggacttcactgtgtgtctcttggtgactccccaaaccggcgacgccggtcccaacactcatttacactgtctggcacacacact

SEQ ID NO: 90506 - DNA, 532 bp, Homo sapiens
  chr3:154146488-154147020
  hyper
cgctcacggtgaagctcctggtgccatagagagtcccccggttctcacgcctgcaggcttcagccccagcggcagcgggcgcacccggtccgaacacggtgtcggagctcggagagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccgatcttctggaggctgtctggctccccacacctctgtgcatcgtataaaagttgta

SEQ ID NO: 90507 - DNA, 18 bp, Homo sapiens
  chr3:154179223-154179241
  hypo
tctgagatggagtttcgc

SEQ ID NO: 90508 - DNA, 30 bp, Homo sapiens
  chr3:154373134-154373164
  hypo
ttatttccatctccccgttcatcatataat

SEQ ID NO: 90509 - DNA, 30 bp, Homo sapiens
  chr3:154797184-154797214
  hyper
ttttcttgaaagccccgaagctaagcaatt

SEQ ID NO: 90510 - DNA, 317 bp, Homo sapiens
  chr3:154797461-154797778
  hyper
gagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcc

SEQ ID NO: 90511 - DNA, 356 bp, Homo sapiens
  chr3:154797835-154798191
  hyper
cgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttggg

SEQ ID NO: 90512 - DNA, 30 bp, Homo sapiens
  chr3:155668471-155668501
  hypo
ggattttggaatacacgggagtcctggaac

SEQ ID NO: 90513 - DNA, 76 bp, Homo sapiens
  chr3:156002795-156002871
  hypo
aatttttttctgtcgtattttctttttatatatgtacaagagtgaaactggagggaggcagcgtgagtttaaaaag

SEQ ID NO: 90514 - DNA, 276 bp, Homo sapiens
  chr3:156009024-156009300
  hyper
agcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggac

SEQ ID NO: 90515 - DNA, 621 bp, Homo sapiens
  chr3:156009318-156009939
  hyper
cgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggtatgcacgtaagattccctct

SEQ ID NO: 90516 - DNA, 147 bp, Homo sapiens
  chr3:156534392-156534539
  hyper
cgctggcgaccccttcccgggtctcctagccctggccgggctgcccccgcgcccgcccccgccctcgaaatccaggcagtgcgggaggccgccttgctgctctctccgcccgcacagggccgcccgacggagcgggcagggagcagg

SEQ ID NO: 90517 - DNA, 30 bp, Homo sapiens
  chr3:156543165-156543195
  hypo
agcagtttggtgtaccgatactgctctgcg

SEQ ID NO: 90518 - DNA, 23 bp, Homo sapiens
  chr3:156999611-156999634
  hypo
actacgcccggccaaaattgagt

SEQ ID NO: 90519 - DNA, 182 bp, Homo sapiens; identical to SEQ ID NO: 28512
  chr3:157155252-157155434
  hyper

SEQ ID NO: 90520 - DNA, 77 bp, Homo sapiens
  chr3:157155701-157155778
  hyper
aggtaaggaggcaagcggggccgggacctcccactgcggctttgttccgggagcgcgcgtaacggcaagccaagcca

SEQ ID NO: 90521 - DNA, 351 bp, Homo sapiens
  chr3:157156015-157156366
  hyper
cccgatccgactaagcgctgcaggagtccactggcccgttataaccgtgatccctcttgccgcccagcttccctccgttagggatttccacgtcttctaattttatcctgcctctgtctttagaggagctctggtttcccgcactatttcagggcccaggctaacgtttagggatgttttccagcccctcagccggcccctcctctccgcccacccattctcagcaagaaacttgaggctaaagctaatctcccgaagggtcagcggaattcttcaggggtcccccagcccccggggtttgtggaattagcgcgacaggggaggtcggagggtgtgcggtttgggattcag

SEQ ID NO: 90522 - DNA, 52 bp, Homo sapiens
  chr3:157217149-157217201
  hyper
gagtcacagctgtcccgcgcaaactcgactttacctgcgtgctactcctcaa

SEQ ID NO: 90523 - DNA, 121 bp, Homo sapiens
  chr3:157261112-157261233
  hyper
gaaggctgagggacccggtccccgccccgcgtgctcaggctgaacagcttttcttccctgatctctcggaggcgccggctgctggccaacgcagggcagcctcctgcgtgcgtgctgtggg

SEQ ID NO: 90524 - DNA, 101 bp, Homo sapiens; identical to SEQ ID NO: 40046
  chr3:157303466-157303567
  hypo

SEQ ID NO: 90525 - DNA, 104 bp, Homo sapiens; identical to SEQ ID NO: 28516
  chr3:157812154-157812258
  hyper

SEQ ID NO: 90526 - DNA, 1169 bp, Homo sapiens
  chr3:157812436-157813605
  hyper
cgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacaggaccacggcggatggcctggctgcttcagggcgtaccatgcccgcaggcagatgtttattattaaaaactaccgacgttcatcaaccaggagacccgcaaggcctgcgcactgaatacggcccaaatcctgttcagtggtctttgaaagttaaaagaaagaaacctatcgcccacgtctatgctgaggaacagctttgaatacgagctaagacctgggagagggccaagtgggggtggtggggaacactgctggaggatgtggggctttggcaggggttttacgcaccctccagcacgagggtggggggtcccaggggacgctcaggactctttcagtctttgcggaaggtcccgtcatcacaagagcccgcgcgggaaggaaagttcctgccttggacatggtcagggccgagtcttcaaagtctccaactatccccacacaggcagcacctttgggctttactagtgggatttcttccagaagggggccacgacatggggagagagagctcctcattattttcaaggccaggcttttcctaaacccgattctggcttccaccttctaaatttaaccaatgaagaagctgcttcagccaaccctaaacaggagtgtcagatggggaatcctccctccacagtgccctggcctgcccgcctttgcggctcttttcccgctccgaagtcagcacctgccccgctccagagagggtcaacgaactgggactgattgtcgattatgccataccaaacccaggttgatttcgctccgcaggatccctccttccttcctcccaaaagtgtccccagataaagactggaattatagcaaaacgaataacgagagtccatcttggggaaggaagttactctatcctatgttattttacttcttatctgttctttcattaatttggtataaccctgtttctatgctgggtggataaaatggagggggc

SEQ ID NO: 90527 - DNA, 176 bp, Homo sapiens
  chr3:157813669-157813845
  hyper
cggcacgtaagagcagaggcaagcgcttttccaagttggtatattcgagagagtgatacgcattaatcaaaagggaaagactatcccggatattttaatagtaacaggaacaaagatgactcgaaccccatcaaatgaaacgatattttcattcaattgatcgcaaagtgtcttca

SEQ ID NO: 90528 - DNA, 34 bp, Homo sapiens
  chr3:157815889-157815923
  hyper
tcttggcggctgctgcggccgccactaccgaggc

SEQ ID NO: 90529 - DNA, 411 bp, Homo sapiens
  chr3:157820458-157820869
  hyper
ctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaag

SEQ ID NO: 90530 - DNA, 175 bp, Homo sapiens
  chr3:157821536-157821711
  hyper
gcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcct

SEQ ID NO: 90531 - DNA, 56 bp, Homo sapiens
  chr3:157822030-157822086
  hyper
ggcgaacctgtagttcgggcctgtagttgtggactcatggccgggaggctgcactg

SEQ ID NO: 90532 - DNA, 41 bp, Homo sapiens
  chr3:157822839-157822880
  hyper
aacacaccaagaaaccgaaacgcctcgcccgggagaagcag

SEQ ID NO: 90533 - DNA, 109 bp, Homo sapiens; identical to SEQ ID NO: 28525
  chr3:157823011-157823120
  hyper

SEQ ID NO: 90534 - DNA, 736 bp, Homo sapiens; identical to SEQ ID NO: 28526
  chr3:157823138-157823874
  hyper

SEQ ID NO: 90535 - DNA, 48 bp, Homo sapiens
  chr3:157824303-157824351
  hyper
ttcccgggtagcagtcgcgcctctaccgggggttggggaggggaaaag

SEQ ID NO: 90536 - DNA, 498 bp, Homo sapiens
  chr3:157824411-157824909
  hyper
aggagagagagagattggagttcgggcgggctggggctggagtggtagggcagcacagggggaccggagggggcggggagagaaggccggtccccggccgctcaggttttcagatagcccctgccgcctgtgctcttggccattaatccaggattgacaagaatccctaattaatttaattaggcgtggattttgcgttggtgtcacgacttagttaaacactggggagctggatagaccccgcggggtggggccaagaggaaactgacaagtgcgcagctcttagagtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggc

SEQ ID NO: 90537 - DNA, 349 bp, Homo sapiens
  chr3:157825059-157825408
  hyper
cgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatggtgaattacaggacttcttctttagcatcttgggaaacatccgagtttatttactaatttgaaaaacaagagattatccctcttcgagtctgaaaaaaaaatcgacgttaagtttgtacc

SEQ ID NO: 90538 - DNA, 151 bp, Homo sapiens
  chr3:158176209-158176360
  hypo
aaaaatggcaaaaaccgcaattacttttgcactaacttaatagcaacagcttagcaaaacaacagaggaagtaggatgtctataagcatggaatagaaatgactttcttggcgtccagggtgggtagtgaaggaagcgaagcctagagggg

SEQ ID NO: 90539 - DNA, 125 bp, Homo sapiens
  chr3:158288887-158289012
  hyper
gcctcgtcctggtgacgtcacagagcaatgtccaatgggaaagcagctcggtgtcacgcacctcctatcccggcgggcaccgcctgcgccgcggcgagtgaggcgtcgtccgtactggaggctag

SEQ ID NO: 90540 - DNA, 230 bp, Homo sapiens; identical to SEQ ID NO: 28531
  chr3:158449969-158450199
  hyper

SEQ ID NO: 90541 - DNA, 55 bp, Homo sapiens
  chr3:158450408-158450463
  hyper
cttagtgctaggatgcggcatcgcctccgcagcgcagggccgggtgcttctggcc

SEQ ID NO: 90542 - DNA, 30 bp, Homo sapiens
  chr3:159444029-159444059
  hypo
caactgttagtaggacggcttctgctgtac

SEQ ID NO: 90543 - DNA, 44 bp, Homo sapiens
  chr3:159480931-159480975
  hyper
acttggaaggggatgcggcggcggcaaggcggctggagctgcgc

SEQ ID NO: 90544 - DNA, 58 bp, Homo sapiens
  chr3:159482848-159482906
  hyper
ggagaagcatctggccgggctgcagttccgggagcaggaggtacggaaccagggccag

SEQ ID NO: 90545 - DNA, 71 bp, Homo sapiens
  chr3:159483270-159483341
  hyper
aaaagtcagtgcctgcgggggatatttcaaatcgtaatagttgtggctttgtcaatcgtggtggctctcct

SEQ ID NO: 90546 - DNA, 30 bp, Homo sapiens
  chr3:159751507-159751537
  hypo
atcattagccattaacgatcaactcaattt

SEQ ID NO: 90547 - DNA, 300 bp, Homo sapiens
  chr3:159756632-159756932
  hyper
cggggccgtgggacccggccgccctttctcctccgtggctccccagccaggaggctgcgcttacctgctccgcacgacctctgcggcttgggggctctcagctctgtcgctgcggggctccaggctggtgcttgtgctgagaatgactgcgggaggggctcgcgtgcccagcactgcaccgcgaggcgaccaaccgctgacatgtggggcgattgggtggacaggaagactcggcgagcttttgtagccgcgggtagggacagcctgggctccctgaaccaagcgcgcgtgggcggcgac

SEQ ID NO: 90548 - DNA, 1147 bp, Homo sapiens
  chr3:159943489-159944636
  hyper
tgctgctactgctggcgctggcgctggtggcgccctcgcggggcggcgggggctgcgctgagctggcgtgcggcgagcgggagcgctgctgcgacgcgaccaacgccacggcggtgcgctgctgcaagctgccgctgcacgccttcctggacaacgtgggctggttcgtccgcaagctctccgggctgctcatcctgctggtgctcttcgccatcggctatttcctgcagcgcatcatctgccccagtccacgcaggtacccgcgcggccaggcgcgcccgggacagcggcccgggcctccggggggcgccggaccgctggggggcgcggggccgcccgacgacgacgacgactcgcccgctctgctgcgcgacgaggcggcagccggctctcaggactcactgctggacagtggcggcggcggccggggccggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaacggccggggtgccgccgccaactgcctcagaccttatctggcaccctggcctaactgcccggcaccccgcgactgggttggggtcactcgtctccctcgcgttctcccgggatcttatgtttctctgcgtttcattccgttcaaagaaacgtggggcacgcgcggcgggtgcggctgcagcaggcgaccctccagcgcaccttcgaaggacgtccctgccctctgccttgcctcgtattgtggttcactagtaagtgcctgcttccctagtcaaagagaacacgtgagccctttggtgcgtcgagagaagggcggtcttctttagggctgaggagaaaggaccgcagttccactcctttccctacctgccgcctggacaggtctcccagggtgggcagagggcgaggagccgttgag

SEQ ID NO: 90549 - DNA, 521 bp, Homo sapiens
  chr3:160167468-160167989
  hyper
caccttctccgcatccgtaaaggtccttagactcaccgcggggaggaagcggaccaggcaactccacagcacggaaacacagcgccacgagctccaggcggatgctgagagccgccccgagtccccgccctcctctgccccgaagggcttcaggtgcccagaccgggcggggcctcgcggagcctcgcagcgcaggcgcagtctgcaggcaacattcaactgcaaggcatcggccaatgggaactattgctgggctcgttcgaaagtaaacggtggacggcgcggcccgaggcaggtggcgggagtcagtttaaggctggcgcccagctttccgcgcctgcgtgctaggcgcaggccgcctctcggaagcttggcctcgcaggagcggctctctatcctgtggggagcttcggccagtgggcctcgtgagctggggtcccgcctggggaatccgcatggcaccggtggtctgggggagaggctgggcctggcgcgggacgaggcgaagcgccggtggccga

SEQ ID NO: 90550 - DNA, 48 bp, Homo sapiens
  chr3:160170146-160170194
  hypo
atatttgagagaccccgcctgctggggcgcaggcggcagcggcgtggc

SEQ ID NO: 90551 - DNA, 36 bp, Homo sapiens
  chr3:160474464-160474500
  hyper
cttcgggatcttcgacgggcacgggggagaggtagg

SEQ ID NO: 90552 - DNA, 196 bp, Homo sapiens
  chr3:160822766-160822962
  hyper
ctgggccccttctcccgcgctcaccggaggcgggcagctgctcgtcaccgagacccgagacccacggtgcggcggctcaacctgggccacgctccgctctagaggagtgggcggtgcctcccggcctagctgccggggtctaggcgtttccgaggacggcgcgttccgggaaaggcgggtccggtggctataccct

SEQ ID NO: 90553 - DNA, 540 bp, Homo sapiens
  chr3:161090003-161090543
  hyper
agcgcagcaggactgcgtctgaaactcggcatcaggctgctaagtgagcccagggctcgggctggggcagcgggcggccaagcaagcatcccaccccatttatttgtcaaaaaccgaagaaagcaaagccttttagcactggcagctaattttggtgcctctgaacgtgtgaaacgcccctccccgccccactcgcatcctgccaccttgcccgcggtagctaggaggttaatcgttaaaaaggtggactcccccagggaaatagatgaaaggatcgtgcccggagaacttgtgtgtgcccactcacaagtgcagagaattaatctcggcccggactgcggcaggagggcaaactggggaaagaaggctgggaggcggcccggtggtgcagagacgcgcggcgcctgctcccgcggctcccggggctggcgtgccctgcgcttacgctccgcgctcgaatatcttccccggagggctcgggaccagcgcgagcaccttccctggaagcccacatccatcacccagcgatctcctctccat

SEQ ID NO: 90554 - DNA, 55 bp, Homo sapiens
  chr3:16220336-16220391
  hypo
caggagcctgtgcctcgggctgtagcgcaccccgtgctatcgccagccacacatc

SEQ ID NO: 90555 - DNA, 30 bp, Homo sapiens
  chr3:163720280-163720310
  hypo
gcctccatttgcctccggattttctggaat

SEQ ID NO: 90556 - DNA, 137 bp, Homo sapiens; identical to SEQ ID NO: 28538
  chr3:164911621-164911758
  hyper

SEQ ID NO: 90557 - DNA, 87 bp, Homo sapiens
  chr3:164912404-164912491
  hyper
ctcccccccatcccccgcccagcactttgggtacccaatgtgcagaggcggtgactatttatcgggtgttatcggaacccatgatgt

SEQ ID NO: 90558 - DNA, 1530 bp, Homo sapiens
  chr3:164912907-164914437
  hyper
aacaaataattaaaacgctgcatcattcattttctgaagagctttgagccgtctatagagccttttctaatctgctgtcgtcaggcgaaacgcacaatggtctgtttagaaacggaaaattattaaaagctcaagcctttttccttctacctcttacaacaccagcgagcattccactgggggaggggtccttcgctccgccacctggcctatttgttggagttacttacgatgtcttcacccagaaaagaggtccgagggtatgttagtctccggtacccctccttccaccaacgtccttacacctaactgatccaattcaaaactgcaacaaacccctagcacctgtgagcgtacagaatacaccgcggccaaactcgatgtgctctacaatgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaattagcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacgtctcctcctaaactggagcgccaggtcgtgtataaggagtcaatataggaaac

SEQ ID NO: 90559 - DNA, 47 bp, Homo sapiens
  chr3:164914438-164914485
  hyper
cagggctggaacctgaatgcaaatccatcagccgcccccaaatcgcg

SEQ ID NO: 90560 - DNA, 461 bp, Homo sapiens
  chr3:164914796-164915257
  hyper
cctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctgagctgtattggtgggcggtatcgctaaacgcctccggggagcggtttccaagtgatttgcagtaatcccccaccttcatgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaatacgtgtaataacacgtatgtgaaagtat

SEQ ID NO: 90561 - DNA, 30 bp, Homo sapiens
  chr3:16498958-16498988
  hypo
gtactcaataaatgccggttatcattatac

SEQ ID NO: 90562 - DNA, 488 bp, Homo sapiens
  chr3:16553978-16554466
  hyper
actgacaccacccagcgtccctagggatcacccataaccacacagggcagctgagggcaagcacagagtcacagacagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcacc

SEQ ID NO: 90563 - DNA, 443 bp, Homo sapiens; identical to SEQ ID NO: 28088
  chr3:16554467-16554910
  hyper

SEQ ID NO: 90564 - DNA, 468 bp, Homo sapiens
  chr3:16554911-16555379
  hyper
acaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttcc

SEQ ID NO: 90565 - DNA, 46 bp, Homo sapiens
  chr3:16555380-16555426
  hyper
cccggtcacctccacgcggccgagctgcaagcgaccctggcagcct

SEQ ID NO: 90566 - DNA, 91 bp, Homo sapiens
  chr3:166984418-166984509
  hypo
cagaaatagggatgacgttaagggtataaaaaactcccggtcccctttgttcagtgtgcacttgcaatcttgattgacgtgagtggcaccc

SEQ ID NO: 90567 - DNA, 91 bp, Homo sapiens
  chr3:166984569-166984660
  hypo
ttgaggcatcggaaattcatttataacaatttggtggctcgtatggggagcccattcttctctggggagggatttccggtcctttcccgtg

SEQ ID NO: 90568 - DNA, 275 bp, Homo sapiens
  chr3:167097912-167098187
  hyper
agtctgcttcccagccgcgctgcccgctctgctccccgcaccaactagcccgggcttgctgcccgctaggcggactcagagaccatcctcccctctcatccacccgcagacagacaacccacctggagaccccagcctctcgcgtcaccaccgccggatggccgcggatagctgccgggagtttccgtcttggtctccttggttaccgcgttacctcggtacccatagcaaccagaaagctgggttctgccactgtccgccggcagagggcgaaa

SEQ ID NO: 90569 - DNA, 30 bp, Homo sapiens
  chr3:16727103-16727133
  hypo
tgtctgatctgatagcgggtcataagaccc

SEQ ID NO: 90570 - DNA, 33 bp, Homo sapiens
  chr3:167916958-167916991
  hypo
ccgggagttgtacaccgccggtgatattgggtg

SEQ ID NO: 90571 - DNA, 315 bp, Homo sapiens
  chr3:167966606-167966921
  hyper
gtgcgtcccaggctgcgctggccagcaccgcagccagagagcttcccgctccgagcaggagcggacgctgttcgtctctggaggggccatggtgctcgcgactggctgttcctccttatatttgggggaaaggagctggtttgaaggaaaggagggattaagtttgtaaaagcgttggctcctccttataactctggtgcctaaagggggtgagatgatagccaaataaaacgaagagagatgaccccgttttgagtgaggaggatttctggatgagccggcgatatgtcctgcaactgtcgatttggcagattt

SEQ ID NO: 90572 - DNA, 114 bp, Homo sapiens
  chr3:167967446-167967560
  hyper
ggtttcagttgctcccggcggagcaggggcatgcagctcagcggccaccgagcctctggggctcgcccggccgctcctcgcgctcccagacgcctgtgacgcctgttggggcca

SEQ ID NO: 90573 - DNA, 445 bp, Homo sapiens
  chr3:167967937-167968382
  hyper
ggggacagacacctgcgggggctgcgggctgtcccgggcggagcgcggcggaacgcagtccccagctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattccacaggtttgaccagaggcaaatcctggctcgtctgccgaagtgaggagctg

SEQ ID NO: 90574 - DNA, 30 bp, Homo sapiens
  chr3:168118785-168118815
  hypo
catgagcaaagttggcgcacatcacagcca

SEQ ID NO: 90575 - DNA, 30 bp, Homo sapiens
  chr3:168156757-168156787
  hypo
aaaaaaacaaacagacgaacaaaagtagtg

SEQ ID NO: 90576 - DNA, 56 bp, Homo sapiens
  chr3:168427120-168427176
  hypo
actgtgaatgtgatacgggatagagactgcatgctgatgaacgcacctgcataagt

SEQ ID NO: 90577 - DNA, 30 bp, Homo sapiens; identical to SEQ ID NO: 40048
  chr3:168490451-168490481
  hypo

SEQ ID NO: 90578 - DNA, 47 bp, Homo sapiens; identical to SEQ ID NO: 28546
  chr3:168864015-168864062
  hyper

SEQ ID NO: 90579 - DNA, 40 bp, Homo sapiens
  chr3:168864583-168864623
  hyper
atcagcagcccccaacgctcctgcacgaaaatcctttcaa

SEQ ID NO: 90580 - DNA, 35 bp, Homo sapiens
  chr3:168865068-168865103
  hyper
ccctttcagatcctccgcagcgccttcgcgggtcc

SEQ ID NO: 90581 - DNA, 134 bp, Homo sapiens
  chr3:16889114-16889248
  hypo
aaataaaaataatctcgaatcctcctacccaaaaggaacgcttaatcttggtgtactttttggtttttcagtcacacacattcacatcaatataatttgtcccagttgagattatcccacgtattgaatttggt

SEQ ID NO: 90582 - DNA, 37 bp, Homo sapiens
  chr3:16892948-16892985
  hypo
atagtaagctgggtgcggtggctcccgcctgtaatcc

SEQ ID NO: 90583 - DNA, 202 bp, Homo sapiens
  chr3:16894319-16894521
  hypo
caggtccagagatcacgctttgagtaatgaggggctagactgttgcactgtcctgtacagtatctaatcaccacatatgactattgaaatttaaatttcagttacttaaaaaggagagaaagtattcttttacaagctgccttttctttttttcttcttaagtcatatatattaccttctaatctcccgaaaatgattttta

SEQ ID NO: 90584 - DNA, 254 bp, Homo sapiens
  chr3:168960226-168960480
  hyper
ggcaactccactctccgctgataacgctcctgcctgctattctccaaggagccggctgctggaagactgctccgaacctcatccccttggtgctcctgatgcgggcgatcctccgactgctcggcgccaaccacaacatgctacccaccgtgagagagcaggacgcgggctgctctagtcaggacttatcgtctatcatactgattgacgaaaccaagagtgagcagaaaaaataaacacgaacagaggctgca

SEQ ID NO: 90585 - DNA, 49 bp, Homo sapiens
  chr3:16925656-16925705
  hyper
tggtgggtcagggggcgaccgaggagggaccacgcggcctgtagggggc

SEQ ID NO: 90586 - DNA, 30 bp, Homo sapiens
  chr3:16925935-16925965
  hyper
ccgcccgcccggggccgggagatcctcggg

SEQ ID NO: 90587 - DNA, 885 bp, Homo sapiens
  chr3:169375895-169376780
  hyper
ttttagaaagaagaccgtggctagtggagtggggaagtcgggagggaactaatgatttatcctgcgccgtccaggagaaaagaaaagcagaccccacagaccgttttagaaaatgcctagacagcggcttccagcggaagaagggttaaccgtcactccaaaaaaatgtacctggcatcatcagagtgtaacttttccctcccaccccatctcttccccaaactcactctcccttgccctatgaggctaggaaggagcctgtcccaacagggagagtgaatgagtgagtgtgtgcctgccctccgcgcaagagtgctccttgtcttcctgaagccaagacgtgtgtgggtgtgcacacgcatgtgtgggtgtgagtttacactgtcaatgtaaacccagctccgagggaagcagcgcgccaggcacgcagcccctctgagactagagagggaaagaagagttctggccaaaccttggagccctgagctgagcagcctgaggagcgaggtgtagggggccccctgagtgagaaactgcctcccacctcactggggcttccccagtcccacccccacgtccatcttgggccacttcctcagcaccagacggttttgagatgaagcgtgggagggctcagctcttgggaacagggctctgggtgccttgggaacagggaaaaagccggtgaccaggagatgacaagtcaaggttctccatctcaccgcccgcttccagcggaggcaacgcgcaggggggtgccgggagagagggggccgagccgggcgtgccgggggcaactccgctctcttgtccttctagcccggggaggagggcgtccccccttcctgccccaggtcacaactgcagcctcggataacctggccc

SEQ ID NO: 90588 - DNA, 385 bp, Homo sapiens
  chr3:169379260-169379645
  hyper
agcagcgagtgtaaagaacaacacccaaaagagaaacagatggactgatgacccaaagagccctatatttaggttgatttctcagacccaggggaaaggaaatgtatcggggagtgtacgagtgcttgggtgaggactgcacaaagcactggaaaggcgcctgggatgacagcatctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttct

SEQ ID NO: 90589 - DNA, 89 bp, Homo sapiens
  chr3:169386544-169386633
  hyper
ttaccttctctacctcgtaaaacttgccgttttgtaaattgcgttttcggtcccagatttcttagcaaatcattcggttttacaatcct

SEQ ID NO: 90590 - DNA, 114 bp, Homo sapiens
  chr3:169427251-169427365
  hypo
ctggctccaaggctgcgtctctccactggactagcgagagggttgtcagtgttttgctcctgggtctgcttccggctgcttatttgaatccttgctctgcgatggactattccc

SEQ ID NO: 90591 - DNA, 36 bp, Homo sapiens
  chr3:169480922-169480958
  hyper
agttcaaggagtccccgcccttgcaaaagggatctt

SEQ ID NO: 90592 - DNA, 30 bp, Homo sapiens
  chr3:169482409-169482439
  hyper
cgagtcctgggtgcacgtcccacagctcag

SEQ ID NO: 90593 - DNA, 215 bp, Homo sapiens
  chr3:169482680-169482895
  hyper
ttgctctagaatgaacggtggaaggcggcaggccgaggcttttccgcccgctgaaagtcagcgagaaaaacagcgcgcggggagcaaaagcacggcgcctacgcccttctcagttagggttagacaaaaaatggccaccacccctcccaggcccaccctccgcaacccggtgcgctgccgggcgagtcggcttataaagggagcggccgccgacc

SEQ ID NO: 90594 - DNA, 250 bp, Homo sapiens
  chr3:169482896-169483146
  hyper
cacggattggccaagctgactctcgcggctctcgtgagagtcactctctcgggcgggctggttggggggaacgggaaattaaagttccatttccggccatgaggaaggacgttgcccttccgcacgtccgggaaaggctttgcgtctttacttccgaccttctttaaaggtgaaactaacttgaggtatcagagggccttttttctatcctctgcagaccagacgcggttcacctcgactaccttaaaaa

SEQ ID NO: 90595 - DNA, 105 bp, Homo sapiens
  chr3:169485356-169485461
  hypo
ctataacttgcacagcggtgttggcaggagccacctttgctatatccttaactaaccgcttgtctaaaccagggaaagaggttgatcccccggcaaggataatat

SEQ ID NO: 90596 - DNA, 250 bp, Homo sapiens
  chr3:169487251-169487501
  hyper
cgccttgatcattcccgagccgttgtcgatcaccaccggtagctggcagtggttcatgccgccgctgctgccgccgcctcctgtctctgagccgctctagctacgggctcggccggggccgagtgcctggaacgccgcgtcacagaggccccggcacggccgggtgaggccagagtcctgggggcgcaggcagggggtcggcagggccccaggcggaaggactcgctggacgcaccgtgctcctcatgtt

SEQ ID NO: 90597 - DNA, 104 bp, Homo sapiens
  chr3:16952388-16952492
  hypo
ctttggttttatcttcgagatataactagtgatagtgtgctgtaagtattattcccaatgtagaatttgtaatggggccaggcacggtggctcaccctgtaatc

SEQ ID NO: 90598 - DNA, 463 bp, Homo sapiens
  chr3:169529938-169530401
  hyper
caaagggcggacccacgggaactcctctccgtggactcctctcctgcccccggtcgcaaagggcgaccggggactcttctcctgccctcgtttctgggcgccccaaacctctggccacagctggggttcccaggggcccccctcccgcctcgacgccttgggctggcgggctgctgggaggactcctgccgtgcgaccccggcgcccctcgcgcgttttgtctgggccaggccgcgcagacgtgctccctacttcttaccgcgctggaccgccagggccgcgcccggagtactggcctgagtggaggcccaagccggggacctggccggcgcacgggcggcctcccgggagctccccatgctcctctcacccactggccgcggcggctgcgctgccatggcgaccgcgcgcgcacttacagtccgcctgcagctgtgaggcggctacacgagcctcggcgcca

SEQ ID NO: 90599 - DNA, 711 bp, Homo sapiens
  chr3:169539898-169540609
  hypo
ccccaggagattcagcgtttaaagaacatcagggtcctctacctggataagaacaacctgaggagcctgtgcccggcgctggggctgctgagcagcctggagagcctggacctgagctacaaccccatcttctcctcctcccttgtcgttgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcagg

SEQ ID NO: 90600 - DNA, 154 bp, Homo sapiens
  chr3:169540980-169541134
  hypo
tcatttacctcacaacgactgtgtcctcaatggtatatgaaggaagtgaggggcagggagcttaactaacatatccaaggttacacagcctgtaagtgctgcagccgcgattccagcccacagctgccaggctccagggtctacattctttttt

SEQ ID NO: 90601 - DNA, 19 bp, Homo sapiens
  chr3:169579288-169579307
  hypo
agagcgagactccgtctca

SEQ ID NO: 90602 - DNA, 30 bp, Homo sapiens
  chr3:169900402-169900432
  hypo
tcttccaagaagtagcggagcgggttttat

SEQ ID NO: 90603 - DNA, 22 bp, Homo sapiens
  chr3:169980664-169980686
  hypo
accttcttttgtggccgggcgc

SEQ ID NO: 90604 - DNA, 38 bp, Homo sapiens; identical to SEQ ID NO: 39880
  chr3:17001303-17001341
  hypo

SEQ ID NO: 90605 - DNA, 30 bp, Homo sapiens
  chr3:170025781-170025811
  hypo
taaccagtttctccccgaaaggtacaacca

SEQ ID NO: 90606 - DNA, 420 bp, Homo sapiens
  chr3:170136627-170137047
  hyper
aagagggggcgggggcgcgctgcccagcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccact

SEQ ID NO: 90607 - DNA, 32 bp, Homo sapiens
  chr3:170266977-170267009
  hypo
tccagactgggacaccggccttcttctttttt

SEQ ID NO: 90608 - DNA, 656 bp, Homo sapiens
  chr3:170302487-170303143
  hyper
gagaactttcagcaccgcggacagcgccattccctgcactcagtcggaggaggagagctaccttgcccccagcgctctcctagaccctatacctagggggaggcagggtgacatcctgcggcccttgggcaattcgggccagtgacgttcaccgacactcaggcggggatcccttcgccagagccagttcctttgagtgtctccgctcaaaatctcaaggaaacgagcttcacacaggtggggggatgaggagtgccagaacaggagcgagccccgctgctctagccttcctgcatctcttctcgcctttgctttgctcactcttcaatcgcaatataaaatactcatttggggagggggcagggtgacacaggagagagaaggagggtgggggctgcatcccgcgtggccacgcagccctaacctggccctcttggattagaggggagctgatgtgctttggaatgggagaagagaggagactgagggttgaagcagtgcaggagagctccccttgctggggctgccggctctgggcagggagcttccctggacaccgctcccgtcacgtcctcttcgccgctcccgggagagtcaccactctccggggacagacgcccctcggggcgccaccatcctggtcggggtgctgggct

SEQ ID NO: 90609 - DNA, 116 bp, Homo sapiens; identical to SEQ ID NO: 28558
  chr3:170303379-170303495
  hyper

SEQ ID NO: 90610 - DNA, 377 bp, Homo sapiens
  chr3:170303554-170303931
  hyper
cgccatattcctggtcccccgctcccggtgactccggctccctgggtcattccgggagaggcggccatcccagttgcaggggtcccgctggggcgcggggggcgcggagggggacaaacggcagcgaagggggccgttcacttaccggggtcggggctggaggcgacgagctggctgccaaggctggtggctggcagtccgcacttactgcgcggagctgtctctctagctgggatgggaagtggtggtggcggcaaaggaaggcaggaggcagccgctgctgctgaacagctcctcaattattcagattgggcccccaccccccgaacccctccccgtgcctgctcgtcctccctccagctcgcctgtctccgcct

SEQ ID NO: 90611 - DNA, 31 bp, Homo sapiens
  chr3:17048624-17048655
  hypo
tatcaaaggtaaatgcgtcttttaaaaacta

SEQ ID NO: 90612 - DNA, 109 bp, Homo sapiens
  chr3:170583189-170583298
  hypo
tttgccaaaccatttcgattagagctttcaaaggccagtttattcgggagaaagggtccatccacttgtaagtttcaatagacaaccaacacgccggtgttggggtagg

SEQ ID NO: 90613 - DNA, 346 bp, Homo sapiens; identical to SEQ ID NO: 28560
  chr3:170625828-170626174
  hyper

SEQ ID NO: 90614 - DNA, 254 bp, Homo sapiens
  chr3:170626456-170626710
  hyper
acaccccagcctccccgcccttacccgcccccactcagccctatttccgggataggccccggagcgtcacaggcaccgccctctcgggctaccattggctaccagattcccgaggctccgcccagtcacgtgaagagcgccctggcaaccccacgtgctgcggattagtgcacttccggcgtggagcgcactttcagcagtctggttgccgagggtgagctcgctggcagaggaacttgcgccttccaactctt

SEQ ID NO: 90615 - DNA, 18 bp, Homo sapiens
  chr3:170627856-170627874
  hypo
atccggccactgtactcc

SEQ ID NO: 90616 - DNA, 20 bp, Homo sapiens
  chr3:170831096-170831116
  hypo
tataaaatgctaattcggcc

SEQ ID NO: 90617 - DNA, 30 bp, Homo sapiens
  chr3:170957950-170957980
  hypo
gcctccagtttaggtcgactcatcagggat

SEQ ID NO: 90618 - DNA, 30 bp, Homo sapiens
  chr3:171036849-171036879
  hypo
cctatttacttgggacgctaaaatgggaag

SEQ ID NO: 90619 - DNA, 30 bp, Homo sapiens
  chr3:171095156-171095186
  hypo
ttagatcaccctccccgctcagctgcttca

SEQ ID NO: 90620 - DNA, 30 bp, Homo sapiens
  chr3:171139798-171139828
  hypo
gtgacctaccacgcccgaccagttgtgtaa

SEQ ID NO: 90621 - DNA, 30 bp, Homo sapiens
  chr3:171147897-171147927
  hypo
tgaaataccgccttacgttgtttgatcttg

SEQ ID NO: 90622 - DNA, 283 bp, Homo sapiens
  chr3:171528050-171528333
  hyper
cactcgctgaaatcccgtccaagttgggcggggagcggccagctgcccaggttgggcggaggagggacggagggcgagggcagtggaaacccggctcccacgggcgcccggtgatccgggtctcggcgcggctcctacctgcagggcgaaggggccgctagcacctgcgcgttggcggcggactctcagggctcgggtgcctctggcacagctggagctcagcgggagggagggagagagggcgggccggagggggctctgcgctgcgcggccggcaggaact

SEQ ID NO: 90623 - DNA, 27 bp, Homo sapiens
  chr3:171661628-171661655
  hypo
cgtgagcctccgcgcccagcctgagaa

SEQ ID NO: 90624 - DNA, 145 bp, Homo sapiens; identical to SEQ ID NO: 40054
  chr3:172033174-172033319
  hypo

SEQ ID NO: 90625 - DNA, 353 bp, Homo sapiens; identical to SEQ ID NO: 28562
  chr3:172165432-172165785
  hyper

SEQ ID NO: 90626 - DNA, 368 bp, Homo sapiens; identical to SEQ ID NO: 2318
  chr3:172165866-172166234
  hyper

SEQ ID NO: 90627 - DNA, 278 bp, Homo sapiens; identical to SEQ ID NO: 28564
  chr3:172166235-172166513
  hyper

SEQ ID NO: 90628 - DNA, 222 bp, Homo sapiens
  chr3:172166672-172166894
  hyper
cgctggactagtgtgccccggaaggacaggtcacacccgggggtgggggtgaagacgacggtggcggtggggaggacacctttagcagctgggacctgatttcttcctccacaaggctgcagctggctatggccctggtggaaagaaaaagcgagcttgaccaactcgacttgggaagggggatagagagagaaaagaaggaccttgtgtttgtattcatac

SEQ ID NO: 90629 - DNA, 475 bp, Homo sapiens
  chr3:172166999-172167474
  hyper
cggatctcccacccggttgggacttctgagcgcacaggggcaagatatgtgagtaaaccctgtccagaatcccagtcctttgtatcactcggtagtggtagagagtctgctgtagggtatattacttttgcttgatgcaaacctggtggcggggtgccgaggttggtcagggagggaacaggagaaaggaaaaaggcagggttggaggtgtgtggaggcggcaagtgaagaagaggctgtgaggctggcgcgtcgagagtgtgcaggaaacattttttgaggcataactgagagagatcagccatttagtagccgtattcccttgggcaaggtcttcaacctcctgagcattacgtctttttctttgaattgcaatgatttgtgcggaccactgggggtgatatcaagtgtcagggaccaccggaggcactcaataaatagaagacgcgttgctgttgagaagtagaagctgtgc

SEQ ID NO: 90630 - DNA, 322 bp, Homo sapiens; identical to SEQ ID NO: 28568
  chr3:172167595-172167917
  hyper

SEQ ID NO: 90631 - DNA, 30 bp, Homo sapiens
  chr3:172263919-172263949
  hypo
gccatcatgcctggccgatatagaaatatt

SEQ ID NO: 90632 - DNA, 37 bp, Homo sapiens
  chr3:172355768-172355805
  hypo
ggaagttgcagtgagctgagatcgaaagaacaagacc

SEQ ID NO: 90633 - DNA, 16 bp, Homo sapiens
  chr3:172356006-172356022
  hypo
gcagtgagctgagatc

SEQ ID NO: 90634 - DNA, 58 bp, Homo sapiens; identical to SEQ ID NO: 14590
  chr3:172384961-172385019
  hypo

SEQ ID NO: 90635 - DNA, 22 bp, Homo sapiens
  chr3:172395425-172395447
  hypo
ttggtgggggaggggcgggggg

SEQ ID NO: 90636 - DNA, 30 bp, Homo sapiens
  chr3:172424700-172424730
  hypo
tttttctttgtcttacggtgctgatgaaca

SEQ ID NO: 90637 - DNA, 35 bp, Homo sapiens
  chr3:172425347-172425382
  hypo
atctggggaacttttcgttttttatttttattatt

SEQ ID NO: 90638 - DNA, 35 bp, Homo sapiens
  chr3:172425682-172425717
  hypo
ttcttaaacactgctaagaacgttcatctcccaga

SEQ ID NO: 90639 - DNA, 225 bp, Homo sapiens
  chr3:172466199-172466424
  hypo
caataaatttttcaccgcaaatacagctatctgctagaagtgccatgagaacaaggcccatatttgtcttgtcacacctatattctcagtgctagcatagtacctaatgggtgcttaatagttattaaatgaataaactatgattaggttaatcaggacatccagtctctcaaacattatgaatgaacttggatctagctcattcactctcgaaatatttatttg

SEQ ID NO: 90640 - DNA, 31 bp, Homo sapiens; identical to SEQ ID NO: 40058
  chr3:172469925-172469956
  hypo

SEQ ID NO: 90641 - DNA, 31 bp, Homo sapiens; identical to SEQ ID NO: 40059
  chr3:172470196-172470227
  hypo

SEQ ID NO: 90642 - DNA, 30 bp, Homo sapiens
  chr3:172550135-172550165
  hypo
ttgttattctcacaacgtgcactttatatt

SEQ ID NO: 90643 - DNA, 284 bp, Homo sapiens
  chr3:172727266-172727550
  hypo
tgcctggaatctgtgcggaggcaccactcaagcccatgtgaagcccaatggatcttggatcccagagcaccctagagccagctacagtagccccaccaacaggggaggctaggctctttcgcatgcccttaggatagctgcagcagccgcagtgctcaggagcagactacagaccgcacctctgctgctgctcgccaggcaagtcccaccggcttgggcctccagtgtgcacacctgcctgtgttactggtcataggcagttgtccaggttcttggtgttttga

SEQ ID NO: 90644 - DNA, 44 bp, Homo sapiens
  chr3:172727610-172727654
  hypo
aacgaaagtgcacttcacagggcaggagccggctggagcaagcg

SEQ ID NO: 90645 - DNA, 116 bp, Homo sapiens
  chr3:172858974-172859090
  hypo
cccaacgtcccactgcgaggcctgatcaggctgcttgctcgcggggacgccaggacttgaaacgtcccgtgccacgaggcccatcgcgcccacaagtggcgcgggtcactggcacc

SEQ ID NO: 90646 - DNA, 604 bp, Homo sapiens
  chr3:173113090-173113694
  hyper
tgcgttcacactactcgcacggaacagtctacagccaacgaacgcttcaattcagagattactctgcctctagctagaggaagcagaggaaagagaggggagtttggtggctagagatttaccaaaaagaggggggcgggggaaagaagaggcacagtggaaggctgttgcctccaactccgcgctctccgtcaccaagacgaaaacgcctggaaccggagcacgatgacgccgagaagacagaaactcagagcgtccgacgcctcgcgtctgggcggtcgtgcccgttcactcacacgccgctctgagtggtttggcgaacctcacacgtgactccctgggcccttcacccctcctgccgccgcgggcgctgcggaagctgcgggcggaggacgctcggctgccgcgggaggagtaagggaggagggcggaacttgtaaagggaggggccatcaccagcaccaagtctgccaccgccggacccgcgcccccgaagcccacccccaccaagatcgcgcctccgaccggcgggaggggcgcgcaggggaggggacgctgtgcaataaaccgggcggggagagggaggcagcggagggagtcctgg

SEQ ID NO: 90647 - DNA, 451 bp, Homo sapiens
  chr3:173114136-173114587
  hyper
ccaagttttgctcttcgctgtcccctcccgtttacagaagcatctgtggtgcttttcattttggatttacatgcaggaaacgtatatatgtttatataccgaccgcataatatataaatacatatacgcgtgcccaagggcctggttttcgtctctcctccccacgaaacggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggtaagggagcttcctgcgtccgccgagctccggcgtttaccttaatcccggggattgccgagaacttcctattccctgcctctccttcgccttccccacctt

SEQ ID NO: 90648 - DNA, 709 bp, Homo sapiens; identical to SEQ ID NO: 28571
  chr3:173114985-173115694
  hyper

SEQ ID NO: 90649 - DNA, 218 bp, Homo sapiens
  chr3:173115957-173116175
  hyper
ccttgcctgaaccctcggcggagcgcagaggagctgctttcagccttctgctctccccaggccctccggctagttctggggttggttccgccggttagtttgacagggataagaaagttgctcttcttccccacaacgtttcctgagaggtggttttcagatctgtgtgtttccagtcaagatgtcactccctagatcccccgcgttgagcaactaat

SEQ ID NO: 90650 - DNA, 258 bp, Homo sapiens
  chr3:173302411-173302669
  hyper
agccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgct

SEQ ID NO: 90651 - DNA, 491 bp, Homo sapiens
  chr3:173302734-173303225
  hyper
cgaagtgttgtagagaccgtctccttgaatcattgcaaagggaccggggaaagatgagggggctccctctgtggatttatcttgctgagggtaagtttgtggctcttttattgggagggggctgccagggttttgtgccactgcgcggaaggtgatgcggacgcggtgcctgtgaaatggagagagaaaggggaatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggcttctagggg

SEQ ID NO: 90652 - DNA, 30 bp, Homo sapiens; identical to SEQ ID NO: 39848
  chr3:1741068-1741098
  hypo

SEQ ID NO: 90653 - DNA, 36 bp, Homo sapiens
  chr3:174159270-174159306
  hyper
ggcgccgcgggcccgcgcgttcgaaatggcgcgcag

SEQ ID NO: 90654 - DNA, 66 bp, Homo sapiens; identical to SEQ ID NO: 14524
  chr3:17499802-17499868
  hypo

SEQ ID NO: 90655 - DNA, 37 bp, Homo sapiens
  chr3:175338134-175338171
  hypo
tgcaaccagcatccacgttgggcgccagcgtcaagat

SEQ ID NO: 90656 - DNA, 31 bp, Homo sapiens
  chr3:176545097-176545128
  hypo
aaaagagaatttttccgacgggtgtttttcc

SEQ ID NO: 90657 - DNA, 30 bp, Homo sapiens
  chr3:176837181-176837211
  hypo
ttttatttttccaatcgatggctggattcc

SEQ ID NO: 90658 - DNA, 206 bp, Homo sapiens
  chr3:176853680-176853886
  hypo
tggaattggccttctcggattaaccccagagtgctttttattccttcccaatgaggaaattacctaaaactgttaagccagacgaaccaagatctactggaatccaaatctctccatcttccctttactccaatagatcagtatctaaaatcaggggttttcaaactgcaggtcacaatcagtttgtggatcgtaaaataaattta

SEQ ID NO: 90659 - DNA, 24 bp, Homo sapiens
  chr3:176869535-176869559
  hypo
tttcccagacgggcacggtggctc

SEQ ID NO: 90660 - DNA, 17 bp, Homo sapiens
  chr3:176871397-176871414
  hypo
aggcgcggtggctcacg

SEQ ID NO: 90661 - DNA, 41 bp, Homo sapiens; identical to SEQ ID NO: 40063
  chr3:176872455-176872496
  hypo

SEQ ID NO: 90662 - DNA, 197 bp, Homo sapiens
  chr3:176897068-176897265
  hypo
agtgtactttgagctcgactattgttacctgatgcaaaacatgaatatgctggggaaaatcacgtatgaaccagagcaatctccttgttgtactgacataattctcgtatttaccaattacatatgagcctattccggatacagacacacgctggagcacaaccaagtattcttttaacttacggtatctgttttat

SEQ ID NO: 90663 - DNA, 30 bp, Homo sapiens
  chr3:177158305-177158335
  hypo
aagggcttgtatgagcgttgaatgagattg

SEQ ID NO: 90664 - DNA, 28 bp, Homo sapiens
  chr3:178577720-178577748
  hypo
aaacaaaataaagttcggaaggggagcc

SEQ ID NO: 90665 - DNA, 30 bp, Homo sapiens
  chr3:178833103-178833133
  hypo
acccttaaattgaaacgctactattaatgt

SEQ ID NO: 90666 - DNA, 34 bp, Homo sapiens; identical to SEQ ID NO: 40066
  chr3:178861413-178861447
  hypo

SEQ ID NO: 90667 - DNA, 30 bp, Homo sapiens
  chr3:179031625-179031655
  hypo
ggaagggtttattcccgcttaaatgaaact

SEQ ID NO: 90668 - DNA, 30 bp, Homo sapiens; identical to SEQ ID NO: 40067
  chr3:179136841-179136871
  hypo

SEQ ID NO: 90669 - DNA, 979 bp, Homo sapiens
  chr3:179168661-179169640
  hyper
taattttggactcagcgtagaacttttatgagtcttccaagcactctccacccaacagccctgctgggcagtcccgaatacccgttattttgggggcacgcacgggctcgtgctctgagttcctggaaggaggcctcggggagtgacgagaaaccaggggggtctgcaggacttggaccgccgaccgttcctcgctccccggggcgagcggtctggaccgcccgggaagtgcctgcgccggcggtcgtggggccagttcccgcgtggcagctgggcgcgacacaggcgcgccctcctcgtccctcccgggcagcgtcggccgcccgagcccggggagacccgccccgccccgcgccgtcacccgggccccgttccgcaggggtggctcgcggcgccccacgtccctgcgagaagcccgggatcgcttcgcggggcgcaccgacgagccgccgctcgcgagctcgccgcctacctggagggagctcaggcccgcgtcgaccgcgcgctgccggtgtccgctgggcgctcagcagcccctggagcgcggagccggcgtggagagcgcagctcacagccgagaccagagccgccggccacacccagtcccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 90670 - DNA, 23 bp, Homo sapiens
  chr3:179171196-179171219
  hypo
accgatcccggccccatattctt

SEQ ID NO: 90671 - DNA, 30 bp, Homo sapiens
  chr3:179183022-179183052
  hypo
agtcagacaaaaagccggttatatcactcc

SEQ ID NO: 90672 - DNA, 184 bp, Homo sapiens
  chr3:179740682-179740866
  hypo
ttgagtgcagagtatcggtaaagctatttggattctacatctgtgttgagtaagtggtagaaagaatgcatcagtgatttctaccctccaaggccaccgcaatgtccagaaaacttgcaaaatcattttatctcctgttagttgagtcattttgcagcggctgaggtaccgacatggagatatg

SEQ ID NO: 90673 - DNA, 15 bp, Homo sapiens
  chr3:179754178-179754193
  hyper
cccttctcccacctt

SEQ ID NO: 90674 - DNA, 245 bp, Homo sapiens; identical to SEQ ID NO: 28577
  chr3:179754238-179754483
  hyper

SEQ ID NO: 90675 - DNA, 276 bp, Homo sapiens; identical to SEQ ID NO: 28578
  chr3:179754484-179754760
  hyper

SEQ ID NO: 90676 - DNA, 70 bp, Homo sapiens; identical to SEQ ID NO: 336
  chr3:179754803-179754873
  hyper

SEQ ID NO: 90677 - DNA, 286 bp, Homo sapiens; identical to SEQ ID NO: 337
  chr3:179755086-179755372
  hyper

SEQ ID NO: 90678 - DNA, 30 bp, Homo sapiens; identical to SEQ ID NO: 40070
  chr3:180042862-180042892
  hypo

SEQ ID NO: 90679 - DNA, 87 bp, Homo sapiens
  chr3:180319834-180319921
  hyper
agtctcgctcggtttcgcgagatcgaggctgagctccgccgcgccgccgtgggggcgaccccagaacacttccgggtgtaactggtt

SEQ ID NO: 90680 - DNA, 732 bp, Homo sapiens; identical to SEQ ID NO: 28581
  chr3:180397310-180398042
  hyper

SEQ ID NO: 90681 - DNA, 121 bp, Homo sapiens
  chr3:180547113-180547234
  hypo
gcttggcagcagccccgcatcactgtggcccgcagacctcgggtgatggcctggccccggcagcccagctcagcatgctggcggcacttccagtacaccttgtccccgacagccttctcct

SEQ ID NO: 90682 - DNA, 1009 bp, Homo sapiens
  chr3:181413421-181414430
  hyper
gacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatgatatttattcaccgaagtcccaatctg

SEQ ID NO: 90683 - DNA, 99 bp, Homo sapiens
  chr3:181419696-181419795
  hyper
tgttggctcagaaaccgtgtaatttctcatccgataggagtttctttatgagaacatcaaaggataaaaagctctgcattttcgtagttggttaaaatt

SEQ ID NO: 90684 - DNA, 638 bp, Homo sapiens
  chr3:181419915-181420553
  hyper
aatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctgcttgctgttttgacgttgtcagcagcgtcttgaatgccctcagaggtcctgcaagtatcgtaactgagccttcgagtaaacgaaataacttgctt

SEQ ID NO: 90685 - DNA, 1926 bp, Homo sapiens
  chr3:181421249-181423175
  hyper
acctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttgataaaatctctaccccgaattctatggaaaagacaggcaagcgggattccagccacagcacccccaccttttgctctaccaaaaggcttgtccccattacagaaataatatagtcggtgctagttttgtgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccacttagcttaggcccactgagaccctgccaactcctcagacccttttccccttcatccctcacacctttcatgatgaacccaggaaagaacccgaactctgaaaaacagtacatgtggtttgaagtttgatagttatttgggtgtgagggacatgactctattaataaagactaagattcaaggctgagctctcatttattaaatttgctctttcactctgttttcaaactctggagatctttcagtttcgttgctccaaccctgacacagacaaaggcgccagggagaaagcccaggcgggcttgaagcagttgaggtatagactgatactcatctctccatcactcagacgggcagataagcactgccagactgggggtcctaatccagggcccagcggctacgtgggttgctgcggggtgttgaaaccacaagtacaacttgacaccattgagcccacggtgcttgtcaataatctgtgaattaggtgcagagattgtcactgtagatcataacagtttctgaaggactcattacagcctatcgtgtcaatgatcttcaaattaaggaggggaggtggggcgagacgaaaaaggagtggggagagccagcaaaaagggaagaagggtgggagggaagataaaagtcagagccccagctccgaaggagcctttaaagattatcaggccagcgatctgagaattccattgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtg

SEQ ID NO: 90686 - DNA, 568 bp, Homo sapiens
  chr3:181428260-181428828
  hyper
actacctatttgtaacggacgtgctgccattgccctccgcattgagcgcctacctattgaaatctttacgtcgggacaatgggagagcggctaaaattaccctcttgggtcctgggcgggcaagattcctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttcttacggggaggcatggga

SEQ ID NO: 90687 - DNA, 111 bp, Homo sapiens
  chr3:181429607-181429718
  hyper
ctttcatgcaaaacccggcagcgaggctgggctcgagtggaggagccgccgcgcgctgattggtcgctagaaacccatttattccctgacagcccccgtcacatggatggt

SEQ ID NO: 90688 - DNA, 277 bp, Homo sapiens
  chr3:181430054-181430331
  hyper
ctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccag

SEQ ID NO: 90689 - DNA, 721 bp, Homo sapiens
  chr3:181430695-181431416
  hyper
acccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggacct

SEQ ID NO: 90690 - DNA, 233 bp, Homo sapiens
  chr3:181437066-181437299
  hyper
gctggaggtgtccttcgttttattaccctagtctgcctgcgtgtacagaatgaagggtgcactgttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgac

SEQ ID NO: 90691 - DNA, 269 bp, Homo sapiens
  chr3:181437300-181437569
  hyper
agctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagccctctccatgttgacctcgtgacacgggagacggtgtct

SEQ ID NO: 90692 - DNA, 270 bp, Homo sapiens
  chr3:181438167-181438437
  hyper
gtattaaataaggagcggtgaattcttcccaagggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagaccccgtctccagaacata

SEQ ID NO: 90693 - DNA, 1641 bp, Homo sapiens
  chr3:181440785-181442426
  hyper
gaccttccaagagttcgttttacatttgttgaagcccaggccttggtgcctcaagttttaaatggaattactcaaggggggcacactactagacaaactattctagccaattccttcatccccgacccagtccctactcctctctgcccccgcccacttcgccacttcttagtcccggatctgaacattttagctgaaagagggaggggtgaggaaagggccaggacagttccctcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttg

SEQ ID NO: 90694 - DNA, 587 bp, Homo sapiens; identical to SEQ ID NO: 28595
  chr3:181442963-181443550
  hyper

SEQ ID NO: 90695 - DNA, 475 bp, Homo sapiens
  chr3:181444050-181444525
  hyper
cataattatgcactgcagattctccagcctcctcgccctcaatcttggtaacctggtctttggttaataatatcgcaactcgggacttcaacgctcagaccccctccaggccccagcctccgtattctcggagccctccactactgatacctctcgcggagtgcggcgccccgggaaaagcctcttggccagggactctgggacattactttctagtttgttttgttttttgtttttctcccagagaccaccaccaccctcatcctcttcaggcagcatttaggagaggacctctgagatcagcagaaggcctcagacggtcaccatattggtggaagcgtttgtctgatgttttaaaacgtataccaaacggggcgtcagggccacgtgctgtgccttcgaaacgccgccgcgggccctgcctttcagagctgcggcagccggggctggcgtggagggggcgctgaaacaccgg

SEQ ID NO: 90696 - DNA, 155 bp, Homo sapiens
  chr3:181444612-181444767
  hyper
cgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgca

SEQ ID NO: 90697 - DNA, 122 bp, Homo sapiens
  chr3:181444827-181444949
  hyper
ttgcgtcttgcgcagcgcagacacctccactctggattgaaacgaaaaagctcgcggtaagagcagaaaattggtctattgatacattcgctccgagtgttgatcttggcatcaccgatagc

SEQ ID NO: 90698 - DNA, 1 bp, Homo sapiens
  chr3:181444988-181444989
  hyper
c

SEQ ID NO: 90699 - DNA, 735 bp, Homo sapiens; identical to SEQ ID NO: 28601
  chr3:181444990-181445725
  hyper

SEQ ID NO: 90700 - DNA, 189 bp, Homo sapiens
  chr3:181445799-181445988
  hyper
cggccagtctcagtttttctctgaataatccctgagggtaagtcctccgggcttttaaagagctctagtattttttttttaaagaataaaaagaaaaacgttcgattttagtttagacctcgtcaacttttagtcgctaacaggcatcactcaagccagtcaatacttaatgaccgttagttacccttg

SEQ ID NO: 90701 - DNA, 516 bp, Homo sapiens
  chr3:182314781-182315297
  hypo
caacacattcaaaagcgggggggtgggggttctgtatttatctggaagtaagtaagcacctgtattaataataagactagaatctcagaatctgtttaaaaatatgcttttaatatgaggatgaataaagcacggagaacccgagggagtgtgaagatcaaatcaggtgtctttcggtcagtggaggaaacacccggaagcagtgaaacgcactgggcttattgcaacaaccccagctactgaaaatgccaccctctccacgacgaagcaccgccagtcccaaactccaatcagccgctgggctgggaggccgaaaaggcaagaagacacagagcggggttgaaatgaagaaggaactctttttcaacgagactcattacagtatgcaaaacctaaaaaactgtaccctgtgttgtaatgagaatatgactgcatgggaaatgtgggttacaactcttgactttacctgcttttcacatattttcacatagtgagtaaaatcgctgtgggaggaaa

SEQ ID NO: 90702 - DNA, 20 bp, Homo sapiens
  chr3:182457888-182457908
  hypo
agcctccgtggctggcgcgg

SEQ ID NO: 90703 - DNA, 21 bp, Homo sapiens
  chr3:182704506-182704527
  hypo
agcaaatgggctgggcgcggt

SEQ ID NO: 90704 - DNA, 30 bp, Homo sapiens; identical to SEQ ID NO: 40073
  chr3:182800477-182800507
  hypo

SEQ ID NO: 90705 - DNA, 19 bp, Homo sapiens
  chr3:182812783-182812802
  hypo
tgccctggccaggcacggt

SEQ ID NO: 90706 - DNA, 148 bp, Homo sapiens
  chr3:182815981-182816129
  hypo
gctgcgattacaggcgtgagctaccgcgccccgccaacttccaacaactttcttatgtttctctggggcactcctacaattaagtaactaaaaagggcatctacaatatttctggaaaataaaagcaagcaaacgttcatataaatgg

SEQ ID NO: 90707 - DNA, 64 bp, Homo sapiens
  chr3:182834167-182834231
  hyper
attcccctgcccttgcggactggctgcgcctgctgtttccctgcccgtgcgcactgactgcgcc

SEQ ID NO: 90708 - DNA, 34 bp, Homo sapiens
  chr3:182895956-182895990
  hypo
attaaaaataaattccggctgggcgcggtggctc

SEQ ID NO: 90709 - DNA, 497 bp, Homo sapiens
  chr3:182896611-182897108
  hyper
tgctgggaggcggaccgggagctcccagtctgcggcccccgccgggttggagcggctccggctcctccaaggctcgggctaagcggctctcaaccgattcccaccccgccctggagaaatgcgggcgtgtctgcaggcatttttgattgtcacgatttgggggcggggtggaggatggggtggcgcattcctggcacctagtgggtagaggccaggggtgctactaaacatcctaccgtgggagcacagagaagcccacgcagcaaagaattgcccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacac

SEQ ID NO: 90710 - DNA, 313 bp, Homo sapiens; identical to SEQ ID NO: 28605
  chr3:182897157-182897470
  hyper

SEQ ID NO: 90711 - DNA, 239 bp, Homo sapiens
  chr3:182971103-182971342
  hyper
ccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtaaagtcactgggaagctggcctggggcggggtttccccctcttctcgtattttagaaacggacagcggcagtgcagccct

SEQ ID NO: 90712 - DNA, 531 bp, Homo sapiens
  chr3:182971927-182972458
  hyper
ccactccgggccgagcgaggtctctggaggagaagagtggcgaggaggtgagggcacgccggccctcgcccggcgggtggcgccaggacttcaggtgggaacgcgcgcttgggccgggggcgcgtggctggcgtggacaccggatcggggcccgccgccctggcccggaccgcgcacggcccagcgccgggaagtcgggaagccggggaggcctctcccaccgcgggccccggcagcccgccctctgaaagcgcggcggagaaggaggctcgtcccctccccggaacgcctttgttccctccggcctgcccgcgcgggtggccagcggctgggacccaggccgggccgccgcccaggtgcggcaggtaggctcgggggccgggcagctccggttggggcggcttcccggggcctgcgggtccccgtccctgaggagctccggctcctcggtggcgggacaggcccgtgcgcgggagccgcgaggcgaacgccgcgcccaccaattcggttgccggccgggggccccaggct

SEQ ID NO: 90713 - DNA, 30 bp, Homo sapiens
  chr3:182987335-182987365
  hypo
ttcctgaaggatgcccgtgtggaagaattt

SEQ ID NO: 90714 - DNA, 121 bp, Homo sapiens
  chr3:182987831-182987952
  hypo
gtgtcaagctcaagacgtcctccttttactgtttgtaaaaactgctcctgaaaactatgatcgacgttccggaattagaaggacgtggggcaatgaaaattatgttcggtctcagctgaat

SEQ ID NO: 90715 - DNA, 79 bp, Homo sapiens
  chr3:18299771-18299850
  hypo
ggcatcactcgtcaacgttatccctaatggaggcaagaaagccgagccttttttttttttttaatgacggagtctcgct

SEQ ID NO: 90716 - DNA, 30 bp, Homo sapiens; identical to SEQ ID NO: 40078
  chr3:183035309-183035339
  hypo

SEQ ID NO: 90717 - DNA, 36 bp, Homo sapiens
  chr3:183070301-183070337
  hypo
ctttgtctcaaaaaaaaagaacggactaaaggctga

SEQ ID NO: 90718 - DNA, 30 bp, Homo sapiens
  chr3:183084014-183084044
  hypo
ctggatgctacaaatcgatggatcaatgtt

SEQ ID NO: 90719 - DNA, 247 bp, Homo sapiens
  chr3:183145371-183145618
  hyper
cacccaccctactcccgtcagaagcagctaacggatggtaacagcccagcagccctcggtttggagctcaacggactcggcaaccacctggtgaaggcaccagcctcggccccccgacccccaccagcggcgcgccccagggatgccccccgctgggcaccgcaggcaggacccagagcagcgaggcccagatgccgggcaaccccccaggaagcgcgctgccccggggcagcgggtgaggccagga

SEQ ID NO: 90720 - DNA, 43 bp, Homo sapiens
  chr3:183183687-183183730
  hypo
cgggccatgaaaaaagctttcagtgttccgatgagttccctga

SEQ ID NO: 90721 - DNA, 30 bp, Homo sapiens
  chr3:183196555-183196585
  hypo
cccctctgtgcccagcgctgtgccccctcc

SEQ ID NO: 90722 - DNA, 84 bp, Homo sapiens
  chr3:183214546-183214630
  hypo
ttctgttgatttagccgtgtataacaagcatgctttcaggtattgcttgtatcattaaaaagtgaacaacaaatttatgacaaa

SEQ ID NO: 90723 - DNA, 92 bp, Homo sapiens
  chr3:183355362-183355454
  hypo
ttaatagggtatttgcgttttgtcagattttcttctgcagatataggaattcactcaagacttaatacacttgttttgtttttgagacaggg

SEQ ID NO: 90724 - DNA, 141 bp, Homo sapiens
  chr3:183531359-183531500
  hypo
cgtcatagtgcagcccgtggctgcttgaggcagctcccgcagtggcagcttgggttgtgaaataattaaaaagttaacattttcttttgtctggaatttgctaacatgttgaactgctttttatttatttagagacagagt

SEQ ID NO: 90725 - DNA, 138 bp, Homo sapiens
  chr3:183543365-183543503
  hyper
ggcgcgcggcgctcccggccgcgcctcctgcgcccagcgtccccgcccccgcggcccgccccgcgccgccgcagcaccgccccccggcacgagggtgggcgtcccgggagggggcgcactcggcggcagccccacttg

SEQ ID NO: 90726 - DNA, 99 bp, Homo sapiens
  chr3:183603067-183603166
  hypo
ccctagaggaaccaacgtggcaagccaagttttcttaaattactacttttttctgcatctcaccacttcgtgttattctgtatgcctttaacaaagtcc

SEQ ID NO: 90727 - DNA, 172 bp, Homo sapiens; identical to SEQ ID NO: 40081
  chr3:183622013-183622185
  hypo

SEQ ID NO: 90728 - DNA, 274 bp, Homo sapiens
  chr3:183643321-183643595
  hypo
agttcctgaaggactcggtacctgtccctgggccagcaccataatcctatcggagcctagaaccgtgtgcaggcgatgggcaatggtcagcatggtacagtctgcaaatgcttctcggatggtctcttgaatcaataagtctgtctctgtgtccatggcagctgtggcttcatctaaaatcagaatctgccagagaagcagaggagaaagaaactcgattaaattcctttagcattctggttaatctagattttactaaaatgtatttcattta

SEQ ID NO: 90729 - DNA, 54 bp, Homo sapiens
  chr3:183648128-183648182
  hypo
ttgccctttgcacggcgtttttcccgcttggaacatgctcgcttctcactaccc

SEQ ID NO: 90730 - DNA, 79 bp, Homo sapiens
  chr3:183676026-183676105
  hypo
tattgcatgacgctgaggtctgggttactaatgatcctctcacccaggtactaagcatagtacccggcttttccctctt

SEQ ID NO: 90731 - DNA, 222 bp, Homo sapiens; identical to SEQ ID NO: 40083
  chr3:183684023-183684245
  hypo

SEQ ID NO: 90732 - DNA, 30 bp, Homo sapiens
  chr3:183688570-183688600
  hypo
tattgtatttgctcacgacctgtctgtgcc

SEQ ID NO: 90733 - DNA, 30 bp, Homo sapiens
  chr3:183696328-183696358
  hypo
cagagaaggtcaccacgctggcaatcacca

SEQ ID NO: 90734 - DNA, 34 bp, Homo sapiens; identical to SEQ ID NO: 40084
  chr3:183713864-183713898
  hypo

SEQ ID NO: 90735 - DNA, 17 bp, Homo sapiens
  chr3:183728806-183728823
  hypo
ggcgtgagccaccgtgc

SEQ ID NO: 90736 - DNA, 202 bp, Homo sapiens
  chr3:183771813-183772015
  hypo
tacaggcgtgagtcaccgcgcccggcacaccggcctcactttgtgactgaacaaatgctgtatgctcagtgatgtcacctcatgatcccgatgctagaaataacccacgagacaactgaggtcactaaatctgagaagagcaaaataaatgcatagcaccaaggtaagcacccagtcagatacctaccgtgtttctcatatc

SEQ ID NO: 90737 - DNA, 35 bp, Homo sapiens
  chr3:183801986-183802021
  hypo
gacaccctgctcttccgcctcgggaacacctagga

SEQ ID NO: 90738 - DNA, 21 bp, Homo sapiens
  chr3:183872331-183872352
  hypo
ttttttgggggggggcgaggg

SEQ ID NO: 90739 - DNA, 445 bp, Homo sapiens
  chr3:183948369-183948814
  hyper
ctgggtccgggcctgcgccaacggcccctgcctcagcgtgcgggcccggctcacctaccgcaacccgcagccgcagccggtggacggtgaggcccgggtggggcgcgggcgcggcggggggtgcgccgggcagggtccgacgccgcctcccgccgccctccccaggcgtgttcgtgtacccgctggccgaggccgaggtggtgtccggcttcgaggccgaggccgccggacggcgcgtctccttccagctgcagagccggcgccgctcgcaggccgcctgctgccgcgctctgggcccggggctggggaccccgacgccccgccgctgcgcgcagggtgagttccgcgcgcccgcacccgcgctcctgaaagccgggcgcagctcaggctcccgcatccgctcggcctccgcccgtcccccgccttcctccgggcactgccttgt

SEQ ID NO: 90740 - DNA, 26 bp, Homo sapiens
  chr3:183965599-183965625
  hypo
cttactgtccaggcccgagttagaaa

SEQ ID NO: 90741 - DNA, 26 bp, Homo sapiens
  chr3:183965925-183965951
  hypo
gccaccgcgcccggcagaaatgcatc

SEQ ID NO: 90742 - DNA, 105 bp, Homo sapiens
  chr3:183977991-183978096
  hyper
ctatccggtcatcctcgatcaccactgcgcagggagaaagcgcgtcagccgcgcggcctcggggggcggcggcgatgagaatgagccccgcgtcctagcttcccg

SEQ ID NO: 90743 - DNA, 567 bp, Homo sapiens
  chr3:183980079-183980646
  hyper
ctgtgccagtgtctccgtctcctgaatctgggtatttcagtctctcctaggaggggtctatagaaactgggccgacgcgcgcgcaccagggcagacacccccagccctagtccggtggctgtagccccccgcggctctggagtggtgcgctcgcagtgtaggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgccctcttctccccttgcctcccgcccccacaacccccgccctggctggccgtcacccgcggcgtcacctgcttgccagcgcgcaggagctctggcgcaatcactggccttggggaggagggggtgtctcacatgcggcgacagtgacggcagcgctgaaaacggtaatgatcaccctgtacgttcattccacactccaggcgaacgcgctttccttcctta

SEQ ID NO: 90744 - DNA, 209 bp, Homo sapiens
  chr3:183993757-183993966
  hyper
ccgggcggggctccgcgtggggcggtggactcgggcgggggggggggcggccgcggccgagcgggggtgctgcgcggcggccgtgatggctggtgacggcggggccgggcaggggaccggggccgcggcccgggagcgggccagctgccgggagccctgaatcaccgcctggcccgactccaccatgaacgtcgcgctgcaggagctgg

SEQ ID NO: 90745 - DNA, 16 bp, Homo sapiens
  chr3:184005808-184005824
  hypo
acaacgggagccaggc

SEQ ID NO: 90746 - DNA, 136 bp, Homo sapiens
  chr3:184015341-184015477
  hypo
ttttctcaccttacacgcacacacacacacacacagctgaagaagaaactctggggtttgcctaaaacagtcaagggctttgaagactgaaagactgagctttaaattttgattccgccgggcgcggtggctcacg

SEQ ID NO: 90747 - DNA, 16 bp, Homo sapiens
  chr3:184015597-184015613
  hypo
gcgtggtggcacaaaa

SEQ ID NO: 90748 - DNA, 144 bp, Homo sapiens
  chr3:184016089-184016233
  hypo
cagggctttattgatcgatgtcaactccacctggctccccaaagtatttaaaatggtagccacgggaatagcagagtactctctttcaactggggaggaatatcaaatgaggttaataggccgggcgcggtggttcacacctgt

SEQ ID NO: 90749 - DNA, 149 bp, Homo sapiens; identical to SEQ ID NO: 40088
  chr3:184018038-184018187
  hypo

SEQ ID NO: 90750 - DNA, 36 bp, Homo sapiens
  chr3:184031698-184031734
  hypo
attcgtattgtatcacgatttacttaggcaggacgg

SEQ ID NO: 90751 - DNA, 41 bp, Homo sapiens
  chr3:184057516-184057557
  hypo
ggattacaggcgtgagccactgcgcccggcctgagaagggg

SEQ ID NO: 90752 - DNA, 30 bp, Homo sapiens
  chr3:184059863-184059893
  hypo
ggtggtgaaggaccacgtgaccaagcctac

SEQ ID NO: 90753 - DNA, 23 bp, Homo sapiens
  chr3:184152655-184152678
  hypo
actgtgcccggccagaatgtcct

SEQ ID NO: 90754 - DNA, 35 bp, Homo sapiens
  chr3:184164708-184164743
  hypo
gacgaccttggttcacgacacgctcccttcgttgg

SEQ ID NO: 90755 - DNA, 130 bp, Homo sapiens
  chr3:184200600-184200730
  hypo
gcgcacacacacacacgcacgcacatacacacgcacacattaaaaaatagacagagagataaagtgagtgcctccgtgggtctccccgaggcatgaaggtgctggattgaatgtgcgtggagaatctcag

SEQ ID NO: 90756 - DNA, 30 bp, Homo sapiens; identical to SEQ ID NO: 40091
  chr3:184226786-184226816
  hypo

SEQ ID NO: 90757 - DNA, 86 bp, Homo sapiens
  chr3:184237219-184237305
  hypo
attgtatatcgaagccggtgagagaaggcaaaacaaagacataaaaaattatattatttaggccgggcacggtggctcacatctgt

SEQ ID NO: 90758 - DNA, 401 bp, Homo sapiens
  chr3:184243074-184243475
  hyper
ccccccacaaacgcacgtaaaacctctataaagggagaaccgccttgctgctgagggcgcggtgggacccgtcgcagggccagctgctccggcaggtgcccccaaagggtcccgcaggtgatcctcggggactgagcgcccatcgcccttcctacgcactcagatccgccgagcccagcgcccgccagagcccagagagtcctcggggtcagagtggtcacgtcaccgtcattcttttcctgcccgactagtcgctctgggctccccggggccgggggccgggggccgagccgccgccccgattccggcttcacccgcccgcagcgcgcggcgccccgcgctccattcgcgctacctggcggctggcaggctgccccaccccaccgcgggccacacacagc

SEQ ID NO: 90759 - DNA, 35 bp, Homo sapiens
  chr3:184279894-184279929
  hyper
ggatctcctgggacccgacgcgagcctgccccgga

SEQ ID NO: 90760 - DNA, 51 bp, Homo sapiens
  chr3:184280171-184280222
  hyper
caaggtgcctggggtcgcggggctgcgggctagcagcgtgggtccgacccg

SEQ ID NO: 90761 - DNA, 183 bp, Homo sapiens
  chr3:184301488-184301671
  hyper
cccacggagcccagccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgc

SEQ ID NO: 90762 - DNA, 53 bp, Homo sapiens
  chr3:184319790-184319843
  hyper
tacaggggcagcagccgcggctggcggcttcggggagccccggggctggggcc

SEQ ID NO: 90763 - DNA, 223 bp, Homo sapiens; identical to SEQ ID NO: 28615
  chr3:184319873-184320096
  hyper

SEQ ID NO: 90764 - DNA, 106 bp, Homo sapiens
  chr3:184321768-184321874
  hyper
taggtggcttggaaacgttcagtagtcggacctgggccacggagggcacagcggccactctttctgagaggcagaggtcggtgggctccaccctcccactccgagc

SEQ ID NO: 90765 - DNA, 122 bp, Homo sapiens
  chr3:184322209-184322331
  hyper
cgccccttgccaaggtcaatcaaaccctcccacgctccggaggcgcgcgctgcgtgctctaggcagcggggattggggccggaggggcgcgtcccggcggggccgggcgagggtgggtgggg

SEQ ID NO: 90766 - DNA, 150 bp, Homo sapiens
  chr3:184459092-184459242
  hypo
ttggtggaggaatcccggcaggccggcaagtcccaacaggccgatgttgggctgctgcaggcagacagtgagtcacctgggtccccgctgcttacaggacagagccagaataatgacaataataatagaggtccacggtgctgttattaa

SEQ ID NO: 90767 - DNA, 109 bp, Homo sapiens; identical to SEQ ID NO: 40092
  chr3:184785147-184785256
  hypo

SEQ ID NO: 90768 - DNA, 526 bp, Homo sapiens
  chr3:18485126-18485652
  hyper
gcacgtggcactccccggacctgccacctgcctgcttcgtccttctcgtcgtggtttcccaaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctc

SEQ ID NO: 90769 - DNA, 231 bp, Homo sapiens; identical to SEQ ID NO: 28092
  chr3:18486970-18487201
  hyper

SEQ ID NO: 90770 - DNA, 112 bp, Homo sapiens
  chr3:184870195-184870307
  hyper
cacgggatttcatctcgtcgtcaaggcagcgccaaccccagccgtccggcgcaaggaaagctccggcgggcccggagcccacggcggccccagcctccggcagagcagcccc

SEQ ID NO: 90771 - DNA, 776 bp, Homo sapiens
  chr3:184870608-184871384
  hyper
catttcctctccctccgcgcggagccgacaccgggagcccgggagaagcgacgtctgggtgggcaggaagccgagccggctgcggacgcgggagggcgcggcacgggccgggagtcacgccagcacgcggcggcggcgggagcgcggcggtcccaggctcgaggaggagccgccccgggcgctgcgaccgggtccgggctggcagcctccctccctccggcgcggcgcgcgccgcgccccacgcgcacacgcacgcgcacaggcgcgcgccggtcggccccgcgcgacgttcctcagcgagcccggccttctcacacacacgccgctggggagcttggccgtcggcgtccccgccggtcacagcgaggtcctcctcacatactcactccttcctcggagaaagaccccgacggagggccgtggtgaacacacactcctcggccgctttgtactcacatgcacgccagcctacatatgcacttccccccgagtgacactggccaccgagaactgacacacgcgtccacacgctccacggagggctgcgcacacctggcccacgcccacccgaacctcctagtggcccgggccgggtgcatcgcgtagcgaggatctcacacacacagcctgtccccacaggcgtctcacatctccctcgtacacacctccccgtgtctgggcatggagcccctgggaggcgcgcacacgctcgtgcacacgcgcgcactccccccacccagggcgggcctcctgccccagcgcggccacagggcgcg

SEQ ID NO: 90772 - DNA, 88 bp, Homo sapiens
  chr3:185001579-185001667
  hypo
agggaggagttggaccgttgtaaataaactgctgttgtagcactgactgttcttaatgctttcttttaagcaaagtaaacttactttc

SEQ ID NO: 90773 - DNA, 28 bp, Homo sapiens
  chr3:185001907-185001935
  hypo
gaaccactacgcgcggccactttccttt

SEQ ID NO: 90774 - DNA, 23 bp, Homo sapiens
  chr3:185270882-185270905
  hypo
aaaagaaaaacaggccggcacgg

SEQ ID NO: 90775 - DNA, 84 bp, Homo sapiens
  chr3:185271296-185271380
  hypo
taattccctttctggcgagagtgcttgcaacactaactcaggcttctagtggtctgatgagcttaaaaatcaattaataagccg

SEQ ID NO: 90776 - DNA, 80 bp, Homo sapiens
  chr3:185277764-185277844
  hypo
gcaagtggtgtccccgacatgatcgccttaaagttacgtgtgaaggaggagagctcatcaattttcggtgaatctccacc

SEQ ID NO: 90777 - DNA, 30 bp, Homo sapiens; identical to SEQ ID NO: 14609
  chr3:185278325-185278355
  hypo

SEQ ID NO: 90778 - DNA, 40 bp, Homo sapiens
  chr3:185302868-185302908
  hypo
ttttttgatggggtgcgtcagggtcccactctgtcaccct

SEQ ID NO: 90779 - DNA, 30 bp, Homo sapiens
  chr3:185303247-185303277
  hypo
gagacattagtgggccgcaggtttcatcct

SEQ ID NO: 90780 - DNA, 30 bp, Homo sapiens
  chr3:185362704-185362734
  hypo
agctcctctctacaccgtgagacctcccaa

SEQ ID NO: 90781 - DNA, 338 bp, Homo sapiens
  chr3:185362967-185363305
  hypo
gcttggctttgaacacgttcacctatgttagttcaactaaaagggatagcgtcgtgggagttcaggagagatccgagtggatggtgaagtggatggctgaagcctgcagaagccctggggggcgggaggcggggctcggtggttctggcaaacctggctgaccttccccgcccctcctcggcccctggggttctcagggcctcggcagagtccctggccgcctccgcagacttctcattcctcagatggtctttggtttgctcccgatctggctggctgcgtttggtctcattctgtcaggtgttggaagggctacattcatccgttgttttgctggt

SEQ ID NO: 90782 - DNA, 34 bp, Homo sapiens
  chr3:185363531-185363565
  hypo
tcatctacccacccccgcacgttactccaggccc

SEQ ID NO: 90783 - DNA, 136 bp, Homo sapiens; identical to SEQ ID NO: 40098
  chr3:185385541-185385677
  hypo

SEQ ID NO: 90784 - DNA, 37 bp, Homo sapiens
  chr3:185446057-185446094
  hypo
gctcccttcatcaggcgctctccgctcctccagccca

SEQ ID NO: 90785 - DNA, 30 bp, Homo sapiens
  chr3:185457365-185457395
  hypo
acactgatgctgtcccgtgatgaggacaga

SEQ ID NO: 90786 - DNA, 17 bp, Homo sapiens
  chr3:185504539-185504556
  hypo
tacgtggaaacctacat

SEQ ID NO: 90787 - DNA, 127 bp, Homo sapiens
  chr3:185543557-185543684
  hyper
cgttcccgggccgtgcgctcgctctgagacccgctccccgccacgctctctgaggtgaccgagcggcgcgtgtggtcgaaggatcgcgcgcgggagtcgggacgcctaggaccggggttggccgggc

SEQ ID NO: 90788 - DNA, 172 bp, Homo sapiens
  chr3:185543923-185544095
  hyper
aggggccagggactgcggcgaggccggagcgctggggtcagcggccgggggacggatggtcgccgcccggctgcgcggccggttcagctccaaagccagggtggtgggaggcgagggtggctggaagcggaggagcgcaggctgtgtaggagttccccgagcactgggaagg

SEQ ID NO: 90789 - DNA, 29 bp, Homo sapiens
  chr3:185547274-185547303
  hypo
tcctgctgtgtagccgggttcctaacagg

SEQ ID NO: 90790 - DNA, 35 bp, Homo sapiens
  chr3:185551925-185551960
  hypo
atcccaggctgggtgcggtggctcacgcctgtaat

SEQ ID NO: 90791 - DNA, 30 bp, Homo sapiens
  chr3:185552326-185552356
  hypo
tgatgttgattactacgggctatttatttg

SEQ ID NO: 90792 - DNA, 30 bp, Homo sapiens
  chr3:185598167-185598197
  hypo
ggtgagaagagaaaacggcctcaggcagaa

SEQ ID NO: 90793 - DNA, 81 bp, Homo sapiens
  chr3:185643324-185643405
  hypo
ctgtaagacctgctacgtgatcgtctatgggagcgggagcgagaccgtgaccgggtataatgccttcgggagcttcttctg

SEQ ID NO: 90794 - DNA, 91 bp, Homo sapiens; identical to SEQ ID NO: 40102
  chr3:185667518-185667609
  hypo

SEQ ID NO: 90795 - DNA, 30 bp, Homo sapiens
  chr3:186019122-186019152
  hypo
aaactttccatgtgacgggtgcggtggctc

SEQ ID NO: 90796 - DNA, 619 bp, Homo sapiens
  chr3:186078712-186079331
  hyper
tatgctaatgaagtccgaggaggcagcggcgcagcgcgggagagcgcgcccacgggttcacagcgctcccgggcaccactgcggcgcagccacagatcgcttcgcgctgcagcagacgctcccgccgcggggggcgactgggggaggggtctcgaccgccaccctgagttccgcagctcatccctcccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctcctttattctctgaggtgtccgtgttcgcttcagcttccctttaagtcgccctgcgcaggggctttgtggagtgcccccaaagtcctagaaccccgcgggacggtcggaggctttggcggccagacattagg

SEQ ID NO: 90797 - DNA, 150 bp, Homo sapiens
  chr3:186079621-186079771
  hyper
agccccttccctggccgcgggaccggctcccgctttgccctcctttaccaagttgctgcaccgggtgctccctgagccggggaccccctccgccgcgccggccgccgtcttacctcaccaggcaacacttggttgcgcggtggcccgggg

SEQ ID NO: 90798 - DNA, 427 bp, Homo sapiens; identical to SEQ ID NO: 28624
  chr3:186079818-186080245
  hyper

SEQ ID NO: 90799 - DNA, 49 bp, Homo sapiens; identical to SEQ ID NO: 7169
  chr3:186080246-186080295
  hyper

SEQ ID NO: 90800 - DNA, 22 bp, Homo sapiens
  chr3:186329022-186329044
  hypo
ttcttttttttgagtcggagtc

SEQ ID NO: 90801 - DNA, 136 bp, Homo sapiens
  chr3:186495172-186495308
  hypo
aatgactaatacacacggcatacaatttactaaccaatcttcttttgacagccattgaagtcgtttatagttttattattttaatagttttttttcctattaaaataatgaagggccgggtgcggtggctcagcct

SEQ ID NO: 90802 - DNA, 78 bp, Homo sapiens; identical to SEQ ID NO: 40105
  chr3:186527185-186527263
  hypo

SEQ ID NO: 90803 - DNA, 41 bp, Homo sapiens
  chr3:186648285-186648326
  hyper
gactcgcttccttcccgcccctccgccgcgctcttcttcct

SEQ ID NO: 90804 - DNA, 30 bp, Homo sapiens
  chr3:186649839-186649869
  hyper
gaatggaggcgccgccgccccagtgtgtgc

SEQ ID NO: 90805 - DNA, 664 bp, Homo sapiens; identical to SEQ ID NO: 28626
  chr3:186857050-186857714
  hyper

SEQ ID NO: 90806 - DNA, 3 bp, Homo sapiens
  chr3:187086277-187086280
  hyper
caa

SEQ ID NO: 90807 - DNA, 38 bp, Homo sapiens
  chr3:187238765-187238803
  hypo
atgattggtgggggccgggcgcggtggctcatgcctgt

SEQ ID NO: 90808 - DNA, 35 bp, Homo sapiens
  chr3:187253705-187253740
  hypo
caagttctggctgggcgcggtggctcacgcctgta

SEQ ID NO: 90809 - DNA, 35 bp, Homo sapiens
  chr3:18735758-18735793
  hypo
gaccggagctgttcctattccgccattttggctcc

SEQ ID NO: 90810 - DNA, 130 bp, Homo sapiens; identical to SEQ ID NO: 341
  chr3:187387791-187387921
  hyper

SEQ ID NO: 90811 - DNA, 233 bp, Homo sapiens
  chr3:187388006-187388239
  hyper
cgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctctcaaccgtctccctctgttttaaactctctctctgacgtcaggctaggagg

SEQ ID NO: 90812 - DNA, 178 bp, Homo sapiens
  chr3:187416640-187416818
  hypo
ctggactcgtccagccgcgccgtgccgcactcatagcacagctgcttgaagacgcgcatgcgcaccgagcccgcccgctgggcgcggtccaggaacatgtggaagaggatgaccacatgggcagactgccaggtgtgccagcaccaggagcagtggaacctgccgggaggagaaggag

SEQ ID NO: 90813 - DNA, 1324 bp, Homo sapiens
  chr3:187455342-187456666
  hyper
agcctaggcagacttcgctaccccaccccgaccactccgtacctgtcttccagggactgcccgcccctgggcgatccacctcgaagccccccgcaaggcgcgacggaggctttgtggtatgaccgtggcggcccttaatttagttacattcaaataaaacttttggtgcacctcggtagctaacattgtgtgtatgcctttttttttttttttttttttttcctgttacgccgtcaatgcagcaggcaatgaggggaatgacacagccctctcattcccggaacgtagtcaatctcggctctgcggatttcacagaacacactttgcctattgccggctccaacaagaagtaactttccaggaagctgccggccccggcagccgccaggatcgctgcctgcgctgcgctggccgccggggattcacccagggaggcggggccgctggggaaggctcgcggggaatacagcacactttcccctaaatccctcgtccgcgccgagtgcagggctctcagagttcacctagtcccacctctcacccacaacagtttataaatggggaaggtcagacaagttagtagcagagctgggtctagaacccaggagttcgaatacaatccgaggctcatatcgagactttaagttgtccgattccgaagtttatttgcttttttccctctttttgccttccattctccctcacccccgttcttttaggggaatgtttgagcgagacttcaaggtcaaaagatggagtccctaggggctgagggtctccatcataggcgccccaggcaaggttggagaaaaactaaacagaaagccccttccgcctacgttggcaagaacgggaacccagctccacttggtttccgcccaaagtctttagaacaggagctgccaagccgtaaggatttccgaatccgatttccccgaaaccgtagagacacagcttggactcggcaaaggccggggccccgacccctgcgcgcgcactggcactctccaaagttgcctcgccttcctgtggccctcccgggaattataacccccgggtgccatgtcctaattggtctcggtagcaggctccggggtgcgctttcgggggctaggggacagcgaaagactcagccacaaaggccgcagtctggtcctaaaactagccagtggcgtcacactgcgccgctcatcccttctgcggcaagcggaagggtcagagtcggtctgcaaagaacgagcctttggcctcaaaatcctacattgaggctttctcaccccttcgcccggtgggataaaggtgaaagagacggttgggatttaat

SEQ ID NO: 90814 - DNA, 542 bp, Homo sapiens; identical to SEQ ID NO: 28630
  chr3:187457112-187457654
  hyper

SEQ ID NO: 90815 - DNA, 190 bp, Homo sapiens; identical to SEQ ID NO: 40107
  chr3:187870406-187870596
  hypo

SEQ ID NO: 90816 - DNA, 36 bp, Homo sapiens
  chr3:188096606-188096642
  hypo
tagactggaggtgttcctattcggccatcttggctc

SEQ ID NO: 90817 - DNA, 31 bp, Homo sapiens
  chr3:189114996-189115027
  hypo
aattattccaggaggcggggcgcggtggctc

SEQ ID NO: 90818 - DNA, 17 bp, Homo sapiens
  chr3:189838424-189838441
  hyper
ccggcgtgggctgtccg

SEQ ID NO: 90819 - DNA, 377 bp, Homo sapiens
  chr3:189838501-189838878
  hyper
cccagatgcgctcccgcatcctccgcctcagagaggcgcgggacggttacgctcgagagggcttcggggcacctcgcgtccgggtcccctctcccaccttccctcggggaagcgcgccgactccgccgcgatctggccgctccgcgagccccaggtgaccgccggcgctccgcgtactgagaggcggaggccgtgcctggccagccgctcttaaagggacgcccacagctcacacgctcctcctgctgcctgagactccgagagccgctctcccaggctccccgctgcagcggcggggctgccaggggcggcacactccagcgccagccagagagctagcgccgcttgaggccggccggggacgaggcgctttacac

SEQ ID NO: 90820 - DNA, 99 bp, Homo sapiens
  chr3:190039853-190039952
  hyper
cgtacatggcctgggcggtcacgatgttgtcgccggcataggagtaaatcctccactggggcagggcagtgctgacgatggcgccgatccatcccagga

SEQ ID NO: 90821 - DNA, 195 bp, Homo sapiens
  chr3:190040207-190040402
  hyper
ggttgctcccaggctcgggaactgagacgcagaaccgctgggcgccgcgatttaaagcagctccgcccgcctcagccccggcagccggggagcgccccctggcggtttcagggcggctcaccgagagggcgccgggagcgcccggttggggaacgcgcggctggcggcgtggggaccacccggcaggaccaggca

SEQ ID NO: 90822 - DNA, 29 bp, Homo sapiens
  chr3:190065742-190065771
  hypo
agaccatgggctgggcgcggtggctcaca

SEQ ID NO: 90823 - DNA, 159 bp, Homo sapiens
  chr3:190529604-190529763
  hyper
tgcatctctaataaacgggatggtttcttgcggcggcttttgctagagttgcctaataccacccagtcagggaaaaggtacactgggcaaggagggctaaccctgtgcttccactggaaacaagcctaaatctttgtacacgtccgctattgattccta

SEQ ID NO: 90824 - DNA, 554 bp, Homo sapiens
  chr3:190580406-190580960
  hyper
tgcagtggaagaaagcgctgcagaaactgagcccactcaatttttcagtaaaaccagtgggagctttaaatgagactgaggggaggagctaggagaggcgagttctaatctgcgggagctcccggtgacgcccagagctcccggcgagcgccgctctgtgatttggtgagaggctgtcaaaccggtgacgtgagccaggagtcacccagcagaagacaaagtcactcgcgctctgggcggccaccgcgccgggaccagggacctgccgatctggccaccggccgtggggcagaggcaggacctccggccctctcgctccgggtgcgcggcgctgcttcacacccggccccagtgtggactcgccgcgggcggggagacgggcggggagacgggcggggagacgggcggcgaccccgcagccgggaccgaggcgagggccgggctccctcccgctccacgcgcagcgcggggcagggccgagccgggccgggcgagaagatggtccaggtgcctggacgtggggtaagaaaagcccaaaccggcatcacaggggt

SEQ ID NO: 90825 - DNA, 82 bp, Homo sapiens
  chr3:190595746-190595828
  hypo
accaggtgttggcctcgaactcgcactctcgaaccctcgcctccctgaaggcccgagggcaggcgcaaccggccggagccac

SEQ ID NO: 90826 - DNA, 74 bp, Homo sapiens
  chr3:191670699-191670773
  hypo
tccaccttagcatcacgaacagtgggaaaactggaagtcatgtgccttctaacataatgcggtaggaagcaccc

SEQ ID NO: 90827 - DNA, 148 bp, Homo sapiens
  chr3:19188145-19188293
  hyper
gaattttctgggacacgatgcgccacccaaacaacagggactccctcatctttttctccccagctccgcccaagactgagccacatagccacctgcagttgcgatcggctcgccgcgtgggggactccacccgcgtgagctcggtttc

SEQ ID NO: 90828 - DNA, 799 bp, Homo sapiens
  chr3:19189373-19190172
  hyper
tcggggccagtttcccggactaaaagaccctggtgactggggatgggcctcacaactaactcgggctgccctgcccctgtcgcgtgggctcgcaatggcaagtgctccggaagggggccgcctccccgtggggctcctggctgcctctgctcccttggacaccactggggggcctccccctcctaagttctaggttgaggccggatacctgccccgacctgtctcctccctttctccaataccacacccacgggactccagtctccccgggagtgggacggagagggaacaaaggggtctttgttcactggctcccggggcgtgggagttgcgctcgctctcctttcccggcgtcccgtggagaccgggaggctcagcgcctctcccagctctcagcgccgccctcccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctg

SEQ ID NO: 90829 - DNA, 17 bp, Homo sapiens
  chr3:191929220-191929237
  hypo
tttatttttttgagacg

SEQ ID NO: 90830 - DNA, 15 bp, Homo sapiens
  chr3:192125814-192125829
  hyper
tggtctccgcctcac

SEQ ID NO: 90831 - DNA, 596 bp, Homo sapiens
  chr3:192126115-192126711
  hyper
cggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggc

SEQ ID NO: 90832 - DNA, 63 bp, Homo sapiens; identical to SEQ ID NO: 344
  chr3:192126786-192126849
  hyper

SEQ ID NO: 90833 - DNA, 110 bp, Homo sapiens; identical to SEQ ID NO: 345
  chr3:192126850-192126960
  hyper

SEQ ID NO: 90834 - DNA, 412 bp, Homo sapiens; identical to SEQ ID NO: 28639
  chr3:192126961-192127373
  hyper

SEQ ID NO: 90835 - DNA, 175 bp, Homo sapiens; identical to SEQ ID NO: 348
  chr3:192127556-192127731
  hyper

SEQ ID NO: 90836 - DNA, 204 bp, Homo sapiens; identical to SEQ ID NO: 28641
  chr3:192127936-192128140
  hyper

SEQ ID NO: 90837 - DNA, 224 bp, Homo sapiens
  chr3:192231853-192232077
  hyper
ttctttcttttcctccgtgtagtctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcac

SEQ ID NO: 90838 - DNA, 282 bp, Homo sapiens
  chr3:192232078-192232360
  hyper
agcaacttttcggagacactgaacaactccaagtcgcgcgccgccctcgcaaatcgcagagagggccgcgagaaggtgcgaacgcaggtcacggccagcgccgcttggagagagacccgcaggtttcagcccaggcgcgcccggcgaaagccaacgcgctctccctacaaagcgtcgatgacttcagggatttaaaagaaaaaatacccacagacagaaccagcggaggggccctgacctcgccccagtcgggaaacgccttccctccgccacaggcagcgc

SEQ ID NO: 90839 - DNA, 255 bp, Homo sapiens
  chr3:192232564-192232819
  hyper
ggttggtcaactccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggagg

SEQ ID NO: 90840 - DNA, 103 bp, Homo sapiens; identical to SEQ ID NO: 7188
  chr3:192232849-192232952
  hyper

SEQ ID NO: 90841 - DNA, 435 bp, Homo sapiens; identical to SEQ ID NO: 28646
  chr3:192233094-192233529
  hyper

SEQ ID NO: 90842 - DNA, 159 bp, Homo sapiens
  chr3:192445228-192445387
  hyper
tgcatgcacagtgcccgctcagatttttttttttttttttttacctgggtctggaagctgcaggcaggagctgtcctccgagcgtggtgctgcaggtgtagtgacagatcatcccactttgctctctggatgcacagcagatttgcatgggcgctggca

SEQ ID NO: 90843 - DNA, 56 bp, Homo sapiens
  chr3:192445421-192445477
  hyper
cgcctcccgctcccccgcccccttcgcctccctccccaatacggtcctcagttatc

SEQ ID NO: 90844 - DNA, 802 bp, Homo sapiens
  chr3:192634345-192635147
  hyper
cttcggaatgttgaccgccggccacgcaccgcttgacagccacggatccgctggcggagccgcaagttacaacccaggcgcctggcaaactcacactacacctcagtagcaataatcccaacggcaggacacctggggagggtgggctcggtctcccgggcctggctcaattatgttcctttacacagcattcaatcatgtttcaggagccgtaggtgaggggctggaggtgggagtgggggacacattttctagcccccgacgtctccgcggttggaaactctgggcacctctttcggccagcgctaagacaatacacaaagagcagggaaccggcgctcctctgcggccagagctccgcgcctagtcacggaagagctgggaattaagaattccgagctcagcgagagccctgaagaagcaccggaaatgcttccgatcgcttcataagagaagtcaatttgcaaatcaaagttgcaggaactccggacgcctagactacttcagcgggttactcgggaacacccaacaagtttggccaccgggggctcggcatgacagcgccgcgccgcgagacgacagaagcaacttgtcgctcgggcgccaagccagagccctgagccgtctccgctcccaagctcgggagagcacccaagagccggcgtcgggaaagcggaggtccctgcctccggcagccaaatccctcaactgaaggcacctcaggggctcacctggactgcactcgcttccaggggcttcccccaacagtgcaacgcttcaccgcgaacgcctcacctgcctg

SEQ ID NO: 90845 - DNA, 30 bp, Homo sapiens
  chr3:192754793-192754823
  hypo
ctctctccagcaaatcgcatgttgcagtaa

SEQ ID NO: 90846 - DNA, 198 bp, Homo sapiens
  chr3:192958910-192959108
  hyper
gggcgggcgggcgggcgggcgaagctgggctcggggccaagcgaggtctagccggagcgactgtgccccgcctcctgggcggagcgggcggctccccatggtcagagcctcgtgccggctcggcagcgcccggacgccgagcccagcgcgtcggccccccggcgtgcgggcgtctcagagccgcggaggggccgccgg

SEQ ID NO: 90847 - DNA, 53 bp, Homo sapiens
  chr3:193093790-193093843
  hypo
gccacagggaatcttcggggaaggaagagcaagtggggcgaggctgtcaacat

SEQ ID NO: 90848 - DNA, 36 bp, Homo sapiens
  chr3:193103643-193103679
  hypo
atcaggctggtcttgaactcccgacctcaggtgatc

SEQ ID NO: 90849 - DNA, 37 bp, Homo sapiens
  chr3:193312128-193312165
  hypo
gtatagataatttatcgtgtttataaggaatggaatg

SEQ ID NO: 90850 - DNA, 32 bp, Homo sapiens
  chr3:193419609-193419641
  hypo
gagtgtaattttgttcgcgtcaaaagcattgt

SEQ ID NO: 90851 - DNA, 174 bp, Homo sapiens; identical to SEQ ID NO: 5009
  chr3:193548530-193548704
  hypo

SEQ ID NO: 90852 - DNA, 30 bp, Homo sapiens
  chr3:193548916-193548946
  hypo
ttgagaaaccttgaacgatgtaagctgaga

SEQ ID NO: 90853 - DNA, 252 bp, Homo sapiens
  chr3:193588098-193588350
  hypo
gctgaccagtgctctcgtttcacagatggggaaatggaggccgagacgtgggaatgctttatgccaggtcccgcatgaacagtggtagatctagaactcaggtgctacgctgtcggcctgctgttggtctgcggagctactatatagctgttgcgtgactcagggaacacctggggcgtgactgacaggtggagaagggtcaaggtggttggagcccaagcgtggataagacagccccggagggagaggcca

SEQ ID NO: 90854 - DNA, 114 bp, Homo sapiens
  chr3:193656666-193656780
  hypo
acacagctgcacactcggtaaatagactcagatgttgagcttttgtttgaaggatcttttcagattaatgcagagagaattagtttttaaaacttaagccggagccaggatgag

SEQ ID NO: 90855 - DNA, 30 bp, Homo sapiens; identical to SEQ ID NO: 40114
  chr3:193774655-193774685
  hypo

SEQ ID NO: 90856 - DNA, 164 bp, Homo sapiens
  chr3:193776076-193776240
  hyper
cggttcctctgcagacgttcagccccttcggaaatgtaaaacccgggaagcgaaagctgcggcgacctcccagagcctctcaggcacgcggcatctctccccaccggcagcgccttgaaataccaaaggcctagccaaagatggaaccgttttgttgggagctc

SEQ ID NO: 90857 - DNA, 220 bp, Homo sapiens
  chr3:193776241-193776461
  hyper
ggtttcccccgccgcgaggctgagccggtggcgcagctgctcaaaggtcacgcccgagacacgtccgcacaagcccgggtggcggggcgggcagcggggagagaagaggggagtggggagggggacgggggcaggggggaggggcgccaccttctccagggccctgcggggtgggctcccatcttcatctcgcaagcatccaacccggggaggtggcttt

SEQ ID NO: 90858 - DNA, 33 bp, Homo sapiens
  chr3:193858603-193858636
  hyper
accagcagcccctctcgccggcccccagcagtg

SEQ ID NO: 90859 - DNA, 36 bp, Homo sapiens; identical to SEQ ID NO: 14616
  chr3:193922775-193922811
  hypo

SEQ ID NO: 90860 - DNA, 30 bp, Homo sapiens
  chr3:193943217-193943247
  hypo
tttaacccacatcaccggacaacaaggagt

SEQ ID NO: 90861 - DNA, 30 bp, Homo sapiens
  chr3:193969848-193969878
  hypo
agagggcacaagcaccgggtagactttggg

SEQ ID NO: 90862 - DNA, 18 bp, Homo sapiens
  chr3:194041075-194041093
  hypo
agcactttgggaggccga

SEQ ID NO: 90863 - DNA, 197 bp, Homo sapiens; identical to SEQ ID NO: 40117
  chr3:194048751-194048948
  hypo

SEQ ID NO: 90864 - DNA, 30 bp, Homo sapiens; identical to SEQ ID NO: 40118
  chr3:194128418-194128448
  hypo

SEQ ID NO: 90865 - DNA, 187 bp, Homo sapiens
  chr3:194208071-194208258
  hyper
cagtgactagacagacgttgcccagagtcatggtcatggaggaagcttgtgctagaatggtggagaggaaaccagagcccagctcctaatgcaaggctctttcattcctttagccaccctcgcccccgccaaaacaaacagacaaaaaactgtcattctcatatgaccacggactctgcgccccggc

SEQ ID NO: 90866 - DNA, 118 bp, Homo sapiens; identical to SEQ ID NO: 28653
  chr3:194208467-194208585
  hyper

SEQ ID NO: 90867 - DNA, 30 bp, Homo sapiens
  chr3:194319447-194319477
  hypo
ctccacttcccctagcgtaccgcaagaagt

SEQ ID NO: 90868 - DNA, 52 bp, Homo sapiens
  chr3:194374304-194374356
  hypo
acagggaggagacaacgaaagcctttcagttcagtgccgtgacagacaacca

SEQ ID NO: 90869 - DNA, 401 bp, Homo sapiens
  chr3:194407435-194407836
  hyper
agtagttttattcttcgatcttgcccgggccgagcctggcaggggccggtggctcagcgggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtggg

SEQ ID NO: 90870 - DNA, 640 bp, Homo sapiens
  chr3:194408129-194408769
  hyper
cggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgc

SEQ ID NO: 90871 - DNA, 281 bp, Homo sapiens; identical to SEQ ID NO: 28656
  chr3:194408838-194409119
  hyper

SEQ ID NO: 90872 - DNA, 36 bp, Homo sapiens
  chr3:194827205-194827241
  hyper
cggcggtgtctacgccgggctcgctggaaccttcca

SEQ ID NO: 90873 - DNA, 40 bp, Homo sapiens
  chr3:194834954-194834994
  hypo
gggtggcccccttctcgctcctccacgtgaagccctgaac

SEQ ID NO: 90874 - DNA, 43 bp, Homo sapiens
  chr3:195183871-195183914
  hypo
gaagtttaaaaagcacggtacagggctgggcacaatgactcat

SEQ ID NO: 90875 - DNA, 37 bp, Homo sapiens
  chr3:195274920-195274957
  hypo
ccttctccgactccacgcaggccgagttagtgttcac

SEQ ID NO: 90876 - DNA, 172 bp, Homo sapiens
  chr3:195474886-195475058
  hyper
gccccacccgcgctccgcccgccccctccttcggcgggatctggaactgcagctggcggagggcccggagcccaggtctgcgtggggccgcggcttcctgcgctgttaaccagcggagccccggggactgctgatgagggcaggggcaaaggcgcctcgcttgactgagggg

SEQ ID NO: 90877 - DNA, 30 bp, Homo sapiens
  chr3:195495704-195495734
  hypo
aatgggtgatcttgtcgtgggaagcagcca

SEQ ID NO: 90878 - DNA, 75 bp, Homo sapiens
  chr3:195536670-195536745
  hypo
actcaagaacttgggcgtcaggaggtccaaccgttcaccactgctttttacacaggggaccggggccctggggag

SEQ ID NO: 90879 - DNA, 24 bp, Homo sapiens
  chr3:195538329-195538353
  hypo
caccgcgcacggcctccactcttc

SEQ ID NO: 90880 - DNA, 293 bp, Homo sapiens
  chr3:195586977-195587270
  hypo
tccaggcctgcctcacgcgccaggatcacgagagccgcctctaacccacccccaaaacaacaaaaggatgcgctctggccttgccaacttcagtgcctgggacaagccggctcgtgcccgccgcctcggctgcagggccctccacctgcagcgctttcgtccctacctggcgttcaccgttctcacccatcacatcagcacaacgtgaccttgtggggagccacctcctctgctcccaagacacctggtgcgtaacgattacagagcacccgtcctgccgtgatgctgtcaca

SEQ ID NO: 90881 - DNA, 72 bp, Homo sapiens; identical to SEQ ID NO: 40123
  chr3:195597490-195597562
  hypo

SEQ ID NO: 90882 - DNA, 154 bp, Homo sapiens
  chr3:195599686-195599840
  hypo
ggtctgtggggccagcgccccgcccacacctcctcctcacccctcagttccctggcaaggccggggccccagtcctcttctggccacttgatttcactcctcggctgggttccaggagttctgagaggtgcgggggtgccgggggacacctagg

SEQ ID NO: 90883 - DNA, 1277 bp, Homo sapiens
  chr3:195600086-195601363
  hypo
ctctgacctcagacacgaaacctctgctgatgtggcctaagccggggcctgggcaggggcaggggcaggggcaggggcaggcaggccaggaagcacagggctcccgcaagacactcctgactcccgaaggctctcacaggttgtgaggctcccgcgtctgctgctggacttgtcatacgtgatgccgtgagcagagtctgggcaggcgggggcggtgagagccccgtgggcagtgtctgggcaggcgggggcggtgagagccccgtgggcagtgtctgggcaggcgggggcggtgacagccccgtgggcagagtctgggcacgcgggggcggtgacagcccagagctgctagggtggacacgtgtggcaccacactgcacgccctccccaccaacccccacttctcctgtcccagggccaaagcgtgaagaagggctcctctgaaacccagccaggccggggagagaggacggaggaggtggcgacgcctgggcacccagacccacagccttgtaaggtgacgaggcctggctggagcggggtgactccggaacagcccatcccagagaccaaagtcaaacccgagagcaccacggtcggcggggaggcggggggcgcggggcgcggggagacggggctgtgctccccctgcccagcctcctcatacacagggccactggcctggccccaccacacacagccaccctgtgattcccaccctgcctgcagggagggaaggaaggagagaggacagtaccccgagacgagacgagtcccatctgaaaaatagcagggccactcgaaggagcagagccccggctccccagcacgcacacagcctcccacggcggcccgtagaggaggaaccccggcaccggctgggctgcggctctcccgctacacccacgggctccccggtggctgccgcgggccagacgccggactctgctctccacacctcttcagaggcgctcagtaactgggtgagaatgccgctgaggccgagaccttgctcagagcagcgtgactcgtgcccaaggcaggtcactccgtctggcctctcccttccgccaacactgcccagctccaggcacagaagcctcctttgggacccacttctgagagggaaaggagacatcaagcccacctcccttagtgcaggtatggccgaggcaagagcccccatggctgctgggagtcctgacaccactcgagaaaacatgcttgctcctgggggaaggagagtaagagtgcggaggacgtgtgcaagaagctcc

SEQ ID NO: 90884 - DNA, 22 bp, Homo sapiens
  chr3:195602315-195602337
  hypo
gcacgctcggaggcacaggaag

SEQ ID NO: 90885 - DNA, 76 bp, Homo sapiens
  chr3:195603847-195603923
  hypo
gaggggccaggcccacggctttccagctcgtggaggtggacacggtcatgaggctggacttcgggctggaggccct

SEQ ID NO: 90886 - DNA, 126 bp, Homo sapiens
  chr3:195604262-195604388
  hypo
ggcacaggattgcaccgaaggccgcagactccaaaagctgcagtgcaggtggaagaggctccctgggaagcagccctagccccatccttgcctggcctgagtcaggagctgcgagcacaggggatt

SEQ ID NO: 90887 - DNA, 30 bp, Homo sapiens; identical to SEQ ID NO: 40130
  chr3:195604945-195604975
  hypo

SEQ ID NO: 90888 - DNA, 194 bp, Homo sapiens
  chr3:195637231-195637425
  hypo
cgctcggattcccagcggcggggcagcctgcaggccctgttcccagcccacagacccatgtcccagcccaaacggaggcagccctgggcagcgggcgcgtggagcccaagggctcagggccactcagcccttgttactgtccctcatctagaaaatggatgtaataacaaaacagttcacggtaggtggcaaga

SEQ ID NO: 90889 - DNA, 30 bp, Homo sapiens
  chr3:195644193-195644223
  hypo
cacaaaaagccacagcgaagataggtctgt

SEQ ID NO: 90890 - DNA, 219 bp, Homo sapiens; identical to SEQ ID NO: 40132
  chr3:195648722-195648941
  hypo

SEQ ID NO: 90891 - DNA, 30 bp, Homo sapiens
  chr3:195730384-195730414
  hypo
acatcagctcctctccgtgtctgcagctag

SEQ ID NO: 90892 - DNA, 136 bp, Homo sapiens
  chr3:195834926-195835062
  hypo
taacattttttaaggaattcttatttgccatgagccaaggaatgcacagagactagattcccatggacagctcactcctaccgaacacatacaatgggacacacctgtgctgggtgaaaggcgcagcctagagggc

SEQ ID NO: 90893 - DNA, 76 bp, Homo sapiens
  chr3:195837125-195837201
  hypo
tgagccaccgcacctgccacgtagagcctattttcttatccataaaacaatacctacttcacggggttgttctgag

SEQ ID NO: 90894 - DNA, 82 bp, Homo sapiens
  chr3:195874745-195874827
  hypo
tctaccacaatgtctacatatggaaggtgctccaaaagcgtgaaccattagaattcctatggaatgacgttttcatcaaaca

SEQ ID NO: 90895 - DNA, 167 bp, Homo sapiens
  chr3:195924532-195924699
  hypo
aggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccaca

SEQ ID NO: 90896 - DNA, 21 bp, Homo sapiens
  chr3:195926795-195926816
  hypo
acagagcgacactctggctca

SEQ ID NO: 90897 - DNA, 41 bp, Homo sapiens
  chr3:195928204-195928245
  hypo
gggattacagccgtgagccaccgcaccgggccaaaactgac

SEQ ID NO: 90898 - DNA, 30 bp, Homo sapiens
  chr3:195945299-195945329
  hypo
ggagcattctgttgtcgggtttttgtgtgt

SEQ ID NO: 90899 - DNA, 36 bp, Homo sapiens; identical to SEQ ID NO: 40136
  chr3:195993024-195993060
  hypo

SEQ ID NO: 90900 - DNA, 81 bp, Homo sapiens
  chr3:196056108-196056189
  hypo
ggccaataaatgattttttaagaagatgacaattcagcgggaaaaagtctcttccacaaatggtgccggaacaatgcacat

SEQ ID NO: 90901 - DNA, 36 bp, Homo sapiens
  chr3:196063642-196063678
  hypo
ctagctaggtgagcacgtcatcggctagatgtccag

SEQ ID NO: 90902 - DNA, 360 bp, Homo sapiens
  chr3:196069875-196070235
  hypo
acacttctttaagaaatcatgtacttgagataaacgggtctcgtaaggctagcgttgggactatctcttcatttccatgtggcgagcctcctagggcaacagaggcacggtcgctgccatgaaagcactgaagcttcacctctttgagacgtgttaataaccgcggagtgtggctctactggagatggagctacttgctgttactttgtcggtgatgctcctagggaggagcaaatgggagtctgaggacataaatgacgaacagggcctgggctgagaaaaccagtcatgccacaaaaggcttcctgaggctgaaagatttgggagacggccaggtgccagtgacccacacctgtaatc

SEQ ID NO: 90903 - DNA, 30 bp, Homo sapiens
  chr3:196099492-196099522
  hypo
gtgactcatcatgaccggtaatggctgaat

SEQ ID NO: 90904 - DNA, 140 bp, Homo sapiens
  chr3:196226294-196226434
  hypo
aatttctgctaagttcgtggtactttgttacagtagccctaggaaataaaaagaattccatttatatgaagttccagaacagaaaaaactcatctatggtggataaaaactaaaacagcccggacgcggtggctcacgct

SEQ ID NO: 90905 - DNA, 30 bp, Homo sapiens
  chr3:196251394-196251424
  hypo
ccctgggagttttaacgtaagcttgacgag

SEQ ID NO: 90906 - DNA, 10 bp, Homo sapiens
  chr3:196255622-196255632
  hyper
gcggtgtcgc

SEQ ID NO: 90907 - DNA, 91 bp, Homo sapiens
  chr3:196256207-196256298
  hypo
ttttattattattgccgttatcattggtttaggaacggacaggtggcagaattctggcccatgaaatataagaagaggcccactgtggagc

SEQ ID NO: 90908 - DNA, 30 bp, Homo sapiens; identical to SEQ ID NO: 14628
  chr3:196294577-196294607
  hypo

SEQ ID NO: 90909 - DNA, 39 bp, Homo sapiens
  chr3:196318724-196318763
  hypo
ggctccacagcccagcgggtagagcgagggaggcgggcc

SEQ ID NO: 90910 - DNA, 482 bp, Homo sapiens
  chr3:196366435-196366917
  hyper
tcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctggg

SEQ ID NO: 90911 - DNA, 875 bp, Homo sapiens
  chr3:196386790-196387665
  hypo
ctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgag

SEQ ID NO: 90912 - DNA, 440 bp, Homo sapiens
  chr3:196388333-196388773
  hypo
tgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttt

SEQ ID NO: 90913 - DNA, 140 bp, Homo sapiens
  chr3:196389082-196389222
  hypo
gatttcatagcaggacgacgacaacaaagcatttcaaagcacagctggagggtctgacataagatcataagatgaggcctctcacctgctgcgtgactggccaccgccgtcagaacggtcctgtgatcctagcactttgg

SEQ ID NO: 90914 - DNA, 30 bp, Homo sapiens
  chr3:196401622-196401652
  hypo
ggctctcatggtgggcgcagttctgcagct

SEQ ID NO: 90915 - DNA, 41 bp, Homo sapiens; identical to SEQ ID NO: 40146
  chr3:196402166-196402207
  hypo

SEQ ID NO: 90916 - DNA, 40 bp, Homo sapiens
  chr3:196403527-196403567
  hypo
aggcgggagccaccgcgcccggccccgtttttatttttta

SEQ ID NO: 90917 - DNA, 30 bp, Homo sapiens
  chr3:196406244-196406274
  hypo
agaaattttttaaaacgatagaggttcatg

SEQ ID NO: 90918 - DNA, 26 bp, Homo sapiens
  chr3:196697284-196697310
  hypo
accacaggccccgccaccatgcccgg

SEQ ID NO: 90919 - DNA, 75 bp, Homo sapiens
  chr3:196730975-196731050
  hypo
agcaccgcaggcagacgacctgctcctcactgggctcaggcagggtcacccgcccagtgccgctagctgcaaatt

SEQ ID NO: 90920 - DNA, 246 bp, Homo sapiens; identical to SEQ ID NO: 40148
  chr3:196731283-196731529
  hypo

SEQ ID NO: 90921 - DNA, 242 bp, Homo sapiens
  chr3:196754516-196754758
  hypo
ccgggcctggcagggcgaggtcggctcctttcctggtgaatggggctgttgtgtgctccctcctgagtcacagccctcttgtctggcagggtggaagggagaggactcaccgcgatgagctggacgcagtggtcggcggaggtgccccggacgcagaggagggagggctggatgcccgcttcccggaaggcctcgctcatgttgccgcacttgtgctgctctgggtccgaggtggcgcacca

SEQ ID NO: 90922 - DNA, 65 bp, Homo sapiens
  chr3:196755979-196756044
  hyper
cgctccccgaggtcccgcctcccgtcccaccatcccgggccctgactccccggggcgccgacgcg

SEQ ID NO: 90923 - DNA, 76 bp, Homo sapiens
  chr3:196766119-196766195
  hypo
acattacactccatacgacattccgggaaaggcaaaactacaggcactgcgaacagatcggcggttgtcacagact

SEQ ID NO: 90924 - DNA, 30 bp, Homo sapiens; identical to SEQ ID NO: 40150
  chr3:196784239-196784269
  hypo

SEQ ID NO: 90925 - DNA, 17 bp, Homo sapiens
  chr3:196948094-196948111
  hypo
aaacataacagggaccg

SEQ ID NO: 90926 - DNA, 173 bp, Homo sapiens
  chr3:197183173-197183346
  hyper
atccgggaaccaggtcggagcctgcttgcagagaatgtagcatcgtggcagagaggaaaaggaactaagggaagcggaagtatcagtaaggagcctccgacagaaatggtaggctggcaacatcctgatcagcagcagaagtgattttcccgtgtccccgtgtccctgctcac

SEQ ID NO: 90927 - DNA, 30 bp, Homo sapiens
  chr3:197183698-197183728
  hyper
ggaaccccaccccaccggccagcccggtgc

SEQ ID NO: 90928 - DNA, 161 bp, Homo sapiens
  chr3:197186095-197186256
  hypo
gaagcaggaagaggccgctggacctggacgggaggacgacacctggattactgggtgtggcgccttccaccaacagtgctggccacatgtgaacagcacctggtagccttggaggctgtgagtagggattggggtcaggaggggtgcggtcaggagggatg

SEQ ID NO: 90929 - DNA, 34 bp, Homo sapiens
  chr3:197226091-197226125
  hypo
acaggtggcaggtgccgggcgccacgacctcact

SEQ ID NO: 90930 - DNA, 30 bp, Homo sapiens
  chr3:197229517-197229547
  hypo
tgctgtgccttgagtcgctttttagatata

SEQ ID NO: 90931 - DNA, 117 bp, Homo sapiens
  chr3:197246683-197246800
  hypo
tgtcctgtccctcagcgtcctgcgggggtcggggccggtggcagatggctctgtggctctcaccagacaatctccttcatctcgcccccgtggctggctccccgggctttggcagca

SEQ ID NO: 90932 - DNA, 25 bp, Homo sapiens
  chr3:197313900-197313925
  hypo
tataagaacccaacacggcgaaacc

SEQ ID NO: 90933 - DNA, 300 bp, Homo sapiens; identical to SEQ ID NO: 40152
  chr3:197327024-197327324
  hypo

SEQ ID NO: 90934 - DNA, 83 bp, Homo sapiens
  chr3:197327773-197327856
  hypo
ttcttcctccaggcccgatggtgggtctcagccagctggttacacacgagcgcgcgacatgtccaaagcgaagcacagccctt

SEQ ID NO: 90935 - DNA, 162 bp, Homo sapiens
  chr3:197402041-197402203
  hypo
ggctttatggtaacacgctttacactctactcaggttgggaaggtgggggagagaagaaaacaatttgtattatctccagctagaggtcagttgctgccacagccccttctcgccaccaaggcgtggtgtcccctggggaggccccgcgaggtgctgagtgg

SEQ ID NO: 90936 - DNA, 30 bp, Homo sapiens
  chr3:197479155-197479185
  hypo
ttgtaaccatgtaaccgtgggcagatgatt

SEQ ID NO: 90937 - DNA, 21 bp, Homo sapiens
  chr3:197601763-197601784
  hypo
agctcctggcagactcgagtg

SEQ ID NO: 90938 - DNA, 231 bp, Homo sapiens
  chr3:197608050-197608281
  hypo
ggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgc

SEQ ID NO: 90939 - DNA, 30 bp, Homo sapiens
  chr3:197616707-197616737
  hypo
ggaagtagccaggcacgtaatcacttcagc

SEQ ID NO: 90940 - DNA, 87 bp, Homo sapiens
  chr3:197685732-197685819
  hypo
acaggaaagggcttgcgtggctggtaacttgtccactacaccattgaaacagctttgcctcctggctgggcgcggtggctcacgcct

SEQ ID NO: 90941 - DNA, 26 bp, Homo sapiens
  chr3:197686059-197686085
  hypo
gagtgaaactccgtctcaaaaaaaaa

SEQ ID NO: 90942 - DNA, 317 bp, Homo sapiens
  chr3:197807228-197807545
  hyper
cgctccacctccgcggcgtcgcccttgagggccgccctgtggatcttccgcagttccgcgtccctggtgtggtacgcgggacccgggtactcgtggtcgatggagcccaggaccgcccggcccgggcgtctcccgaagctgaagagcttcctcatggggcgacttctcctcagacgcccaccaccggctcctgagcccccgcggctcctcgtggcctttccactaaccctaaccccaaacccgagatgtagctcagaatccgcgacccggccgggtccaccacagccttcagcagcgacactcgcagcctctgacct

SEQ ID NO: 90943 - DNA, 178 bp, Homo sapiens
  chr3:197840370-197840548
  hyper
agaggaaaagacagacggcggcggggacattggagaggagaaaagagagggaggaagagaggcgggaaagacagaagaaaggcaggggaggcgcgacggggcgagggacggggaggaaagcggtctcccgcctccagggcgggccgagggctgggcccgcggggcgctcacgtccctc

SEQ ID NO: 90944 - DNA, 34 bp, Homo sapiens
  chr3:19790965-19790999
  hypo
agcaggggtagaggccgcacgtctgccagtcggg

SEQ ID NO: 90945 - DNA, 106 bp, Homo sapiens
  chr3:19791264-19791370
  hypo
tgaggggagttctcccgggcccaggatggcaaaggtccgcgtgggaagtgtggatcccccggggcctctcactcaatcgccccttccccaccgtcaggagcttccc

SEQ ID NO: 90946 - DNA, 16 bp, Homo sapiens
  chr3:19911550-19911566
  hypo
gcgtgagctaccacac

SEQ ID NO: 90947 - DNA, 39 bp, Homo sapiens
  chr3:20013231-20013270
  hypo
gctgggattacaggtggaagccaccgcacctggcccagt

SEQ ID NO: 90948 - DNA, 20 bp, Homo sapiens
  chr3:20139710-20139730
  hypo
gacaacgtcccaaattaaaa

SEQ ID NO: 90949 - DNA, 267 bp, Homo sapiens
  chr3:2139709-2139976
  hyper
gaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccc

SEQ ID NO: 90950 - DNA, 111 bp, Homo sapiens
  chr3:2140037-2140148
  hyper
cgatcccccgaattccgcgtctcccggaggccagaggtttgggtacccaggaaggtcgcgcctcctcgtgccccgatactcgggttgtaaagggaggagacatcgcctcgg

SEQ ID NO: 90951 - DNA, 254 bp, Homo sapiens
  chr3:2140181-2140435
  hyper
cgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagc

SEQ ID NO: 90952 - DNA, 569 bp, Homo sapiens
  chr3:2140827-2141396
  hyper
ggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaactt

SEQ ID NO: 90953 - DNA, 225 bp, Homo sapiens
  chr3:21447375-21447600
  hypo
cagacgttcggcacccgggagccccctcaggctgtcagtaccaaggaggctagctcgtcaaatctgcatgcgccggagaggactgtggctgggttgagtaaggagccaaacccctagctggctcccggtgtccgcacagccttcaccacggagcaggtccgtgccttggagggcgtcttccggcaccaccagtacctgggccctctggagcggaattggctggcc

SEQ ID NO: 90954 - DNA, 41 bp, Homo sapiens
  chr3:21973359-21973400
  hypo
agtgtgacttgaggccgggcgcggtggctcacacctgtaat

SEQ ID NO: 90955 - DNA, 22 bp, Homo sapiens
  chr3:22241703-22241725
  hypo
tcctggcaagattatcggggaa

SEQ ID NO: 90956 - DNA, 91 bp, Homo sapiens; identical to SEQ ID NO: 39887
  chr3:22370592-22370683
  hypo

SEQ ID NO: 90957 - DNA, 318 bp, Homo sapiens
  chr3:22413593-22413911
  hyper
gaaccaggctgacctcgcccccccgcctcggcctcccctgccccttggttctcggcaatgagctgtgacctgagaccctccagctccgcgctcttcactctggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaac

SEQ ID NO: 90958 - DNA, 119 bp, Homo sapiens; identical to SEQ ID NO: 6806
  chr3:22413959-22414078
  hyper

SEQ ID NO: 90959 - DNA, 15 bp, Homo sapiens
  chr3:22414308-22414323
  hyper
cgaagggaggggccc

SEQ ID NO: 90960 - DNA, 45 bp, Homo sapiens
  chr3:22587374-22587419
  hypo
atacccagccaaggccgtgcacagtggctcacgcctgtaattcca

SEQ ID NO: 90961 - DNA, 30 bp, Homo sapiens
  chr3:23032111-23032141
  hypo
caagctacctcacaccgacatcccttctgc

SEQ ID NO: 90962 - DNA, 82 bp, Homo sapiens
  chr3:23111021-23111103
  hypo
acacattcagcagctcgaaaaggccatcttaactgacattgtctcgcagccactcatgataagaactcggcggccgggcgcg

SEQ ID NO: 90963 - DNA, 30 bp, Homo sapiens
  chr3:23245806-23245836
  hyper
acatcatcctgtgctcggtggctgttagac

SEQ ID NO: 90964 - DNA, 134 bp, Homo sapiens
  chr3:23726999-23727133
  hypo
ttatacctcccaattcggcccagccacatttcaagtgctcagtagtacttgtgactggcacctaccatatggcagctggactgagcatgtctaaaggaactctcggtgtaacccttagacgctgaaataaccag

SEQ ID NO: 90965 - DNA, 521 bp, Homo sapiens
  chr3:238195-238716
  hyper
gtgtgcaacatgaaccgagtgaaaccatcggggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgc

SEQ ID NO: 90966 - DNA, 120 bp, Homo sapiens; identical to SEQ ID NO: 28025
  chr3:239006-239126
  hyper

SEQ ID NO: 90967 - DNA, 711 bp, Homo sapiens; identical to SEQ ID NO: 28026
  chr3:239158-239869
  hyper

SEQ ID NO: 90968 - DNA, 153 bp, Homo sapiens; identical to SEQ ID NO: 28027
  chr3:240109-240262
  hyper

SEQ ID NO: 90969 - DNA, 141 bp, Homo sapiens
  chr3:24535454-24535595
  hyper
gtatcacaaccaactcgaggagacccagaggaagatgctgcgccaagagaagcaaagcgaaggagcgcgacccaggaggctagcgaaatccccgccaagcccccaggaggcggagagaagcccagtcgccaggcaccggcc

SEQ ID NO: 90970 - DNA, 77 bp, Homo sapiens
  chr3:24535911-24535988
  hyper
cgccgcgcggtgcccgaacacgagagggcacctcctcccagatccggggcgcagaagccccgcggaggcaggtaatc

SEQ ID NO: 90971 - DNA, 118 bp, Homo sapiens
  chr3:24563619-24563737
  hyper
tggcgtctatcctggcgcaggcgatttgatattttcaataggcctaacctcaccagtggcgtgcccggcccggctggctagcggctcctgtccccaagacccccgcagtcaccagacc

SEQ ID NO: 90972 - DNA, 258 bp, Homo sapiens
  chr3:24870586-24870844
  hyper
atgcatcagccacagcggtgaaggcggcaggggcagcaaccagagcagcagcagtggcagcagtagcaggcgcggccgccgccgcctccggctcagctcacgcggaaaccccactgggccgtcgtggctccgcgcggttgcgggccagcgtggagaggcgggacgtggcgcccgggggcggggcctggcgccagggggcggggcgcagcgagccgggctcccgctgtctgctctcagcggcggcggcaggggctgagg

SEQ ID NO: 90973 - DNA, 108 bp, Homo sapiens
  chr3:24871069-24871177
  hyper
ttggggggtctgcagcgggagcccgcgaccgatcccaggacatctggactcgcggacaactttgcgcagcagtcctcttccaagttccctttattgctattgtcttag

SEQ ID NO: 90974 - DNA, 97 bp, Homo sapiens; identical to SEQ ID NO: 28100
  chr3:24871789-24871886
  hyper

SEQ ID NO: 90975 - DNA, 156 bp, Homo sapiens; identical to SEQ ID NO: 28101
  chr3:24871946-24872102
  hyper

SEQ ID NO: 90976 - DNA, 30 bp, Homo sapiens
  chr3:2523208-2523238
  hypo
ctgacttaaaccccgcgcaaaaaaattaac

SEQ ID NO: 90977 - DNA, 44 bp, Homo sapiens; identical to SEQ ID NO: 28102
  chr3:25469358-25469402
  hyper

SEQ ID NO: 90978 - DNA, 55 bp, Homo sapiens; identical to SEQ ID NO: 28103
  chr3:25469403-25469458
  hyper

SEQ ID NO: 90979 - DNA, 54 bp, Homo sapiens
  chr3:25469820-25469874
  hyper
cagaattcccccatgcgagctgtttgaggactgggatgccgagaacgcgagcga

SEQ ID NO: 90980 - DNA, 1650 bp, Homo sapiens
  chr3:26664032-26665682
  hyper
ctgtgtaagggggtgcgaggaaggcaggcgagagcagcagagggagttaatactcctacctcagctggtctccggcagccaacgctcagcccccgcctcctctctccattccggaccccgcaaccgcgaggcgagagagcagcgccggcgaggcactggctgggctctgactgtcacgttaattccctgctgctttttctagtccccagccgcctcgcccctcctccctcattcccagcctgggtttggaggcgatttccctctattgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtaaggtgcagccgcctgttgcttttcgcagagcgcgggatcatccctctgcccgggtacctaggccgtccctccaaggaacaagtagaggagaactattacaccagttctaagccgtgcctgtctaagcctccctgatcccttttgcgcagaccctgggagagacctcctcctggagagagagagtcgaccctcttcgctcctgttcagccggctgctatacaatagtctgcaaacttttgtgaccccttccctgcgcggtgctcaccccgtgctgtgcaacttgcaggtttagttcttgcccttcccccagcccctcttgccatatgcatctgcccatttctctctgtgtgttcttgccagtcgacttttcactccccgcagctctggctcctgaggcgagggtttgggacccagcagtgctcgtcctgcctctaggagctgggtagggacagagaaggtgaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgggtgaagtaagtggctcagggagggaaaggctgctcgtgcggtggaggaggaagctgagggtcgggtagatctgcccacggttgagggaaatgaaaaggtactgctaatgtgggcgagcggccagccctgagaggccatctgacgaagaggaaaagggatttgagtccggagggcgctggcctgggtatgtaaatacagatgggggaggggctgggtacctgggggcgcgtggagacaaggaatggagccccggaatgccgggcccttgggtacttgggaaggcaggctgctgagtgcctgggatggggcgatcttcctcccca

SEQ ID NO: 90981 - DNA, 238 bp, Homo sapiens
  chr3:27410605-27410843
  hyper
tggctcccgaggcttcggggccgctccacagggacctgaggacgtctccccggagaccctgactcaagctgctcgccggcacagccgagcaccggctcccgcctactcaccgcgcgggagggacggtccctccttcaggccaatctccttatcattgtccctgctgctgtcacctgctgctgcagaccgggggtcccgtccagtctcagcccgtcccgtcctccccccagcctattcc

SEQ ID NO: 90982 - DNA, 197 bp, Homo sapiens
  chr3:27410882-27411079
  hyper
cgttggttttccaatcaaatcctcctccaggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccac

SEQ ID NO: 90983 - DNA, 920 bp, Homo sapiens
  chr3:27754008-27754928
  hyper
aataatgcattgcttcggcggcggtcagagatccatgtgacgcgggggcactttagggaccattgctgagggcctggttagcatttgggcagctgaatccttcccttggcgaactccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttggggttcgcatatttgaaagcgtaaacttgaggaatgacggcggggtgatgggtattttatagagtgggactcaatcgtgctcagcaacagatttctccaaattcccttttaaaaagagcctcccagagctgtcgaaatctccgcggggtgaaagctaaacttttggagtcgctgtgtagccgggtagaggacacggcggcgcgagccggaaagataagtgtccaggcgaatgggaaaggaaagatcttaatttttgttcctactgttagctgaatgtccataaaaatcaaagggaatgcggggaagtttttattccagagcgtttccatgacacccgcagagatttaaaaaattacattcctccccctacgcaggtttaattcggaaagaagagact

SEQ ID NO: 90984 - DNA, 155 bp, Homo sapiens
  chr3:27756087-27756242
  hyper
ggggtgtggggaaggcgctgaccaggataggggggctatgagtctcccttccggaatctaaatcagtcatccacagtacatatatcttaaaaagcacatcttcaacgcttttgtccttggctccccggtaaagttcggggcgcctttgccaaagt

SEQ ID NO: 90985 - DNA, 62 bp, Homo sapiens
  chr3:27756653-27756715
  hyper
tgtccttcgtcttcccgtggagcgtgggccaaataaacggaactaagcgcaaggtgaactgc

SEQ ID NO: 90986 - DNA, 1826 bp, Homo sapiens
  chr3:27762336-27764162
  hyper
atatcagaactttctcgcgcaccgaacccgagccaggtctggctccagggcagatctaaccacctactccgaccgagcttccgaggccggcgctctagccttcatgcccacctcccggagacgccccgtggagaccctggcgcctaaaactgcgggagcccatctactgcgctcaggtggccagctcttgagccttccctatccgtggctccttgccggcatgcaggcatgcacaagcataccgccgagcaggaggatctaacgaatccagcttgtggacatgccctaatttccatttccgcctcctccaggtctgttcaggtgaggatgatgggagggaaaagcggtgtacagccgtaacattggcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctt

SEQ ID NO: 90987 - DNA, 65 bp, Homo sapiens
  chr3:27764407-27764472
  hyper
ataatcaatcctggtgtctgtaatttcgccggaatttagggggacaaagtttggggtctccatag

SEQ ID NO: 90988 - DNA, 79 bp, Homo sapiens
  chr3:27764595-27764674
  hyper
cgtcccggaggctggggaaactggggcaagttggagacaggcccaaggaagtctctttcctcgtcggaagctgtaactt

SEQ ID NO: 90989 - DNA, 464 bp, Homo sapiens
  chr3:27764898-27765362
  hyper
aagagtgaaactaagcgagctaacaccaacttcatactcacgccaacacaactgctttcggggagacagtcacttttattccccacaatttaaaatcctttctgctcagttttcctgatcccggattccgtcccttcaccaccatcttcagttaggcctgacaccaagaaacaaagcttccctaacagccccacagttaggattccctgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttc

SEQ ID NO: 90990 - DNA, 142 bp, Homo sapiens
  chr3:27765400-27765542
  hyper
cgatcacacgggaaactcttcgcccacaacagatgagatggccaaaggattgctgagtgcgcacacgcaagtgtagaacagtgcgaagctttccaacccagttttccaaccacagcagcaccaacatcggcatgtctggggt

SEQ ID NO: 90991 - DNA, 30 bp, Homo sapiens
  chr3:27765844-27765874
  hyper
agttagtgtttggcacggctgttttgatca

SEQ ID NO: 90992 - DNA, 580 bp, Homo sapiens
  chr3:27771471-27772051
  hyper
cctcgctggggtttgcggtgcccctgcctcctgcatgaaagcgcgctctaaagctagggtttttggactttaggagcgcttctcgcctccccctagacgtttgaagccttccaattgagcaagggctgggaagcgagaaggctcctctggtctctccctcctctgagcgcgggacctcggcggacaccctaatcccgaaacactcctctctgggactgcgcacttgccagcacgacagccaactccgcctcagaggagtcttttagggctctgagcgagtggcgaatgctcccccggtgatgcactatcgctcccacccacgccctggtacgcgcagcccgggaaaaagaaaaaaaaaagtccacgtaggggctcaaacccaggcgtcaggcgctgcagtcagggaaggctcccttaggggctgggttcctggcgcttacgacgcagagaaggataagggcgatggtttcgcaatcccaccccctcctttgtcctcctccccacctcccagcctttggcggcttagatctccaaatgcagtctggatggcactcaggtattcgagcgccccagtttatct

SEQ ID NO: 90993 - DNA, 20 bp, Homo sapiens
  chr3:28616662-28616682
  hyper
acggcgcccagctggcgccc

SEQ ID NO: 90994 - DNA, 1300 bp, Homo sapiens
  chr3:28616683-28617983
  hyper
ccccgggcacattgcagtaaatgcctggcagcgacttctcgcttctccttcctcctaccccatcgaccctctgttgccgacctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttctagtcctcgccgccaccacctcgcacaggtcggagatccctcctttccttggctcctttgcgttggggagggggtaaggctgagggtcggcgcttggtcagcgggcggggaaggtagatttcacttgcacctgagagtccctattcttgccagcttcgccgggcaaagcccggcgaccaggttggttcttccagcaactttgttcagaaggttggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaagggagggcgcgcgggaggcggcccctcctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcgacgatcccgagacgagacccaacggcgagaaaggagagag

SEQ ID NO: 90995 - DNA, 127 bp, Homo sapiens
  chr3:28618197-28618324
  hyper
ggtttcagtgttcagcggtgtgtgcagagaaaagtcgtctggtacatgcggtgtgatgctctgggcaagcacagcacctcagtagagcagtgatgagacctttgcttgccctcgcagtctaactgag

SEQ ID NO: 90996 - DNA, 191 bp, Homo sapiens; identical to SEQ ID NO: 39849
  chr3:2909417-2909608
  hypo

SEQ ID NO: 90997 - DNA, 86 bp, Homo sapiens
  chr3:29322482-29322568
  hyper
ctggagaggctctctcggttccacccaccggctggaaggaggggaagtgaatgaaaggacaggacaagccccgaacaccatgtcac

SEQ ID NO: 90998 - DNA, 18 bp, Homo sapiens
  chr3:3100258-3100276
  hypo
acccggcccttaaggccc

SEQ ID NO: 90999 - DNA, 78 bp, Homo sapiens
  chr3:3167655-3167733
  hypo
cggcaaaagtaatcccggcacttttgggggccgaggcctggggaacacgaggtcaggagttcgagaccagttggccaa

SEQ ID NO: 91000 - DNA, 30 bp, Homo sapiens; identical to SEQ ID NO: 39851
  chr3:3167988-3168018
  hypo

SEQ ID NO: 91001 - DNA, 139 bp, Homo sapiens
  chr3:32151266-32151405
  hypo
agctggacacagtcccggtccttaaacaacttaccttcaggtctgagatcagtgaggacatggaagataagaccgaaggaattgccaagtggaatggagtaactgctctgttacactttaaatcgtgtttctttttttg

SEQ ID NO: 91002 - DNA, 53 bp, Homo sapiens
  chr3:32433612-32433665
  hyper
gggtccgggagcggacgcgccgggcgtctggacccggccggagcccagggagc

SEQ ID NO: 91003 - DNA, 203 bp, Homo sapiens
  chr3:32433865-32434068
  hyper
ggcaaagttccttttcgtctttcttcctcttctctgggccgcgccgcttcgaacccgagccgggggtggaagagtcgcccaggcggcggcgctgagggagcgaaacccgacctcttccccgtccacggcctcctctttcctccgaacccagcgcggcagggcttccctgctctgtgtgcagtttcgctcgaaggaggaggtca

SEQ ID NO: 91004 - DNA, 36 bp, Homo sapiens
  chr3:32443015-32443051
  hyper
attccctgtgtgggccggtgtatttatttaaattcc

SEQ ID NO: 91005 - DNA, 358 bp, Homo sapiens
  chr3:32443152-32443510
  hyper
cgcgccgggcccagcgtgcggccctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgacttgtgtttaaatcagcaagggcagtgacgcggctcttccttttc

SEQ ID NO: 91006 - DNA, 1241 bp, Homo sapiens; identical to SEQ ID NO: 28120
  chr3:32857718-32858959
  hyper

SEQ ID NO: 91007 - DNA, 30 bp, Homo sapiens; identical to SEQ ID NO: 293
  chr3:32859255-32859285
  hyper

SEQ ID NO: 91008 - DNA, 860 bp, Homo sapiens
  chr3:32859417-32860277
  hyper
gggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggac

SEQ ID NO: 91009 - DNA, 39 bp, Homo sapiens
  chr3:33136909-33136948
  hypo
cgggaggctgaggcaggagaatggcgtgaaccctaaaga

SEQ ID NO: 91010 - DNA, 1100 bp, Homo sapiens
  chr3:33259696-33260796
  hyper
tctctctcttagcctcgctgattcccactcatctttcacgtcttcccggaccaagccaaaatatccgagggagttttctaaccatcggcggtgtcctcaggggcacattaatagacgttgagaaactgagggacggcggaaaatcaccccttagcagaggaggttctagggcaccttagaggtgatttcattcgagctttcttggagaccttaggaaagccagcggcgggactgcgggacctacgcgctcggcgctaagggagggtccaggcaccaggcgggcgtttgggcgcacgggcacgcggagacttggtgggccaggagagggatgctgggtcgcaggaccgcggctcgttcgttcctctcaggcttgcgcttgccgcttgccgggccggtcagagggagcagccccggcgagctacgccctccctgcccggaccccacgctccaccccccgccccgccgcctcccgcacactcaccatccgcccgcaccgaaaggcgcggcagaccgagcaggagcagcgccgccgcccagagcccggggaggcgtctgtgccaacgggcaggcgggctgggtccctcggcagtcatggtccgggagtgcgcgggccagcggactcgggtgagggctctggctgcgtttggggttgcccaggccactgcccagcgtgcgccactcggctctgcgctctgcgctcggctcacgaatcgcaggcttcgcgccgggcgcgccgagagggaggagcgcggagagccgggggaggctcgggacgcagagccggagcgcctgggccgccgaactcccgggggtcttctctgtggcgccgaggaggcggctgtaacccggctccgccttcgcgctgggcacctggaaacctcggtgccaaaaggggctgcgctgggccgcgcgctctgcgggtacagcggggcggagggcgagggcgcagggaggcggggagagtagctagccggccgcaaggagcccccgcccgtctgggggacccttggcgagagggtgacgcagtctgacaggcggagcccctccggcagggccgttagacaacgagtgtctaactctgtcctcggcctctacttttc

SEQ ID NO: 91011 - DNA, 235 bp, Homo sapiens
  chr3:33318803-33319038
  hyper
gcccagttccagggccgggggcgaggggtgggcggtccaaagggcaccgcccctgcgggtcacgtgctcgccgaccaccaatggccgcctccgagcccaccttggggacggggcggggcgcctggctggcgtcaccaggacaacgggcgtcgccggcgccgtgtgacttcgggctgtgggctcgctcgcggctcttcggccatggtgagtctgggacccgcgtctgcctagctgc

SEQ ID NO: 91012 - DNA, 57 bp, Homo sapiens
  chr3:33319265-33319322
  hyper
ccccacccagtgggccgccggacgacgtgacgctgtttggcccgagagagcctggga

SEQ ID NO: 91013 - DNA, 270 bp, Homo sapiens
  chr3:33841087-33841357
  hypo
tgttattttagcaaacgcttatttagctcatgctgatttaatgagggttcctttcatgatacttaatagttataagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaagacttattctgccgggcgcggtggctcacgcctgta

SEQ ID NO: 91014 - DNA, 89 bp, Homo sapiens
  chr3:33841657-33841746
  hypo
tgaaaagtctagggatattccttccttagctttaggtatcactggagatcgtcttgcctccgtgatgcttccctcgaaagctttgttca

SEQ ID NO: 91015 - DNA, 29 bp, Homo sapiens
  chr3:34246970-34246999
  hypo
aaacacctggctgggcgcggtgactcacg

SEQ ID NO: 91016 - DNA, 190 bp, Homo sapiens
  chr3:34690946-34691136
  hypo
ctgaacttcattttccgtaactacacagttatcattaaactcagattgactcataaagttaccattaatcatcaaagaccaatgaaattcagagtgtaatcctgatcaaggcaagaaagttggataatttagaattacttgcagcagtcaatattatgtaatgctcgctaatccccgaagtatttgctac

SEQ ID NO: 91017 - DNA, 126 bp, Homo sapiens
  chr3:35204511-35204637
  hypo
ctcaaatcagttatacgctatcctctttggcaataaatattttttttcaaatttacattatcatggatgctgtaactaagtggatataaaaacactttctccttcccgatacgttgcctattatat

SEQ ID NO: 91018 - DNA, 827 bp, Homo sapiens
  chr3:35680814-35681641
  hyper
cgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgc

SEQ ID NO: 91019 - DNA, 194 bp, Homo sapiens
  chr3:35740310-35740504
  hypo
caaattaaacaacatcggtactaagttagatggtaaaaatatgatgccaaaaaaaagtctccagaatcaccggacacactggattcacaattgccttggcatacttagaagtgacacaaaactgtttcatgttcttaaattatgtcagatgaaaatcatttctcaagtgttcggtactgcgctttgaacaaaag

SEQ ID NO: 91020 - DNA, 19 bp, Homo sapiens
  chr3:35866142-35866161
  hypo
agaccggagctgttcctat

SEQ ID NO: 91021 - DNA, 23 bp, Homo sapiens
  chr3:36407036-36407059
  hypo
cgagactccgtcccaaaaaaaaa

SEQ ID NO: 91022 - DNA, 30 bp, Homo sapiens; identical to SEQ ID NO: 28126
  chr3:36421872-36421902
  hyper

SEQ ID NO: 91023 - DNA, 41 bp, Homo sapiens
  chr3:36422182-36422223
  hyper
caaggaggcggtgggcgccgagcaaccgccctctcctgcat

SEQ ID NO: 91024 - DNA, 29 bp, Homo sapiens
  chr3:36805450-36805479
  hyper
caggtggtgtacacccgcacgcgcgcgcg

SEQ ID NO: 91025 - DNA, 555 bp, Homo sapiens
  chr3:36805575-36806130
  hyper
cgcacggagcggggtccagagttagggcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcgacggtcgagcaggcgcgggaaggcggggcgagacgagcagccacgagcccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccc

SEQ ID NO: 91026 - DNA, 49 bp, Homo sapiens
  chr3:36806178-36806227
  hyper
cggtggaacctggctgcgctgggttttgaacgtgcgctttgcccctgtt

SEQ ID NO: 91027 - DNA, 602 bp, Homo sapiens
  chr3:36985811-36986413
  hyper
gttccccgcaaattccgcccttcccgcctggcacggttcccttgcaccgctgtgctccgctcccaggtttctgcccgccaagaatgcttgccccgggggcgcgctcgctggtcaggaacctgtcggcagcccccgggaacccctgaggatgcggaggtgggcccgagagctgcggcttcgatgccggggtgggagctaggcaggccgcgcgccgccgcagtcctgtcgcagcgcgtgccctggtccctccggaccgaaaaggccgaagccgtcccccgcgaccgaccccgcgcaactggctcgggtctgcacctagatggctgtgggccccacagggatggccgggcgggcccgttcggccgctacctcagggtcgccagtccccgcgcgcggccgcctcccgccaggaagggtggcgggcccggaaggccagagatgccccagtgcttcccgcgccgctacgcacctagctgcccgcgggtcccacatggctgcggccggagggtccgcaccaggaccgccgccgcctggggaagcgcttccctgtgggcagggcgcggcgggcagtgcggaagcccgaaagctaccggagcccggggcag

SEQ ID NO: 91028 - DNA, 57 bp, Homo sapiens; identical to SEQ ID NO: 28130
  chr3:36986663-36986720
  hyper

SEQ ID NO: 91029 - DNA, 17 bp, Homo sapiens
  chr3:37296942-37296959
  hypo
cacgcctgacctttata

SEQ ID NO: 91030 - DNA, 611 bp, Homo sapiens
  chr3:37493519-37494130
  hyper
acggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttc

SEQ ID NO: 91031 - DNA, 43 bp, Homo sapiens
  chr3:37876198-37876241
  hypo
tcccctgcttatccacggtttcgctttccgagctttcagttat

SEQ ID NO: 91032 - DNA, 49 bp, Homo sapiens
  chr3:37902046-37902095
  hyper
caggccctcctgattcgtggagagcgcgcgcgagcgctcctgccccacc

SEQ ID NO: 91033 - DNA, 66 bp, Homo sapiens
  chr3:37902518-37902584
  hyper
gcctctggcccggtccgcagactccctctctgcacagatcactcccgatcccgctcactcctggga

SEQ ID NO: 91034 - DNA, 30 bp, Homo sapiens
  chr3:38030684-38030714
  hypo
gatgttcacactgaacgtgttcctggggct

SEQ ID NO: 91035 - DNA, 372 bp, Homo sapiens
  chr3:38032099-38032471
  hypo
ggagggcgctggtcccgacggcttgctcgatatttgttgactggctgactaagtgaatgcctagcccgctgagcactgtgtggtggggtgtgtcctgcagggcaggagctaggattgagttacagtggtggggaccaggagtagggaggcagagactggccccgtgccaggcctagcactgcccacaggcagggcgaaggcgcgggagcagtttccagcaggtaggcctgggcagagagttggggggcgggggtttccagggaaccagtggggcagagtgggctattcaagtcaagggcatagagcatagggtcccagggctcagggccacagagcctccgcggcagaattgggaggcggcagcagcccagc

SEQ ID NO: 91036 - DNA, 301 bp, Homo sapiens; identical to SEQ ID NO: 28132
  chr3:38035773-38036074
  hyper

SEQ ID NO: 91037 - DNA, 50 bp, Homo sapiens
  chr3:38041092-38041142
  hypo
gttcatacatagtcacgcctaatcatacacagccacgggcactcacacaa

SEQ ID NO: 91038 - DNA, 829 bp, Homo sapiens
  chr3:38070745-38071574
  hyper
cgtaccgcccgcccacccaccccccgggctagatctcggacaagcctggaaacgcccagggtcgtgcccggcagtcccacccagggagccgcgggctgagattttcccagtccggagaaggggcagagaggcgggcccggggtggtgtggaggcggccgaaggagctgggggctccctgtccagggcccggaacagctttccaggggtccacccctgcagggtctcccgctcgcgcgggccaggcactcaccgtgcagggtcaggaagtcccggcccgagtccatgcccgacgggcggcgcggcgggaggggcaccgcgggactcacttgagtagcgacagcaccggcggcctggggtccgagcggagtgcggtgcagggacctgaatggaccgcggtgggaggaggccgggggtggtcccgggacaccgccccgcccccgctgccctgcgcccccgccccctgagcccgccaaccctcgtctctccccgcccccttctggggacgcgagagggagggcagagctgggggcccggaggactggccaaccctggcccgggccagcgggcgcgccccgaccagaaatagccagattcctccagcttcctccgccgccgccacccacgggccgcgggccctgtcattaccgcgggcggccgggccccacgccctgttgtgggcgcctcgctggggtcggggtgatgctggaaagaatccggcgtcatcccggggaagggatcgtgtaaggtccgacgcccagccgggctgctgcgctagggagacgcggcgtccaggcttccagccgcagctcccagcgttcgcattccctt

SEQ ID NO: 91039 - DNA, 390 bp, Homo sapiens
  chr3:38080619-38081009
  hyper
tgaccacagcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccgg

SEQ ID NO: 91040 - DNA, 133 bp, Homo sapiens; identical to SEQ ID NO: 6836
  chr3:38081153-38081286
  hyper

SEQ ID NO: 91041 - DNA, 15 bp, Homo sapiens
  chr3:38081338-38081353
  hyper
cggcatatatctgta

SEQ ID NO: 91042 - DNA, 20 bp, Homo sapiens
  chr3:38207993-38208013
  hypo
gtaagaagggctgggcgtgg

SEQ ID NO: 91043 - DNA, 30 bp, Homo sapiens
  chr3:38350133-38350163
  hypo
acgtgtctggtattgcgtcttttctataag

SEQ ID NO: 91044 - DNA, 2178 bp, Homo sapiens
  chr3:3840430-3842608
  hyper
gccttctcagtccctcgccgcctgtttaaacacaacttccacccctcacaaatcagaaagctgtaatttcaaagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctgaccgcctttgcttacaccaggtgcacgccggctgcggggagcacaaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatttcaggggccgaccaggggagggaggtgcccggggacggggagggaggagggctgccgggatgtgaaccggggaaggcagctggggctggagagcagcgcggaaagggggcccagggagctggaaagagggccaagaggagggcaaggaaggtggcgggcgacggggagaggaaagaaaaagggtgtcttggcggtggccttggtaagagaaaggggcaaggggtataattgacaaggcactgaaagtattgaagtcagagccttgggaaggatctaccgaactctcggcggtccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagctccacgcggggacagacctcagcccgtgagccttgagcccagaaggagtggcagcctcaggacgtttgccaggtggcctggaatgtgagggaagcctcagccccgccaggaacagagctggcgctgagttcccggctcggcccgggtcagaagcgaggaaagtttgccggcgagtgtcctttgtgctgcgtggagaggggtgt

SEQ ID NO: 91045 - DNA, 147 bp, Homo sapiens; identical to SEQ ID NO: 39897
  chr3:38627339-38627486
  hypo

SEQ ID NO: 91046 - DNA, 169 bp, Homo sapiens
  chr3:38631185-38631354
  hypo
cctacaggtggggcccgggtagcgcctcacttggacccccacttttggtcttccccagcactgccggggtgcaccagggtgggtctggcacccatgagtgccgacgctcatttctagagaatggagctcaggaaaagccctgcacctcactttgcgcaggctctcagct

SEQ ID NO: 91047 - DNA, 30 bp, Homo sapiens
  chr3:38640456-38640486
  hypo
gtgctcctggctcctcgaagccatctacac

SEQ ID NO: 91048 - DNA, 319 bp, Homo sapiens
  chr3:38690443-38690762
  hyper
tctacatggtctaaacgcgcagagatctcgtcccacagagaggacagccccagcggacggttccccctgggcccagagaaagggggtgcgtggcttcctcccccatatccagccctgctcggtcagcccccgcaaaccccgctctctggaaccacattcatggcgcgcctagtcgccgctctgaccttggggtctccggcctccggtatccgggtcccaatcccagaccctccccgagcctgcgccagggatggccgggaagctggggccgcagctccccctcccccggccctcgacagcgcaccgggaaacccggaag

SEQ ID NO: 91049 - DNA, 55 bp, Homo sapiens
  chr3:38691089-38691144
  hyper
gctcggggcactgggcgcaggctcagcggccccgggggagcgatccctgcatcct

SEQ ID NO: 91050 - DNA, 58 bp, Homo sapiens
  chr3:38691468-38691526
  hyper
cgacccggcgacgcttcaccacagatggccacccacgcggacgcggacaggctcacat

SEQ ID NO: 91051 - DNA, 30 bp, Homo sapiens; identical to SEQ ID NO: 39898
  chr3:38950258-38950288
  hypo

SEQ ID NO: 91052 - DNA, 33 bp, Homo sapiens
  chr3:39167780-39167813
  hypo
acttcttaaacaagtcgccgtgatcttgaatcc

SEQ ID NO: 91053 - DNA, 42 bp, Homo sapiens
  chr3:39850324-39850366
  hyper
cgggaactcctggcacgagcccgaaagcgttcctcacttgca

SEQ ID NO: 91054 - DNA, 792 bp, Homo sapiens
  chr3:39851235-39852027
  hyper
gcagcccagctttagcgcgcagaccgacccgcgccccttcttcgccgccggcagcctctaatccacgcggcgcgttgcggcaggtgccctgggcgtactgaggcgcggtggcctgagcccggccgccatcgatgaccccggtcgcggacttgcttcaggctggccaccccccgtgagtaccgtccgcctccctcttctcccctctggcagctttgcgccactctcccctcaacgttgccgcaacttcgggggtgggtgtgtgaaggtgtggaggtgtctctcacgctcccccgcaccctgtgcgcgtccggagccaggaaccctaggcgcggccagtcagcctctgcggaggggcgaggggcgcgggtacttgaacttgctcagggatcatcgcggagccagaatcgcctctttctctcgctgctggggtgggagctcgcctctgcgtttccctcgcgttttccgatcccggatggccacgtagtgcttgggctgcggttcaccgcgtacctactgtgctgcgggcgcaccggcgggacgcctcaaaccatccgttaagcgccccgcaagcagcccagcgcgacggacctgactcaaactcttaattctgtaaaacgggggtaatcagggactctctcaaggtcacagctggtgctcagagttagaacacaggtggattgcgtctggccctcgcccgcgggctgcctggggaggggagagctgttggcggggcggtcacttcagcttcatcccgggttcctcctcatactccctttccgccacagccgccag

SEQ ID NO: 91055 - DNA, 40 bp, Homo sapiens
  chr3:40501052-40501092
  hypo
ttgctgtatgttggccgggcgcggtggctcacgcctataa

SEQ ID NO: 91056 - DNA, 30 bp, Homo sapiens
  chr3:4071112-4071142
  hypo
ttctgggtattgcctcgctgggcctggcta

SEQ ID NO: 91057 - DNA, 52 bp, Homo sapiens; identical to SEQ ID NO: 39900
  chr3:41289147-41289199
  hypo

SEQ ID NO: 91058 - DNA, 30 bp, Homo sapiens
  chr3:42056206-42056236
  hyper
gcctgttttagaacccgtggctgcacttgt

SEQ ID NO: 91059 - DNA, 20 bp, Homo sapiens
  chr3:42162758-42162778
  hypo
tttttttttttgagacggag

SEQ ID NO: 91060 - DNA, 149 bp, Homo sapiens; identical to SEQ ID NO: 39901
  chr3:42200630-42200779
  hypo

SEQ ID NO: 91061 - DNA, 18 bp, Homo sapiens
  chr3:42222719-42222737
  hypo
ttgcattgaaatgtgcgt

SEQ ID NO: 91062 - DNA, 438 bp, Homo sapiens
  chr3:42304950-42305388
  hyper
ggtgcgctcgggactcgccatccgttctctgcgataccctcagctgcctacggggcgcctcctctgcccgctgcagcccggagcccgcgggatctgcgggaggcaccggctgcgtcagggcgccagccgccagtaccgccatcagcacgcacaggcacacgccgctgttcatggctgtagcgagcaaaggaggagggcgcgttaactgaaaggctgggcaacagagctcctgcggcgggccgggcacccagaagcgggcttaggacaaacacaggtgctccagacccgccaggccgccgcaagcacgagggctcgccaagcgctgaccccagccgagtgccatggcgcgcgcccccgggcgcacctggctggtctttgggaactcctcacccagcgccaaggggcagagaccctgttttctgccgtgttgagcagaag

SEQ ID NO: 91063 - DNA, 553 bp, Homo sapiens
  chr3:42543027-42543580
  hyper
gctagcagccacctgcgcttggtccacaagaagacgcgctcccagggcgcagagctggtgaccccgctccccatgccagggacgaataaacgagaaaaggggctgacccggtgtcacccagcggccgagcagccgccccttggaagctcagcaccaaaggcaggcggccagggtcctggcccctctctggaccccagtatccccagctgtaaaatagggaatgcaggaggaggacgacgtctgtggatcgttttaggtcagctgcggagtcggcctgcgggctgggagcagacctcgctccccacgcgagggcgctggcacttcagcccagcctccctggggaggtgccctggacgagacccgcgagggtgcggacacctcatcctccctggagcaggtctcccgaggcttgaagggccagggcacccaacaggtgctgagcgcgccccaccaggtcacccgggagcagggaacaccaaggaacccagagtcgggcctctttcgagccctcgcttcctctcgcctggcttcttcggcgcgaaggatgaattgg

SEQ ID NO: 91064 - DNA, 44 bp, Homo sapiens
  chr3:42631036-42631080
  hypo
gaggtgagcagagggcggataagcattaccgccgagcattctgc

SEQ ID NO: 91065 - DNA, 120 bp, Homo sapiens
  chr3:42640754-42640874
  hypo
ccatgtaatgtgtattttatagtttaaaaaaaaaacttataaaatagtgtggtactcagacacagatcattggaacaaaaatccagaaacagacccacacatatatggtcacaaggcgaa

SEQ ID NO: 91066 - DNA, 860 bp, Homo sapiens; identical to SEQ ID NO: 28144
  chr3:42814258-42815118
  hyper

SEQ ID NO: 91067 - DNA, 108 bp, Homo sapiens
  chr3:42850925-42851033
  hypo
tcttgaactttctttcgattgtagcatttctcctttcaggatacagtacgggatcctttctggaatggaggtcttatgagctgctattgaacacggcaggtgagagaa

SEQ ID NO: 91068 - DNA, 440 bp, Homo sapiens
  chr3:42947369-42947809
  hyper
gtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctgg

SEQ ID NO: 91069 - DNA, 129 bp, Homo sapiens
  chr3:42947832-42947961
  hyper
cgacctgggctatggcggccgtggcgctggcgagcgggacacgcctcggccttgtcctcgagctgctcccgggacagcccgcgctgccccgggcgcgccgggtgagtgcggggccggagcctggaagca

SEQ ID NO: 91070 - DNA, 575 bp, Homo sapiens
  chr3:43020896-43021471
  hyper
cgtgtattccccacccgcggagtatcccggtgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggtaggactcgcgggaaggaacgcgcgagcggagggtggggcgatcaccaggacaggtggctgcagtcaacgcgcagcggcccagggcgcgcgcagcctgcgcggcctcccgaggccggagttgttccccgaaagttgcatggggcggcggcggctttcatttctgcaccagagctgggggcgatcggctttcctgccgctcttagtggggcggaccgtaataagggggcttttattactaatctgcactccttgacctaaccgtaacccactcgcaactctgcaatcttcatgcaatccacaaggcagggagaggggagcgttccctggggaac

SEQ ID NO: 91071 - DNA, 326 bp, Homo sapiens
  chr3:43147281-43147607
  hyper
gcgggtgtcggagtccgctccagccccaagcgcgcgcgcgtcttacctgaagcctggactccgcgggacgaagccacctccgccgacgcgtccaggaggccccacggcggcgccgctttcccaccccgccgccgcccccagcgccagcttctggcccaggaggcccagaaggcccaggcagccagcacaggtttggccgcgccgccgggttcgcagcgaccgccacctccaggctcgcaggtgtccgccgtgcgcctgcccggcgggcgagcccggcgcggagcctgtgcgcctgcgcagagccgcgagttcggttgccctggccc

SEQ ID NO: 91072 - DNA, 38 bp, Homo sapiens
  chr3:43633110-43633148
  hypo
aggttccaagatggccgaataggaaaagctccagtcta

SEQ ID NO: 91073 - DNA, 30 bp, Homo sapiens
  chr3:43655462-43655492
  hypo
atgggagccacacagcgttcaacttagact

SEQ ID NO: 91074 - DNA, 30 bp, Homo sapiens
  chr3:43664372-43664402
  hypo
tttgagatagagcctcgcaatgtcacccag

SEQ ID NO: 91075 - DNA, 29 bp, Homo sapiens
  chr3:43664642-43664671
  hypo
ccaccgcgccctgccggctttaagtgttt

SEQ ID NO: 91076 - DNA, 32 bp, Homo sapiens
  chr3:43749395-43749427
  hypo
acaggcatgagctaccacgcctgacctgatta

SEQ ID NO: 91077 - DNA, 204 bp, Homo sapiens
  chr3:43828321-43828525
  hypo
ggtagaggggccaagcgctgtgacactggtgggtaccatctcggactagagtccttttccccagaagtctcagtggtgtcatcctatagcaactgctctccttgaacatgctgctggggccaatgccatatttcccaggctcccatgacttaagcttccctcagctatgcagggtcagctctgagggtccgtccaaaccagcag

SEQ ID NO: 91078 - DNA, 385 bp, Homo sapiens
  chr3:43935797-43936182
  hyper
cagcccagcatctcccgccagcctcgctgcccgctccgccccggcgcaggggccccaagcccacaggcaacgccagcgcgctcccaaccgctggagacagaaacaatgtgcgcgcgcacacggcccacgtgcacgcgcgcacgcccacgcggcatacaggcgcgcacgtgcacacgcgcgcctgcacagctctgcggctctgctccggccccacaggcccatcttaaagtgtttcgtgctctaacttaccaaacacgtggcagccggcagaacgaaaaggaaaataaatgaactgcgacgaaataaagcaggcctttccgcagtcggccacgtccaacagccacttggttcctagcgctttctcgttacccggcttgggcaaagc

SEQ ID NO: 91079 - DNA, 960 bp, Homo sapiens
  chr3:44036168-44037128
  hyper
tcactttgctgtcagcgacgtgatgtgctctgcagtgctggaattgagagttcaagagagagataccggtcctggcctctcggtgttcaggtgtgtgtataggtgggcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgc

SEQ ID NO: 91080 - DNA, 1793 bp, Homo sapiens
  chr3:44037129-44038922
  hyper
ggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttct

SEQ ID NO: 91081 - DNA, 669 bp, Homo sapiens
  chr3:44039357-44040026
  hyper
gagggacgtgttgcccgactggtctaaataaggaaagaaagtggagtaccaaagaatcaagggcctctgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcacca

SEQ ID NO: 91082 - DNA, 1094 bp, Homo sapiens; identical to SEQ ID NO: 28152
  chr3:44040056-44041150
  hyper

SEQ ID NO: 91083 - DNA, 830 bp, Homo sapiens
  chr3:44063273-44064103
  hyper
gactccggccctgcccggggtaggaagtctttgtctgcctgcgcgcccgagcgctcccggcttgggattgatttttggcccccgctgcagcaagttgggggctggtgaggagtgtagcggtgactgggggcggagtgcggactcgcatccgctgtaccaggagcccactgccacctcgggattttttttttaacttggaatttccatatgacaaaaaagaaagaggtttctcctcaatctaacggagccattaacatctattaataacgccgacagggtaagtaacggagccgcgctcctcggggtggtcaccgggctgcgtggtcctcggccggcctcctgcatccgctgcccctgtgcgctccgggccggatgcgcaagggcggcgcggggaccaagcctggctgccggccgcctactcctccccttccctaaggtaaggggtcgttttcacactcaccagagctcctgcgggctgagctcgccccctcccccgacttctttgcggggcattttctcttgctggtgtattacgtgtcatttctcacggggcattgccggccgcttttctgcaactgtcctttcggatttggtgatctggtccggcacagaggctctcctaggaggtggtgcccatgcatattcattctgtgtagtaaccgactggccgtcttgccattgcaggctgatttattgatttatgtaggaagtgtgttttattttagtaattagggaaccctgaattcacgggaaccgtctgcacttcgcaggcatgttcattgctgggcatgaaagacaaaggttgtcgtgcaccccgcttcattttctag

SEQ ID NO: 91084 - DNA, 236 bp, Homo sapiens
  chr3:44481308-44481544
  hyper
caaagcgggcacccacgccagtctgttgggcttcagtgaaaggacgaacaagtggctctggtttttgttgtggttatgagagctcagtgcatttgacagtcagggtttgcacagtttgaacttcccctctgacgcaaagaggaagtggctgggctttcttatcagcttgtccagatccaggcaaactgagggggagagcttgaatgctattagcagacaaacgtcaaacatgggga

SEQ ID NO: 91085 - DNA, 567 bp, Homo sapiens; identical to SEQ ID NO: 28155
  chr3:44596464-44597031
  hyper

SEQ ID NO: 91086 - DNA, 197 bp, Homo sapiens
  chr3:44626341-44626538
  hyper
ggggcttctgaggggcggggggactccagcccgcgggcacagagatgtggaaacctcacgaagcctagaagggccggagggacaggctgggagttagctgggagttgctgacgcagttccttctgcgctttgttcaagatgtgggtctggcgctttcggtgaggggtgctctacagtctggcgtggggggtcgggcc

SEQ ID NO: 91087 - DNA, 200 bp, Homo sapiens
  chr3:44626539-44626739
  hyper
ggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggctggccgtggtgacagcact

SEQ ID NO: 91088 - DNA, 30 bp, Homo sapiens
  chr3:44690145-44690175
  hyper
agaggaaagcacctccgaggttcctagaga

SEQ ID NO: 91089 - DNA, 59 bp, Homo sapiens
  chr3:44690430-44690489
  hyper
accagccttgtctgtcggggtgcggggggcagtgagttccccaccgcctcggaatcccg

SEQ ID NO: 91090 - DNA, 223 bp, Homo sapiens
  chr3:44726846-44727069
  hyper
ggtataaatatgaccgcaaaactgcccttcaagcagttgacgagcgactttccccttacatcaagtgcacagtaagcccaagcgccggggccgcggggattcccgccagtcactcccgccactaccgccacccggccccgccgccagcgcagcccgcagccccggcaagcctgcgcccgctcggccccggtctctttcgctcaccagaggctacggggcgccc

SEQ ID NO: 91091 - DNA, 180 bp, Homo sapiens
  chr3:44727070-44727250
  hyper
gccccgcacacccaagaaacactgccaccgcgacgcgcctgcccccaggatcctctcgcgagcttcagtacccaaggaagatgggccgtcccggaagtgcggccggggcgacttgcaggcccctcgccgaccgctctaggaatctcggaggtcttttgacctcgacgcctccttacctgg

SEQ ID NO: 91092 - DNA, 30 bp, Homo sapiens
  chr3:44750897-44750927
  hypo
ctgcagattactgtgcgacagatataccgc

SEQ ID NO: 91093 - DNA, 38 bp, Homo sapiens
  chr3:44754084-44754122
  hyper
atcagagaatggatgcgcgagctcgctgctgacgcact

SEQ ID NO: 91094 - DNA, 71 bp, Homo sapiens
  chr3:44754341-44754412
  hyper
ccacgttgctgcctacgcgtgctgcccggacgtagggcactcctagcggctcggcccgcccagcctgcagc

SEQ ID NO: 91095 - DNA, 172 bp, Homo sapiens
  chr3:44770921-44771093
  hyper
ccctgtgctggaagacgcacgccaggtggggtcgcaggttgtttctggtgccggcttaaccggcgcagcaccgaaacccgtagctgcgtgcgggaaggaaccaccgagcggaagccgctcccaccttcctagagaggagacggtagtggttattagccgaggcgcggactgc

SEQ ID NO: 91096 - DNA, 102 bp, Homo sapiens
  chr3:44938757-44938859
  hypo
agtgctgggattacaggcgtgggccaccgcgcccggctttcaagtcagacctgagtctgaactccagccctgccacttatgggctgacgttaggtgtaaatg

SEQ ID NO: 91097 - DNA, 34 bp, Homo sapiens; identical to SEQ ID NO: 39907
  chr3:44999995-45000029
  hypo

SEQ ID NO: 91098 - DNA, 30 bp, Homo sapiens
  chr3:45153808-45153838
  hypo
actgcagctctaaaccgatgctcttatgag

SEQ ID NO: 91099 - DNA, 32 bp, Homo sapiens
  chr3:45187296-45187328
  hyper
tgctttcaagaatcccggcaaagaccctgggg

SEQ ID NO: 91100 - DNA, 96 bp, Homo sapiens
  chr3:45266369-45266465
  hyper
catttccctcctctccgtcttcggagctgcgatcccaccctcagtccaagggcttaaacatctgcttttcggaactggaagcgcagcacaaacctt

SEQ ID NO: 91101 - DNA, 30 bp, Homo sapiens; identical to SEQ ID NO: 39908
  chr3:45821641-45821671
  hypo

SEQ ID NO: 91102 - DNA, 751 bp, Homo sapiens
  chr3:45837489-45838240
  hyper
agaccgcgtcccctgcgctctcagagccgcagcctggccaacaagggtgagggttgggggcttggccgcccccgggatggggcgaggggttcccgagggcttgggagggcggcttgggagagagctccggctccggaacgaggtgtcctgggaacactcccgggtctgtaacttcggacaaatcacgctcgctttcccggcctcagtgtgccgttctgtaacttgggtctaaccccggctcgcacacacggcggggacgcgcacagagttgggctggggccggggcgcggtgggcactcacctccgccgtacatctggcacaggtacgggaatcgccacacgttgcccaggcccacggcgtacgagatgcaggcgaacacgaactgtagcgagttggcccacagcggccgcgctttctccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagaggacagggcggagtcccctggggtcctccggctcggcggggcctttcttcaggctgcggaactcctcgaag

SEQ ID NO: 91103 - DNA, 30 bp, Homo sapiens; identical to SEQ ID NO: 14530
  chr3:45885052-45885082
  hypo

SEQ ID NO: 91104 - DNA, 30 bp, Homo sapiens
  chr3:46009746-46009776
  hypo
ttgtccagtgagtcccgtgtggcctcaagc

SEQ ID NO: 91105 - DNA, 30 bp, Homo sapiens
  chr3:46245355-46245385
  hypo
ccaaaagtgacggtccgtgcccgcaaggca

SEQ ID NO: 91106 - DNA, 30 bp, Homo sapiens
  chr3:46464272-46464302
  hypo
ctgctcacttgcagccgctgacagagagag

SEQ ID NO: 91107 - DNA, 30 bp, Homo sapiens
  chr3:46480817-46480847
  hypo
tccaccttatccatccgagacaccacggca

SEQ ID NO: 91108 - DNA, 23 bp, Homo sapiens
  chr3:46584785-46584808
  hypo
ttccctttaccataccgggcaca

SEQ ID NO: 91109 - DNA, 38 bp, Homo sapiens
  chr3:46586155-46586193
  hypo
tcctttgctgcccttcggcacttcggcaagtaagtaat

SEQ ID NO: 91110 - DNA, 39 bp, Homo sapiens
  chr3:46592147-46592186
  hypo
tgggattacaggcgtgagccactgcgcccagcccctaca

SEQ ID NO: 91111 - DNA, 49 bp, Homo sapiens
  chr3:46607725-46607774
  hyper
agaggctgtttacaccgcagaggctgtttacacccgctgagcagcacgg

SEQ ID NO: 91112 - DNA, 58 bp, Homo sapiens
  chr3:46853945-46854003
  hyper
gccccagggagctgccgctctgggacgccatggatactgccggcgacctcagcctccg

SEQ ID NO: 91113 - DNA, 1399 bp, Homo sapiens
  chr3:46922878-46924277
  hyper
gtcgagggtcccaggcggcccggtccgagccggccgatagcttttgggagtgggggtgggaacgggggagggaggtgaagcctgagagtgggtgtctggattgagccccaggtctggcagcctcgagcctccggggttggggctgggcaagctggagaggcccggccagcagctgaatgggtcgagactcggagacccggacccgaagagacgctgggcagggagggagcgggatgtgtggctgcagacctgggcgggggtcggggctggcctagggccgagaggaacgacaggcctgggatgggactgagggcaggggacgaggcgagggtggggctggacgtgggggagggcggcagcagccaagccgggctcggggctggcagccgagcggcctccccagggaccccgacccggcccgaacgggagcccagtggactgacagcgtcgcggccgggggcgcgcgggggtaccgggcagcctcctcaggggattcgcccatgatgaaagagggctcgcttctcggctcagggtctctattcgccagcgggggccggatgatcaagggaaaaaaaatttaaaagcccgtgctttccagaagagaatgaagcggcggcggcgtcccgggttccctgctcgggtctcgatgttacagctgcccccgccccgtctccccagcactcacatcccgccgccgtaagactccgggcctcggcctctagcgcaatgtcccggggcggggggcggaaggctcctctcggcctctccacactcccgcgtcggcggctgcggagggggtgggggcgggagaggcccgggagggcgcgggggagggaagaggcgcccggccggggagaaggggagcggcagacgccgaggcgagggatgcgcgcggcgggcggtggctccgagcggcggccgggcggggggcgctggaggccaggccggccagcggggggtatcccgagagctccatgaagtccccccggggccgcggacggggcgctggcttggggaggctgtcgggggggccccgacatccatggcaaggcgggggccgcggcggcgcgctcggagtaagtcggggctggggacccgcgccgaggggaagtggccggagtcggggaggagcgactccgggcctggccggagcagccaggctgctctgtctcggtgtcagtcggcggcgcctcctcggaacccgggggagtcgccagccccgcgccgctcggctcggtggcttttttggaaacttgcaaatgttttcgtagagagaaaagggggagggagggagcgagggagtgaccgaaacggagcttggggccgctggaagaactgaggccaaggccgggggagctagagacggactgacagacaggcagaccgacagagcgtcggg

SEQ ID NO: 91114 - DNA, 250 bp, Homo sapiens
  chr3:46924989-46925239
  hyper
taccaccaccagggccggcggcggcggctgccccgagggacgcggccctaggcggtggcgatggggaccgcccggatcgcacccggcctggcgctcctgctctgctgccccgtgctcagctccgcgtacgcgctggtgagtcccccgccgccaacactccgggacaggctgcgggcttaccctagggtccgcgggataggtctaaggcacgcagtcttgagttcccccagtagttcgaactttgggtgag

SEQ ID NO: 91115 - DNA, 40 bp, Homo sapiens
  chr3:46934058-46934098
  hyper
agccctcgctgctgccgccaagagacgcggtcaattaact

SEQ ID NO: 91116 - DNA, 230 bp, Homo sapiens
  chr3:46948863-46949093
  hypo
ttcttcttgctccagcgtttttaacaggcagggcaggagcagccttggcatggcccggacactggcgcttgcccggaggccacagtcagacaacctgtccacaacaaactcatatccatacatcagcaagacagtggggcgtgttgggtgtcattctccatgtgcgagcgtttgtatgcgcgtgctgcttgtgtatttctttgtgtttgtgtacacgagtgtccatgtgc

SEQ ID NO: 91117 - DNA, 30 bp, Homo sapiens
  chr3:4697393-4697423
  hypo
tttcgtgctttttggcgtcagagaggcgga

SEQ ID NO: 91118 - DNA, 30 bp, Homo sapiens
  chr3:46985725-46985755
  hypo
agtctggatccaggtcgtcctgatgcctgg

SEQ ID NO: 91119 - DNA, 22 bp, Homo sapiens
  chr3:47018686-47018708
  hypo
gggcgcggtggctcacgcctgt

SEQ ID NO: 91120 - DNA, 20 bp, Homo sapiens
  chr3:47020175-47020195
  hypo
tctgtaaaacagagccggcc

SEQ ID NO: 91121 - DNA, 20 bp, Homo sapiens
  chr3:47521018-47521038
  hypo
gggcgcggtggctcacgcct

SEQ ID NO: 91122 - DNA, 22 bp, Homo sapiens
  chr3:47555871-47555893
  hypo
gccgacacggaattatatcttg

SEQ ID NO: 91123 - DNA, 30 bp, Homo sapiens; identical to SEQ ID NO: 39852
  chr3:4755974-4756004
  hypo

SEQ ID NO: 91124 - DNA, 41 bp, Homo sapiens
  chr3:47588423-47588464
  hypo
aagaggtacattggccgggcgcggtgactcacacctgtaat

SEQ ID NO: 91125 - DNA, 38 bp, Homo sapiens
  chr3:47843707-47843745
  hypo
ttacaggcgtgagccaccacgcccggcctaaaggccac

SEQ ID NO: 91126 - DNA, 37 bp, Homo sapiens
  chr3:47845756-47845793
  hypo
tattagggccgggagcggtgtctcacgcctgtaatcc

SEQ ID NO: 91127 - DNA, 125 bp, Homo sapiens
  chr3:4799808-4799933
  hypo
aggtaagtgagcagccgtggtgagtgtcatgggctagatgggtcagggccatgtcttatgaggcagtgaggtggaaaatcccattctctggattctctcaaggcccagagcgagggcttctgaaa

SEQ ID NO: 91128 - DNA, 40 bp, Homo sapiens
  chr3:48227765-48227805
  hypo
aataatgtttatcaccgggcgcggtggctcacgctgtaat

SEQ ID NO: 91129 - DNA, 77 bp, Homo sapiens
  chr3:48236476-48236553
  hypo
gtggcagcctcttgacgactcttggtctcagttgtacccctctagaaaatgggagtaatggccgggcgcggtggctc

SEQ ID NO: 91130 - DNA, 459 bp, Homo sapiens; identical to SEQ ID NO: 39915
  chr3:48636676-48637135
  hypo

SEQ ID NO: 91131 - DNA, 118 bp, Homo sapiens
  chr3:48689342-48689460
  hypo
ggtcccggcagtctgcgtgaggtgggcagggcccagaggcacaggcgttggtcacaacacagccaggctccgcattcactcggtggctggggggtagcagggccggggagccagaggg

SEQ ID NO: 91132 - DNA, 439 bp, Homo sapiens
  chr3:48693262-48693701
  hyper
gctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcag

SEQ ID NO: 91133 - DNA, 31 bp, Homo sapiens; identical to SEQ ID NO: 297
  chr3:48693851-48693882
  hyper

SEQ ID NO: 91134 - DNA, 272 bp, Homo sapiens; identical to SEQ ID NO: 298
  chr3:48693883-48694155
  hyper

SEQ ID NO: 91135 - DNA, 9 bp, Homo sapiens
  chr3:48694226-48694235
  hyper
cggtctcgc

SEQ ID NO: 91136 - DNA, 210 bp, Homo sapiens
  chr3:48698801-48699011
  hyper
tgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtc

SEQ ID NO: 91137 - DNA, 1307 bp, Homo sapiens
  chr3:48699376-48700683
  hyper
ggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgccatctttattgaggacgtgagcgttgctcctggtgctgaacagagcgcgaaggttcgccgtcgttgggtccgccctccccactttcggtcgccgccttcacccacctccctccttctagggcgctgtcccagctccgtctcccagcctttttctgtccttccagatctcttgttcccccttcctgaccactagttctgaaccgtgtcccggattttggtctgaaattttggtgcccatgagcgttctcatagctct

SEQ ID NO: 91138 - DNA, 46 bp, Homo sapiens
  chr3:48701213-48701259
  hyper
gaggcgaggggtgaacgcggagcactccaatcggtcagtcattgtt

SEQ ID NO: 91139 - DNA, 105 bp, Homo sapiens
  chr3:48701471-48701576
  hyper
acgctccacagggtgcggctcccgcgatggggtggatcctggttctaacaggcgaggaactcctggccaaggcctctggcccgccccgaacggtccctatgacat

SEQ ID NO: 91140 - DNA, 18 bp, Homo sapiens
  chr3:48884018-48884036
  hypo
aagcgatatttcctcctc

SEQ ID NO: 91141 - DNA, 99 bp, Homo sapiens
  chr3:48948428-48948527
  hypo
gaagtcatcagtatacgggaggtcctaaggcaaagaggttgaatgagatcactggggaaggagcgtagatggaagagaggctgaggattgagtctacca

SEQ ID NO: 91142 - DNA, 111 bp, Homo sapiens
  chr3:49034204-49034315
  hypo
ataattaagtctgtccggggttcgacaaacagcatcttgtccaaggtgagcatagcccaaggctatgtgcctgcccggagactcagcttggggttccgaggcatgtgggca

SEQ ID NO: 91143 - DNA, 26 bp, Homo sapiens
  chr3:49056918-49056944
  hypo
tttttttttttgagacggagtttcgc

SEQ ID NO: 91144 - DNA, 146 bp, Homo sapiens
  chr3:49057184-49057330
  hypo
ggcgtgagccaccgcgcccggctcagaatgaccagcttttaatgtgactcctttaacctggtgtgctttaacaacgatccttaaagcttcctgttttaggcaacagccatttacgggccaaccaaataatgcgaccataatagaaa

SEQ ID NO: 91145 - DNA, 262 bp, Homo sapiens; identical to SEQ ID NO: 28034
  chr3:4910288-4910550
  hyper

SEQ ID NO: 91146 - DNA, 30 bp, Homo sapiens; identical to SEQ ID NO: 39921
  chr3:49140985-49141015
  hypo

SEQ ID NO: 91147 - DNA, 31 bp, Homo sapiens
  chr3:49189534-49189565
  hypo
gttaagccaagaggccgggcacagtggcgca

SEQ ID NO: 91148 - DNA, 30 bp, Homo sapiens
  chr3:49540372-49540402
  hypo
actttctgagatttacgcatgttgatactt

SEQ ID NO: 91149 - DNA, 73 bp, Homo sapiens
  chr3:49592444-49592517
  hyper
ggcgtggcaggatgacgagcgcagggtcagtcggggcctgcagaccgtgactccgtcacgaaccccaaattcg

SEQ ID NO: 91150 - DNA, 54 bp, Homo sapiens
  chr3:49722997-49723051
  hypo
gggtcatgggggaagcgtcactagtgctcaccgcagcgtcgcagggcacagtag

SEQ ID NO: 91151 - DNA, 58 bp, Homo sapiens
  chr3:49755535-49755593
  hypo
ctacgtgcttgtggacgctggccttgcggctgggtgcgtctggcggtgtggtgctgag

SEQ ID NO: 91152 - DNA, 45 bp, Homo sapiens
  chr3:49756360-49756405
  hyper
gaccgtgcaggtggtcgaaggagaacgaggcgagttcgttgcagc

SEQ ID NO: 91153 - DNA, 216 bp, Homo sapiens
  chr3:49851237-49851453
  hyper
aacagtaggctgcagcgctcagagatagggtctttgtgtaggtggcggtgacagtaggggccagtgccctgctgtagccagtgcaaacaggaaccaaggccaagcgaataagggacgctgctggtcacagctctcttcctggagaaaagaaaagtgaaagttaaactatgctctgagctggctcctgatcctgcctccagacgccagccccagaca

SEQ ID NO: 91154 - DNA, 409 bp, Homo sapiens
  chr3:49906970-49907379
  hyper
ccagaacccccaagccgtccgaggtaatggggaactttagcccgaccccgcactccctcccccaaatctgcaaagcccgcgcgctctgaccccgccaggacctcgagccctcgctgcgcccccgcgcactctgcatcccgcacctcgagccagggaaacaatcccccaaggccccacaacctgcgttcgggaagcgcccccagcccggcccgccccgcacctgcagcgccggttggtcacagggaggaagtgatcgcgggctcagcggggcgccgagggctccggggacggcgggcagaatccgctccgagcacgcggggcagacgcggcgccagatgcagccgcttcggctagcgaacctccagcatcgccagccgcttgccggcaccggattcgcaccccgggccgg

SEQ ID NO: 91155 - DNA, 33 bp, Homo sapiens
  chr3:49920459-49920492
  hypo
tctccagatcccaaacgccgagtgcaagactgg

SEQ ID NO: 91156 - DNA, 30 bp, Homo sapiens
  chr3:4992934-4992964
  hypo
gtggggcaaaaagcccgagaaaaaactgtt

SEQ ID NO: 91157 - DNA, 907 bp, Homo sapiens
  chr3:49939687-49940594
  hypo
gagaatgcttctttccgcctgcccccccaccgcgcccccagatcccctcagtgatggaagggaagcagcctgtgttcagccatgtgcatgcagctcacaagtaagggccccttctttcagcttaccgggttggggcaaaaactgggcgactggaagaagtcgaggcctcgccggaggcctggatggactggggattcacaacagcgctccacaccctcatcaattagtgtgtccagcaggtcaatggggaaggcacagacgacagagttggggcccacgccaggaccaccatccttgccagtcacaaagaccccaaatagtacttcctggccctcggcgatgctcagctcagtggcaagttgggcacccactggagcggagtgggccacccgcagcacagggtagggctgtccgccttctggggccccccggcgcctgcgttttggagcaaatctgcagtcgaggaccagctcccgatagtcacccaactctggctcagtggcgctaagccgtgccaggcgtgtgtgcagggcactaggatcatctgtcacgctggccggctgtacagtcaggaagtatacgaaggctcccgtgtggaagctgtgcacgtattcaatactgtaggagacaagatgcttgggcagcactgacaacgccacaaagcccggtgcgaatcccgaggcgtcagccttgagacgcctgatagacactgagcgtgggctgaagctggcagccacggctgcgtccagtgaggatgccacgtagaaataggaggcctggccttgctcaaccacagttacacgggtgcccaatgggctggccacacagtcggggcagtcatcgggccggttatggtgggctgagaagaggcaggctggcgctgccagatgcacggctgtcccttggg

SEQ ID NO: 91158 - DNA, 146 bp, Homo sapiens
  chr3:49941293-49941439
  hyper
gccgctgtacactggcgcttagcgctcagccgacccgagggcgccgggctgggcgggcggagtcgggccgtgggggcggggccgcgaggaaggcttggcctagcccaggccctccgcccatccgactcttccggcccttggaggcc

SEQ ID NO: 91159 - DNA, 147 bp, Homo sapiens
  chr3:5018985-5019132
  hyper
aatataaacaggaagcgggagctctccaaggcgacctgaaggaaatacactgccagtttggtcaacttgtgaatgccagttctctaggtcgtcaagggcactgccagttaagactgatcccctaactgcacccgaggctactactct

SEQ ID NO: 91160 - DNA, 94 bp, Homo sapiens
  chr3:50232113-50232207
  hyper
ggcgcccccgccccacgatcgcggcgcgcaccccccgcacggggaaggaagggctgagcagagtgagagctcccgcccccgcaggacccaacac

SEQ ID NO: 91161 - DNA, 848 bp, Homo sapiens
  chr3:50242714-50243562
  hyper
cagccgggagcagagcgaaccgcaccggcccgagcggagcgccgcacgttcccaaccgcgaggccaggtaccgcttcgggagttcatcccacccgcacaggggaatcgggtgggccgagccctactgtccaccctcctgtccgtagccgggctctgggcagctctcctctaccgtcctgacccgggcaggcgccccagcctccggcgagccaaagccccgcgcgctccaggcgctggtcttggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaaccaagacttggtttgcaagagcccgcccccgcccggttggcccc

SEQ ID NO: 91162 - DNA, 124 bp, Homo sapiens
  chr3:50375443-50375567
  hyper
tgcagagaggcctggcggtgaggcggaggagctccaggtcggggaaatgtcccggagattgaagggaagccccagggagagggccgctgctcgccaggctccgcaggcccgacctatctcagtg

SEQ ID NO: 91163 - DNA, 30 bp, Homo sapiens; identical to SEQ ID NO: 14538
  chr3:50395506-50395536
  hypo

SEQ ID NO: 91164 - DNA, 923 bp, Homo sapiens
  chr3:50402120-50403043
  hyper
gaggacttgaggctgcggccggggcggcaggcccaggaggagcagcagttgcagggagaccaggacgcccagcgacggcgggaaggaggccccgcggccacagtctgaggtatcttcctgcggggagagacaaggagctggtcggcctgggcgggcgcaaggccgcgggatttcgggtccaccgccccctctcctcactgtcgcgttgtagtcgaagcagatgtgcgggcctctccggtatcgcggtctctgcactagctcacactgctccgggccgtccgctgggcatgggtggggagtcaaggaggcggacggcggcggcggcacggagggggcgcgcggggcagagggggagcgggcggcggggagggcgggggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagtttgccccgccctgacccacccccatcctgcggccccgcccccggccgctcggaggccccgccccttccatcctcccgagcgtctcgccccgctcacaggttccgcccttggcctctggtcccgccccactgccagcacctggagcagtttccgcagtcgatgatggcgttgtaggaggcgtttaccgagccgaagtagtactgggtctgtttcatgacgcagctgctctcgcgcgtctcggggctcccctcggcctccgcggggtctgcgagggcccagagcgcctcagctccgcccacagaccctggcaaggtctccggcctccctcagtcgtagaccccaccctccccatggagtcgtcttagctcagattggggacccggacttgaggaggc

SEQ ID NO: 91165 - DNA, 75 bp, Homo sapiens
  chr3:50416271-50416346
  hypo
ggccagttgaacatacgcaatcgacaaaaagaaatggcaggcaggcccctgacagtgatgcgcaggggaggtacc

SEQ ID NO: 91166 - DNA, 385 bp, Homo sapiens
  chr3:50425370-50425755
  hypo
agggagtgaggaagacggagaacagagccgagtttgggcaggagggaaataatgactcgacgccgcatcttccaatttcttctattaaaaagcctgctcattacgggcatgtacttattaattatctgtgatttgttgtgaaatgcgagggggtttccacaacaggagtgggagaaaacaaagcccagccctggcgcctgcctcccagccctcacccgcctgcgtctgccccgcctgtccctggcccatgtctgcttgccagtcgcctgggttcttggccatctgtgcgtcataatcaccggccgccccggggacccgtaacacaaacgggctaatttcatgtgtaatgatctttaatcagaaccgagcgcggctgacagaggcc

SEQ ID NO: 91167 - DNA, 111 bp, Homo sapiens
  chr3:50426562-50426673
  hypo
agaaggctgcagccccggtgggcctggggcgggggcggaggccgggcccaagctgcagggtgctcggcctttccctgcgcccggctccgaccgaagcgcataatgaaagct

SEQ ID NO: 91168 - DNA, 192 bp, Homo sapiens; identical to SEQ ID NO: 39928
  chr3:50433950-50434142
  hypo

SEQ ID NO: 91169 - DNA, 30 bp, Homo sapiens
  chr3:50472586-50472616
  hypo
agggctcaacatatccgtttgtgtgcacgt

SEQ ID NO: 91170 - DNA, 398 bp, Homo sapiens
  chr3:50540230-50540628
  hyper
ccaccagggagggaacgtggggcagatgcgcggctccaactccgccggacaggggtcgctggccgcccctctcacccaacccgggtttccctctcaccgggtcagcggcaggggaatcagctgacaagctcggaccgcccccccccaactcctcccggggcttgaagatcttgccttgcctcattcgggggatttgggggaagcaggggcaccgcggggaagtttcgcgacgcagccagagcgccgggaccgcggctgccagccttcggggcttggggccgtcgcccccgggcgcagcgggcagccggacccagcgcctctgccctggcgcggagcgcagggaaggagtagcgcggaccgggggcagagcggggcgcaaggctcggccggggtctcgc

SEQ ID NO: 91171 - DNA, 56 bp, Homo sapiens
  chr3:50567928-50567984
  hyper
ccgcgcatgtgcacccgtccaggtggccctgccctactctgcggcgccggcacggc

SEQ ID NO: 91172 - DNA, 33 bp, Homo sapiens
  chr3:50575602-50575635
  hypo
ggggctcaagcaatacgactccagccagacgtg

SEQ ID NO: 91173 - DNA, 451 bp, Homo sapiens
  chr3:50604981-50605432
  hyper
cggcgtctggggctgcgggtccgacccgagatccgccctccctgcaagccccgagccgctggccaggcccgctactgcgcaccagccgcatccgcgagcgctggctctgccggcctgagctagggtgggtagggccgggacccacggcggaggtggggccgggccgagcagcctcgggggatccccgaagctacagcgccttgcctccctgcacgctccgcgcccccggcctccgattggctgtcgggcctagagcccgcccagaattggaccgttcgcttgtcgctcgggtctggctccacccccagagggagcctagaacctggtcgcagtttttagagactaccctcaccccgtggcctgcgccgaagttgggcggaggacagtgggtggccaggcccttccgggccagaactcgggacccctgccagctacccgtgccaggacagac

SEQ ID NO: 91174 - DNA, 291 bp, Homo sapiens
  chr3:50712086-50712377
  hyper
cactggaagcggaagcgagtggggagtccgggtagagggagtcgcccacctgaccggcttcgccccctccggggtttgctgcagctgagggccccggaccagcgattctagaagccggtccggggccgggcagtccaatagcttctcgcggatttccctccgctggcgcgcagcagcggcgcgtggattcgcgcgcgggctcgggacggcgcgagcccgggcagcgcgagcccctgcgcggcagggagtggcgcatgcgcgggcgtcctgcgagcccgctggggcgagccg

SEQ ID NO: 91175 - DNA, 25 bp, Homo sapiens
  chr3:50953960-50953985
  hypo
tgtcttggccaggcacggtggctca

SEQ ID NO: 91176 - DNA, 240 bp, Homo sapiens
  chr3:5137779-5138019
  hyper
cccgcgtcctcctgccggcagaagcccctgcagtgcgccccgcgaccaccagctggaaccaaaaggcggcgcgcaggcgcggagcccacggggagcccaggctggggcgcgtgtcagctccgcctgacctgccaccttccctaggcagcggggggcgggggtggggggtggtgcggggagtcacatgcgtcccctccgaagctgggctggagttcatttacagctcgcttttctaggcct

SEQ ID NO: 91177 - DNA, 199 bp, Homo sapiens
  chr3:51989989-51990188
  hyper
gcacttggcctggcacgctaccgcctcatcgtgcacccgctgcggccaggctcgcggccgccgcctgtgctcgtgctcaccgccgtgtgggccgcggcgggactgctgggcgcgctctccctgctcggcacgccgcccgcaccgccccctgctcctgctcgctgctcggtcctggctgggggcctcgggcccttccggc

SEQ ID NO: 91178 - DNA, 141 bp, Homo sapiens
  chr3:51990359-51990500
  hyper
ggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctggg

SEQ ID NO: 91179 - DNA, 30 bp, Homo sapiens
  chr3:52009663-52009693
  hyper
ggttgtgtgtatgaccgtgcttgagtattt

SEQ ID NO: 91180 - DNA, 30 bp, Homo sapiens
  chr3:52117389-52117419
  hypo
caccccgtggagtgacgtacagtccctcat

SEQ ID NO: 91181 - DNA, 28 bp, Homo sapiens
  chr3:52352343-52352371
  hypo
gagccactgcgcccggcctggaggtgca

SEQ ID NO: 91182 - DNA, 149 bp, Homo sapiens
  chr3:52415830-52415979
  hypo
tcacaaggctcgcctcgcacatgtgagcgcctccagggcgtgctgggcagtgggcggccagggctggctggtcggtttgactgacccatgcttttgcacagtggtagaggcctcgggcaaccctgaagtaggcccgtgcagcctacagg

SEQ ID NO: 91183 - DNA, 30 bp, Homo sapiens; identical to SEQ ID NO: 39932
  chr3:52429714-52429744
  hypo

SEQ ID NO: 91184 - DNA, 30 bp, Homo sapiens; identical to SEQ ID NO: 39933
  chr3:52537738-52537768
  hypo

SEQ ID NO: 91185 - DNA, 30 bp, Homo sapiens
  chr3:52539389-52539419
  hypo
tcctggaggtaagctcgggggaggggtcct

SEQ ID NO: 91186 - DNA, 52 bp, Homo sapiens
  chr3:52548283-52548335
  hypo
cctccaatcccaccacgaagggacacagtgggtgtggcgtgctgtccagggc

SEQ ID NO: 91187 - DNA, 84 bp, Homo sapiens; identical to SEQ ID NO: 14542
  chr3:52552577-52552661
  hypo

SEQ ID NO: 91188 - DNA, 240 bp, Homo sapiens; identical to SEQ ID NO: 14543
  chr3:52553207-52553447
  hypo

SEQ ID NO: 91189 - DNA, 70 bp, Homo sapiens
  chr3:52558829-52558899
  hypo
cacctcagctcctgccgctctttcatccaggcagccagcacctgcctcgactccgcgtcctgataggtct

SEQ ID NO: 91190 - DNA, 38 bp, Homo sapiens
  chr3:52568630-52568668
  hypo
aattcctctttcctgcgcagaaccgctctccactcgca

SEQ ID NO: 91191 - DNA, 37 bp, Homo sapiens
  chr3:52569926-52569963
  hypo
tcagaacaaggcctccgttttacggcttagggaattg

SEQ ID NO: 91192 - DNA, 30 bp, Homo sapiens; identical to SEQ ID NO: 39936
  chr3:52599737-52599767
  hypo

SEQ ID NO: 91193 - DNA, 30 bp, Homo sapiens
  chr3:52900469-52900499
  hypo
ttttccccatgctcacgccctcccctgagg

SEQ ID NO: 91194 - DNA, 135 bp, Homo sapiens; identical to SEQ ID NO: 39937
  chr3:52900714-52900849
  hypo

SEQ ID NO: 91195 - DNA, 31 bp, Homo sapiens; identical to SEQ ID NO: 39938
  chr3:53032137-53032168
  hypo

SEQ ID NO: 91196 - DNA, 837 bp, Homo sapiens; identical to SEQ ID NO: 39939
  chr3:53032798-53033635
  hypo

SEQ ID NO: 91197 - DNA, 30 bp, Homo sapiens; identical to SEQ ID NO: 39940
  chr3:53217535-53217565
  hypo

SEQ ID NO: 91198 - DNA, 120 bp, Homo sapiens
  chr3:53879666-53879786
  hyper
gttaaatgcagatcccgggcctgacccggacctgccgtctggatctcattttaggcggcgctagagatcccgggccagggaaacttgagaaccgcagctccaaatcgccagtgctgacgg

SEQ ID NO: 91199 - DNA, 30 bp, Homo sapiens
  chr3:53880694-53880724
  hyper
tcttccctcatctcccggccctcgagccca

SEQ ID NO: 91200 - DNA, 53 bp, Homo sapiens
  chr3:54121997-54122050
  hyper
agatgcgtgggggagcgggcacgggccaggccgccgcccgcctgagctcgccc

SEQ ID NO: 91201 - DNA, 267 bp, Homo sapiens
  chr3:54154739-54155006
  hyper
aggccgcgcttggctcggtttggaaagggctggcacgcttcctcaggcggagggtatgcacagaagcggagaattcattataaccggttagtcatccgtagaggctgtagacactgcccgcgggcggggcgcacctggcgctcctggagaggggcctgttccttgcgttgccccccaaggtgggagcgcgacctgccagagcccaggggagctcgggtctgcccgcactcgggaaaagcactaagagcctctcggtagcagtccttc

SEQ ID NO: 91202 - DNA, 269 bp, Homo sapiens; identical to SEQ ID NO: 6870
  chr3:54155224-54155493
  hyper

SEQ ID NO: 91203 - DNA, 631 bp, Homo sapiens
  chr3:54155524-54156155
  hyper
cgagaaggcgcctcctccggcgctcactgcctcctgcccagtgcggtgggcgccggagtggggagcaggcaatcccccaggctcggagaaatcttttatcccgaaatccagggtgtcccccggtcaggatcgactcggcgccgcgttggcttcctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcgcgccccctttaggttccgcggcccccgaccccgcccggcccaggggcggagcgggcatgctacgccctctcctagca

SEQ ID NO: 91204 - DNA, 273 bp, Homo sapiens; identical to SEQ ID NO: 28189
  chr3:54156356-54156629
  hyper

SEQ ID NO: 91205 - DNA, 420 bp, Homo sapiens; identical to SEQ ID NO: 28190
  chr3:54156654-54157074
  hyper

SEQ ID NO: 91206 - DNA, 606 bp, Homo sapiens
  chr3:54157313-54157919
  hyper
gcgcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagatgacacttgattctaaccacaaagaaaagcaggatactcactcgcactgtcctggctggggctcggaaactgagtgtttttgcatggctctcgtctccgtgtcggtattgctgtttc

SEQ ID NO: 91207 - DNA, 30 bp, Homo sapiens
  chr3:5442940-5442970
  hypo
atgagagctatgtggcgatgtggcactctt

SEQ ID NO: 91208 - DNA, 195 bp, Homo sapiens
  chr3:5496299-5496494
  hypo
tgcaatttccattgacggtggctgctctatatttatgtctcatcctccatctgtgaatgccgaatataatacttgaggtaatcattgaagtcagatttgcctacaaaagctgccacctgaataccattttagagtacagccatcccgtggtatatttggggaattggttctaggaccccacgttaaccacatcga

SEQ ID NO: 91209 - DNA, 67 bp, Homo sapiens
  chr3:55519074-55519141
  hyper
ttgctgggctggacccgtggccccttccgtattgcagcggccggcggcgcagcgaaactggtcctct

SEQ ID NO: 91210 - DNA, 107 bp, Homo sapiens
  chr3:55519516-55519623
  hyper
acacacaaacacacacgcacacacacgcagccaaggatccacacactcggacacacacacatttgtcggcccgcggttcgctgcgcactctccgcattgccccctcg

SEQ ID NO: 91211 - DNA, 1065 bp, Homo sapiens
  chr3:55520325-55521390
  hyper
gagctcacccagtggcggctaataatgctaataacgcgaccccgctccccgcgccggggtgcgcgctggccccccgccaggcactcttaaaggcaaaggggcctgaagcgctcgagttactcggccaaggcaagcctacaatctggcctccgtcggtgcgggggggtgtcggggaaggtgtacgccgctctggagtagttggcccctagttcctctgcgggttctctcaaccaaggagtccctttccccatcccgagccccggccacacaccgtcccggtgcccgcgcagtgggcgcttggtaaatatttgttgaattgaatcattatcctgttactgaaatatacatagtaaattacactcgatgttctcagagcaaaaggaaagtcgtcagtgaaccgcactcagtttgtctactatcgctcttccccactttttctcaaaaatcaaaattgtttgcagaacgggtggtgcgaccagaagtgatctcctgggacactgaggcagtgcgcccggcgtggagggcgaaggggtaggggttcctgccagcgacgctggagttccagcttcttcaggcggttggggaaatggagggataggaagaggcgaagggaactcagttaacttccaacagggggtggggggaagtaaagaaaaaaagtggcagcgcactgaacacctaccttcatggcgagggggagggggcgcggggaggaagtcgccacccgagcgagcgcagccgaggaatccgagcggagcgaccgggttaagcctggggggacggtcaggagcagggctgcggagtcctccggcgcgcgtccggcgggcgcagtgaaccggagctgaagcgggcactggcgcccgggcctggactcccgagttggggcagagctgggatgcgcccaggaatggagggggcgcggacgcgcgcgagccggcagcaagggcagggcctggtcggggcgcaactagggagccgccggtccggcgagggcgcgcaggcaactgttccacggagaggcgctccgtttccaacgtccatcagcgacggcggtaattagggctt

SEQ ID NO: 91212 - DNA, 621 bp, Homo sapiens
  chr3:55521736-55522357
  hyper
cacagaacaatcaggcgcgcatggctttttctccgggagatgccgctgaaaacgcacaagtcgccatctgagctgcaagagtcagccccaaattgtgtcctttcattttagggttcggcaaaaacggggagcaaaataggtgaaagtcgccccggaacttattgctgtgcggtgagctggaggggtgcgactaacccaggggagacgcgggctccccccccccaccacgtatcccgttctttctctcttcgggttgatctctcttttccccgtttttccagggcgaagggcgaagagcagcgagtgcaccgcgggcgcgaggctggggaagggcgagagctcggagctccgcggcggcgactcagctccggcggtccatggccggcgaagctgcccacctcctcgtttggcgcccgggtccgaggggcgggagagcgggccggcgggaggcgggcggtcccgggcacaacggcggcggcggaagggctcgctgggcagctgccgcacggaccccggctctgggcggcggaggcggctccgtggagctcgcagcagatttccacgcgatcctgtgccccgcaaacagactgaccgaccgcggggacgcgtccccccctccca

SEQ ID NO: 91213 - DNA, 695 bp, Homo sapiens; identical to SEQ ID NO: 28195
  chr3:55522595-55523290
  hyper

SEQ ID NO: 91214 - DNA, 28 bp, Homo sapiens
  chr3:55573369-55573397
  hypo
ggagattttctaagacgtattttctttt

SEQ ID NO: 91215 - DNA, 30 bp, Homo sapiens
  chr3:55577421-55577451
  hypo
aaaggaaggctcccacgtgggggatgttct

SEQ ID NO: 91216 - DNA, 203 bp, Homo sapiens
  chr3:56500452-56500655
  hypo
catgattcatccacccgtgaaagtcttgctggtgaaaaccatgacaccatcaccttccacacccctccctgccaaaactgtaaaagtattttattaaagcacagaagcaaacagacaagatggcttacatgagaaaaaggcaaactctactactccccggaaagaaaatggcttgaccccaccaccaccgaactgacattctg

SEQ ID NO: 91217 - DNA, 1061 bp, Homo sapiens
  chr3:56501705-56502766
  hyper
tcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagcaggagcgggaggcggaggaagaggaggagaagcggggcggggaacagggagggaggaaagaagggaaggaggaggacactgctcggagggccagggccaggcgcggggccgggcggggccggcggccgagggggcggcacccgccgcagtcccgagacgcgcgctcgcgcggcgctgccaggcgctgcgctcggcggggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccg

SEQ ID NO: 91218 - DNA, 28 bp, Homo sapiens
  chr3:56502800-56502828
  hyper
cgacgccccttcccgggtacccccctcc

SEQ ID NO: 91219 - DNA, 38 bp, Homo sapiens; identical to SEQ ID NO: 39941
  chr3:56718243-56718281
  hypo

SEQ ID NO: 91220 - DNA, 35 bp, Homo sapiens
  chr3:57040464-57040499
  hypo
ttaggcggagctccccgctccgatctccactgtcc

SEQ ID NO: 91221 - DNA, 32 bp, Homo sapiens
  chr3:57198549-57198581
  hyper
aaggaggatatcagccgcgagaccttcacaag

SEQ ID NO: 91222 - DNA, 54 bp, Homo sapiens
  chr3:57204154-57204208
  hyper
cccagagacccagggcggcggacaacagaaaacctggggcggcggacccaaccc

SEQ ID NO: 91223 - DNA, 28 bp, Homo sapiens
  chr3:57740997-57741025
  hypo
gagccaccgcgcccggcctaattgctac

SEQ ID NO: 91224 - DNA, 205 bp, Homo sapiens
  chr3:57882410-57882615
  hypo
tggggaaaaaaaaaacgcttccatttatcaagtcatcccctttgaatgctggatattttgttaaaactactttcaactacccgaatataatagctgtatcaattccaattgtttgttttgataacaatagcttgctgatagatctgaatactgtctgtaattatatatgtatttttttcctctctgtagacgcccaaatggatga

SEQ ID NO: 91225 - DNA, 35 bp, Homo sapiens
  chr3:57978698-57978733
  hypo
gacttgtaggctgggcgcggtggctcatgcctgta

SEQ ID NO: 91226 - DNA, 91 bp, Homo sapiens
  chr3:5831049-5831140
  hypo
gttcttaaagaaaacagaagatgaaagggaaacaaggccaagtaacatctctgcagagttcctctgctgtctcattcgctgggcaggctca

SEQ ID NO: 91227 - DNA, 187 bp, Homo sapiens; identical to SEQ ID NO: 39943
  chr3:58456517-58456704
  hypo

SEQ ID NO: 91228 - DNA, 140 bp, Homo sapiens
  chr3:58571263-58571403
  hyper
cgcggggacaggcaccgccgctgcagacgcggcagctggtttgcctcgcgcttttggctccagcggtcggcaggcaggcctacgggtggggcgagctccttgcccaaggcagagggtagctggcccgtgagcccaagtcc

SEQ ID NO: 91229 - DNA, 30 bp, Homo sapiens
  chr3:59034636-59034666
  hypo
caaagtgactgaggacgacccagaagcagt

SEQ ID NO: 91230 - DNA, 182 bp, Homo sapiens
  chr3:59223755-59223937
  hypo
tattcaagcccatagcggtgaaatccttccttgcacagtggaccagtgtatcctggcccaattgcctgctcgggaggacagtaaacctaacagaatcagaggacagataattgaggacaatttaatcctgcctcccagggtaggtagggcaaagaaagcccagaaagcggtgaaaatggcag

SEQ ID NO: 91231 - DNA, 30 bp, Homo sapiens
  chr3:59690756-59690786
  hypo
ctagaatgaaggtgtcggcagggctatatt

SEQ ID NO: 91232 - DNA, 30 bp, Homo sapiens; identical to SEQ ID NO: 39854
  chr3:5970953-5970983
  hypo

SEQ ID NO: 91233 - DNA, 30 bp, Homo sapiens
  chr3:61341365-61341395
  hypo
acaaagagtgagtgtcgttaacagacccca

SEQ ID NO: 91234 - DNA, 30 bp, Homo sapiens
  chr3:61546138-61546168
  hyper
gcaaaaaatgtcaaacggctaattaccttg

SEQ ID NO: 91235 - DNA, 60 bp, Homo sapiens
  chr3:61548153-61548213
  hyper
gggtggagggtggcccggcgcccggataggagaaaaggattgctccgctggcttggatga

SEQ ID NO: 91236 - DNA, 91 bp, Homo sapiens; identical to SEQ ID NO: 28200
  chr3:61548917-61549008
  hyper

SEQ ID NO: 91237 - DNA, 42 bp, Homo sapiens
  chr3:61550498-61550540
  hyper
ctctggggctgcagacgcgccttggcgcgaggcggcggcctc

SEQ ID NO: 91238 - DNA, 92 bp, Homo sapiens
  chr3:62305001-62305093
  hyper
ccgggattcccttggcgctgcattaattggcctcgttgcaaaaggaaaccgagaggaaggcggcaagacttggcctgcgggtgatgttagcg

SEQ ID NO: 91239 - DNA, 32 bp, Homo sapiens
  chr3:62351431-62351463
  hyper
ttgagtgatcctggtcgcgtagatgggcccga

SEQ ID NO: 91240 - DNA, 1089 bp, Homo sapiens
  chr3:62353296-62354385
  hyper
ccaagatctcccagacgtaatggggggagagcgctaataagacactattgtactatatgaggacaaggaaagggagctgactccttaaaccggcctgcagtctccctggggatagatgtctgggaaaagcaaggcgatattttcatatccttagccgccaagtcctcctcgcccatcctggggtttcctggggtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctccactgaagcgcaggcctcctaaaacccccggagttcgaattcctgctctaccaagcctggtgaccccaggcatgtcacatagttcatctctgcctctatttctccgtctgtagagtgggaataatcatgcccagcttgagggttgtagtcaccgttcgagaggatgtgtgttaagttcctggcatagagcaagccctcgggagatgacagggttttcgctagtggaaaccactggcactctcagcactgagcgcctactgtataccaggtgttgggcaaacccgcactccagtcactttctgagttacttggcggagtgagggggtgccctttgcgttaagcatctttcccttcaaatagtcgcctcccgccgtggaaatacgcgtggggtcagctcccagccacactcgccccctcaatggggaggttgcgtggaagcgcactcccgggccccg

SEQ ID NO: 91241 - DNA, 348 bp, Homo sapiens; identical to SEQ ID NO: 28205
  chr3:62354445-62354793
  hyper

SEQ ID NO: 91242 - DNA, 157 bp, Homo sapiens; identical to SEQ ID NO: 28206
  chr3:62354899-62355056
  hyper

SEQ ID NO: 91243 - DNA, 920 bp, Homo sapiens; identical to SEQ ID NO: 28207
  chr3:62355300-62356220
  hyper

SEQ ID NO: 91244 - DNA, 279 bp, Homo sapiens; identical to SEQ ID NO: 303
  chr3:62356366-62356645
  hyper

SEQ ID NO: 91245 - DNA, 401 bp, Homo sapiens
  chr3:62356792-62357193
  hyper
cgccttctctctccagatccctctttgccttcctgccagccagccgcgacccgagtcctgaggtgaggtgagaagagaaggcctcgcctggcacgttacctttttggtgaaagcctttgccgcaaaattcgcagacgaagggcttgtagcccgcgtggatgcggatatgcgtgttgagcgtggagctgcggttgaacgctttgccgcactggttgcatttatgtggcttttcctgaggaaaggggcgagtgcacagtaaggagaggccacctcgggaacacctggaagggacatcccccccacccccactcaaccctagagggtaagggataatctttggccatcgtatccccggtgttatcactaagattctgggggttgcgcgcgggctaggcccgacc

SEQ ID NO: 91246 - DNA, 393 bp, Homo sapiens
  chr3:62357278-62357671
  hyper
cgaacggtctggctccggtgtggaccggcatgtggcgggtgagattatagtgagcgttaaacacctatggaaagacatggggggccttgtggtgcgtctgtccgagggcctacaatcagccccgggggggccacagcctacctcccccaaccaacacccccttcagaaaccagagcctttttcagtttgtaaagtgctgcccaaactcctgcttacaccaatactgtgtggccgctgacaagggcatccccattttacagaataggaaactgaggcccaacgaggctcccagtttgggtagtcaactactggggagctcctcagcttgaaaaaggggcattccaggctgccccaaggaagccgccgccgccgatcgcccctcccggcccccct

SEQ ID NO: 91247 - DNA, 382 bp, Homo sapiens; identical to SEQ ID NO: 28211
  chr3:62357735-62358117
  hyper

SEQ ID NO: 91248 - DNA, 288 bp, Homo sapiens
  chr3:62358336-62358624
  hyper
cggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaagccgagcttgccatggcgcgcggagctgagccgagccaggctgggccagggcgcagcctctctcctctaagtctgcattccggaaaaggcagggg

SEQ ID NO: 91249 - DNA, 534 bp, Homo sapiens; identical to SEQ ID NO: 28213
  chr3:62358858-62359392
  hyper

SEQ ID NO: 91250 - DNA, 1242 bp, Homo sapiens
  chr3:62359393-62360635
  hyper
gggagggcggagggtcccggacgcggcgcccccaaagggcccctgggtatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtggtcgaggctgagggttcttacggaggggggtggtggtggctagcaagagagcgagcgagagaattaggtttaggaaagggggaggactgggtgcaagggttttttgaaaagttttggctggttttgttcgcgggacaattatatc

SEQ ID NO: 91251 - DNA, 39 bp, Homo sapiens
  chr3:62362698-62362737
  hyper
gccctgtgtaatccccgggcgcccaggcccgtggccttc

SEQ ID NO: 91252 - DNA, 101 bp, Homo sapiens; identical to SEQ ID NO: 28216
  chr3:62362816-62362917
  hyper

SEQ ID NO: 91253 - DNA, 15 bp, Homo sapiens
  chr3:62363098-62363113
  hyper
cgcacaccactgact

SEQ ID NO: 91254 - DNA, 753 bp, Homo sapiens
  chr3:62363424-62364177
  hyper
aaaatccctttcttgcgcaaaaagctcacacatttgcaccacggaagaaaaaggcaagcatttccactccaaaaagtgttccaatttcagcccctgtggcatgcatatcttggttctggatgacaaggggcactattattttaaaaaccgttattattttttcatctggttgcaatacataacacagcgccctatgtatgccatctccccagggagccgagcagcttgggaggagaaggcttgcttgcggctcccgagtttggggaaacacgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatctgatttacttggtgccgcgcttaaccgctgctgaaaatagattaacttctgaagagaaattcttttgctatcctctcttttttccccaggaagcattttattgaaaacattcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagca

SEQ ID NO: 91255 - DNA, 847 bp, Homo sapiens
  chr3:62364279-62365126
  hyper
cgcccggcccactgcacccggcggctgttttgcagcgcccctggcattcagggaatggtttgcaaatctcaatgcaccacagactagttttcaccgtggagcaggaaaggcgcctattagccaggggcaaccggctttgcagacctgggcgggggcgtagggggaggggcggtggtgcaaacctatcgtgatttccaggatcctcccaactccctccgctatcacatcagaggacattcgctgactcttcggaaatctgggcagcgaatacacttctaggccagaagaattctcctaaaagagcagatctgcagtctatccgtgcaagcttagtactctcctctctgccctggatgcatatatattcacaaacatatatatgcatatcatatatatgcatattgtttatatgtatgtatgtatatacttatatactatcggcaacccatcactagaaatgctatttaattaggaatctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 91256 - DNA, 73 bp, Homo sapiens
  chr3:62859891-62859964
  hyper
tgggagccctgcaagcgagcaaggcctctctgggcgccgcgggcagcaaatcactccccgagcctctcggtcc

SEQ ID NO: 91257 - DNA, 973 bp, Homo sapiens
  chr3:62860169-62861142
  hyper
cctcctcgccagctgcgccgccagctcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgggagacaggcgcgcgccggacggggccgagccgagcacctccttgccgctctcctcctccacgatctcatccgattcttcttcgctggacgaagggtccagcatagtggcgcctggggagcggggtctctggagcccccggcttggagtgcaaaaggtggggggcgctggaggcagccggggatcagctctcccgggtgggcgcttctccccaggtcagggagcgagagcgctgctgctcagcctcggccgccgcgactgatcctctgcccggcggtcgcgagctgggctcagacccagaagcgcgaagggaggaggggaagggagaggtgcgtccgtggactcgaggtgggcaagggggagaatcaattgcgagccccgagcccgcagccggatgccatctgcggctgctgaaggaggcgcctccagaaaagatgccgagtgttgcaagctgtcgatgcagccaagagccgaagaggcatcttgccgattggggagggagcggcgcttacgtgtttattggcttaactctcccgtgtccgc

SEQ ID NO: 91258 - DNA, 182 bp, Homo sapiens
  chr3:62861143-62861325
  hyper
gcgtaaagggctgctgcagagggctggaggggggagagcgcggagcgtcctcagagcctcagtacttctgaccccaataccttgccaccctcctcccctgccggcttcgtggataatttttttgttgatatctggctctcattgcctcaaccccttttcccctcccgcggacaaaaagttct

SEQ ID NO: 91259 - DNA, 82 bp, Homo sapiens
  chr3:62861812-62861894
  hyper
accctaagaactcagcggcgtcaacatctaatgcgtcgactgtcgcactctgttcacccctgcctctcgggtaaactattaa

SEQ ID NO: 91260 - DNA, 238 bp, Homo sapiens
  chr3:63263759-63263997
  hyper
tgatggtgccaagcccgctttcccaaaccaacagacccaaagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgact

SEQ ID NO: 91261 - DNA, 586 bp, Homo sapiens; identical to SEQ ID NO: 28224
  chr3:63264254-63264840
  hyper

SEQ ID NO: 91262 - DNA, 169 bp, Homo sapiens
  chr3:64007991-64008160
  hypo
actttgtcacctatccggcagaggtactcggcctttgccatcattgcatcgcgaatttcgctctctcctagattcttctctgcatcttccagctcctcatccaaacgcttcaactcatcttcatttgccttcttcattttattgagtaggtccacgtctatctgccagt

SEQ ID NO: 91263 - DNA, 335 bp, Homo sapiens; identical to SEQ ID NO: 28225
  chr3:64430570-64430905
  hyper

SEQ ID NO: 91264 - DNA, 30 bp, Homo sapiens
  chr3:64670902-64670932
  hyper
gccacgctctccacccgatccttccattga

SEQ ID NO: 91265 - DNA, 77 bp, Homo sapiens
  chr3:64671655-64671732
  hyper
cttccgttcctgggacgggacctgctccctgtcaatccagttcagcctcagggttcctggcgcgtgaataaaggccc

SEQ ID NO: 91266 - DNA, 375 bp, Homo sapiens
  chr3:64672038-64672413
  hyper
gggggcgggtgtgtgcgctccacgccagtgtactcgcacgcacagagctagctacccaaaccatacgagtttctagctgatatttaacgccggagaggagcggagcctcgccacagtgagggtctctaggcttagaggacaattaagtcttctagaagcgggcgaggaggcggaaggggagaggaggtggcgcgcgcccacttaccattcctgagcagaggctgatgacggccgtgtgctcggagttggtattgacatagcctttgtagaaacagtgcttgagttccgcttcctcttcggaataaaacttggtctgattcaccccgggcgtcccgaggagggtgacagtgaacagtggagcgataaatccggcat

SEQ ID NO: 91267 - DNA, 156 bp, Homo sapiens
  chr3:64673263-64673419
  hyper
ctgggctccccatctcggccaggtcccgcaccaggagcgttagcagtgtggcccaggatacaaactgcatggtgcttcccacccctccctccgctgcccccacccccctccctcctgccctccttggctgcggcggcgacgcgaggcagcggccgt

SEQ ID NO: 91268 - DNA, 30 bp, Homo sapiens
  chr3:64674179-64674209
  hyper
ttctccccgccccaccgtgtccctgtctgt

SEQ ID NO: 91269 - DNA, 30 bp, Homo sapiens
  chr3:64785423-64785453
  hypo
aagaaacctgaactgcgtggcctcacataa

SEQ ID NO: 91270 - DNA, 120 bp, Homo sapiens
  chr3:65534983-65535103
  hyper
cctcttcctcattcccgcccagtctccttcctcccttcctaaccccctcccctcccctcttcctgctgtcacttccaaacccaaggacaaaaccgttacctgcgggccccggagcggccc

SEQ ID NO: 91271 - DNA, 46 bp, Homo sapiens
  chr3:65535274-65535320
  hyper
gctattcacactccgggctgcggctggtacccctctacacgccccc

SEQ ID NO: 91272 - DNA, 15 bp, Homo sapiens
  chr3:65535366-65535381
  hyper
cgggggtaggggtgg

SEQ ID NO: 91273 - DNA, 66 bp, Homo sapiens
  chr3:66025440-66025506
  hyper
ggagataaggatccccgccgggcgcggacatgccctgcgtcctggcgcccgcgggggcgtgagaga

SEQ ID NO: 91274 - DNA, 26 bp, Homo sapiens
  chr3:66618027-66618053
  hypo
acctttggccaggtgcggtgactcac

SEQ ID NO: 91275 - DNA, 30 bp, Homo sapiens; identical to SEQ ID NO: 39944
  chr3:67047776-67047806
  hypo

SEQ ID NO: 91276 - DNA, 30 bp, Homo sapiens
  chr3:67066758-67066788
  hypo
ccaacacttagattacgatgtcaagtagcc

SEQ ID NO: 91277 - DNA, 276 bp, Homo sapiens
  chr3:68056904-68057180
  hyper
agcttcctcctgctgcgtagtccagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtgg

SEQ ID NO: 91278 - DNA, 30 bp, Homo sapiens
  chr3:68777755-68777785
  hypo
ccagctcaccctttccggaaccacttcaaa

SEQ ID NO: 91279 - DNA, 179 bp, Homo sapiens
  chr3:68980768-68980947
  hyper
atctgagatgcctcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgacc

SEQ ID NO: 91280 - DNA, 867 bp, Homo sapiens
  chr3:68980948-68981815
  hyper
gctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggctgcccacgagacagcacctaaatacagggtccaaatccacccccaccccatcctctcgcccctccttatcccttccaacccttcttactcgactagagccggcatccaagtcggaccggcgcgtccggaactaggtactgatcgccgcaccggagcccgaggacgctcaccgtgccgcctccccgcgggagccccgggagcggcccatcacctctgcagcctcgccaggagaagaaaagttcccacgtctctaccaggagaagcccgaagctcctgcgggagaagcctgaagctgctgctggagaagcggcagctgaggcaggactcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggc

SEQ ID NO: 91281 - DNA, 15 bp, Homo sapiens
  chr3:68981851-68981866
  hyper
cgcgcccccactgcc

SEQ ID NO: 91282 - DNA, 181 bp, Homo sapiens; identical to SEQ ID NO: 28233
  chr3:68981867-68982048
  hyper

SEQ ID NO: 91283 - DNA, 66 bp, Homo sapiens
  chr3:6901993-6902059
  hyper
cagtgctagaaagtgcgctctgcggagttctcagttgttccctctctgcaacgaagtaaaaagaag

SEQ ID NO: 91284 - DNA, 351 bp, Homo sapiens
  chr3:6902321-6902672
  hyper
tagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcccccccttacctcagcacgcagcccctccctgcgtgatgatgcaaac

SEQ ID NO: 91285 - DNA, 130 bp, Homo sapiens; identical to SEQ ID NO: 28038
  chr3:6902969-6903099
  hyper

SEQ ID NO: 91286 - DNA, 122 bp, Homo sapiens
  chr3:6903588-6903710
  hyper
ttccaggtagggatgcgctccctccggggcggagcacacagtggctacctgcgcccttaaccctaaaagctggcttggactccggtggtgcgggtcaggtcagccttcgctcatttcctccc

SEQ ID NO: 91287 - DNA, 346 bp, Homo sapiens
  chr3:6904142-6904488
  hyper
ctcgggctgatttcccgacctgtagccagcctccgcgagagcccagggcgcgaggtgctgggaccttcctcaggtggagagatgctgcccgcagacgtgacccccggttggtttgctccgggcaatattttgcaccgtctaaattacatgtgcgatccggccactggccggagctgggcgatcagctttccactcctgccacttcagacctcagcccagggatgagctcacgcgaaacgaaatcgctctccctgcctcctccctcctcccccccgcccccctcacccactatctccctgacgcagaccccaagccaaatcctcggcttggaggacgattcccggag

SEQ ID NO: 91288 - DNA, 30 bp, Homo sapiens
  chr3:69313995-69314025
  hypo
agtatctgggcagaccgcttctcagaaact

SEQ ID NO: 91289 - DNA, 511 bp, Homo sapiens
  chr3:69435147-69435658
  hyper
ccttcgctctgaacccgggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggcttccacgtcttgcgcgcgcgcgaacacacacacacacagacacacaccccccacaccggacgagtggtctcctaatctgcctcggggaacaccttac

SEQ ID NO: 91290 - DNA, 228 bp, Homo sapiens
  chr3:69459574-69459802
  hyper
atgtctgtgcatgagcgagtgtgaatatgtgtgtgagtacgtgagtgtatgtgagtgtatgaacgtgtatgtagtttgcaagacctgtacaagctgtttctggaaaagtgctccacctaggggcagactgtcaaactgatgccctctgatggcacaggcatggcccagaaacggccattgagaggaaggaaggaaaatagaatattttacctacgggttcagcatctt

SEQ ID NO: 91291 - DNA, 239 bp, Homo sapiens; identical to SEQ ID NO: 28235
  chr3:69590888-69591127
  hyper

SEQ ID NO: 91292 - DNA, 105 bp, Homo sapiens; identical to SEQ ID NO: 28236
  chr3:69591310-69591415
  hyper

SEQ ID NO: 91293 - DNA, 199 bp, Homo sapiens; identical to SEQ ID NO: 28237
  chr3:69591779-69591978
  hyper

SEQ ID NO: 91294 - DNA, 140 bp, Homo sapiens
  chr3:69592068-69592208
  hyper
cggaacttgattctgcctcaccggcttcaggcatcccaggacctgagtgctgttagaataaagggtatgaggcaccggtggcagagggaggcgcagaatgcacccagccacccaagaggggctggcgaaatgactcctga

SEQ ID NO: 91295 - DNA, 81 bp, Homo sapiens; identical to SEQ ID NO: 39946
  chr3:69741003-69741084
  hypo

SEQ ID NO: 91296 - DNA, 30 bp, Homo sapiens
  chr3:69937866-69937896
  hypo
agcaatattgtgcagcgatggaaatgcgcc

SEQ ID NO: 91297 - DNA, 27 bp, Homo sapiens
  chr3:70083704-70083731
  hypo
ttttgttctgccaggcgtggtggctca

SEQ ID NO: 91298 - DNA, 304 bp, Homo sapiens
  chr3:71179297-71179601
  hyper
aaaaagaaggcaacacgaaacaatgtcacagtaagcagagagaggttccaatctacgtttagcctataaaactatcctgacaccacccggctgcttacttagctgattatatccaaagacatatttgaaaacaagagtgaattaaacaaggagttagaaggaaacggtcctctcaaatctctaaaaagaaaaaagcctctgatggagagaggagggaagggggaggaaaaaaagcagtaaacaagttggatcaccttatttcgcccttcagagaatgtctgcacaagaacggatccctagttta

SEQ ID NO: 91299 - DNA, 30 bp, Homo sapiens
  chr3:71187389-71187419
  hypo
tttaatatttaggaacgtaatgggatcggg

SEQ ID NO: 91300 - DNA, 36 bp, Homo sapiens
  chr3:71510928-71510964
  hypo
aaaaagagcgagactctgtatcgaagaaaaaaaaaa

SEQ ID NO: 91301 - DNA, 25 bp, Homo sapiens
  chr3:71802569-71802594
  hyper
ccaccgtgaccccagcgcgggcgcc

SEQ ID NO: 91302 - DNA, 193 bp, Homo sapiens
  chr3:71802595-71802788
  hyper
ccgccggacccccgttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggagggg

SEQ ID NO: 91303 - DNA, 710 bp, Homo sapiens
  chr3:71802848-71803558
  hyper
ggcggggggcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcaccc

SEQ ID NO: 91304 - DNA, 225 bp, Homo sapiens
  chr3:71803559-71803784
  hyper
ctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtggg

SEQ ID NO: 91305 - DNA, 201 bp, Homo sapiens
  chr3:71803826-71804027
  hyper
cgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaatt

SEQ ID NO: 91306 - DNA, 185 bp, Homo sapiens
  chr3:71833566-71833751
  hyper
aattgcttttcaaagcgctcacatggccctggaccaagcgatttcaaagggtttctgcggaggacgcatcggggagcaaactctttgactgtaggattaagactctgggcacttggggaattcgtcttggtcctttgcatttcaggaaggggccgtcaaattttaaggttcgaggttggagagcc

SEQ ID NO: 91307 - DNA, 769 bp, Homo sapiens
  chr3:71833976-71834745
  hyper
aggggcaggtgtccccgcccagggcgaccctccctttgcctctagcctgcccttcagggtccccgtcccaagccccctgggcacatcccaggcgcgcatcaggggcagacaggtgcgcccgggccgcttaccccggtgatcacggcggcgtccccagcgcggggcgtgagcagcagcggcggcagcagcaagaggagcaggagtggggcgcagcacaggctcctcatggcgccctcgggactgggcggccgccggaggcagttgggggcgcggggcccgggtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacatagggggcggggggtgggtgag

SEQ ID NO: 91308 - DNA, 119 bp, Homo sapiens
  chr3:72149958-72150077
  hyper
agttctggggacaagcgcgtgcccctgcctccgaatgagctccttttacgtgtgagtcctgggcacaaaaccacagccaccacaagccgcggatgcttccccagcgggccccgcgaagg

SEQ ID NO: 91309 - DNA, 30 bp, Homo sapiens; identical to SEQ ID NO: 39948
  chr3:72305951-72305981
  hypo

SEQ ID NO: 91310 - DNA, 30 bp, Homo sapiens
  chr3:72321838-72321868
  hypo
gctcctcacaatagccgacatctggaatca

SEQ ID NO: 91311 - DNA, 188 bp, Homo sapiens
  chr3:72647815-72648003
  hypo
gacagatagatttaacgggtttggctacttactagctatgtggcctcaggcaattcacctcacctctctgagtcccgggatactcatacctacctcacaagactatttgaggattatccagataatgctcactagggactgagcccagtgcctggcaccggcaagtgaccattcgctacagtgtacca

SEQ ID NO: 91312 - DNA, 43 bp, Homo sapiens
  chr3:7271788-7271831
  hypo
atgctgggattgccggcatgagccaccgcgcctggcctcttcc

SEQ ID NO: 91313 - DNA, 30 bp, Homo sapiens
  chr3:72742498-72742528
  hypo
ggcatgacgtgcagacggagaagaggctct

SEQ ID NO: 91314 - DNA, 30 bp, Homo sapiens; identical to SEQ ID NO: 39949
  chr3:72773579-72773609
  hypo

SEQ ID NO: 91315 - DNA, 369 bp, Homo sapiens
  chr3:72787939-72788308
  hyper
cctcagcaagcttggcgtctgcccctgccgctgggagaccctcctccaggcacctgccctgggccccgccccgcccggtccgcgcgcacgcgcagtggccccaccccgccccgccccgcgacgcccgaggacccgacggagctacacccgctagttcagccaggaggccctgcgcggctccggggagagctgggtggttatgccacctcattagacacattggtggacgatgccgcggattagcgggttggctctcagggcggggcgcaggctttctcactgatccgggagcgtgggagcaggggcaacgcggggccatccgggagctgcccgcctgcttcgcagttggctttccgggccctcgagcaa

SEQ ID NO: 91316 - DNA, 81 bp, Homo sapiens
  chr3:73045023-73045104
  hypo
caggtgggccagtgacgaacgaacgttgggttaagcagggaggtattcttgttaggattattagcaatgcttagtgtatgt

SEQ ID NO: 91317 - DNA, 81 bp, Homo sapiens
  chr3:73045524-73045605
  hypo
gtgttgggatcaccggcctgagccccctgcccggcctcgctctacgttttttaggcgcattctgaacgtgaagtgtataca

SEQ ID NO: 91318 - DNA, 172 bp, Homo sapiens
  chr3:73498616-73498788
  hypo
ccataatccacagtgcgagcaaatcctccgtggatgcatattgatttctgaatcatgatgaggacttgtatattgaacaaataattattttgcttctttctactggcagccacattgttaatcatatcccacgcctcactgttaaataagcgaacaacgcgtgtaaaattac

SEQ ID NO: 91319 - DNA, 273 bp, Homo sapiens
  chr3:73673951-73674224
  hyper
cgaagcggtccagctcgaagcccatggtggcggccaggccccggggtcgccgccgggcggccgggcgccccctccctccccacgaggcggcccagacaggccggctacgccgcccgcgcgctcgctggctctccccggactgagcctaattgatccagacttcctcggaaaatgcccgaggaacaggactcctccggccgtatttgcgcgagcgcgagcgcacatacatcgtgccttggatgcctcccgccagccccccgaaaaagggaggag

SEQ ID NO: 91320 - DNA, 30 bp, Homo sapiens
  chr3:73674657-73674687
  hyper
gtgggtgaatctacccggggaagttttggt

SEQ ID NO: 91321 - DNA, 207 bp, Homo sapiens
  chr3:74663814-74664021
  hyper
gtgcctccgccactccggctccggctccggctccgacgcggacgctggagggaggggagaccgggcggactggagggagggaggggcggggagcgcggcggagcagccaactgggtcccgagcctcgcgtctgcggcgcccccagcgcctctgcgccggccggaccccgcgcggccctgcgctcggccgcgtgcacccacgtgtgtc

SEQ ID NO: 91322 - DNA, 136 bp, Homo sapiens
  chr3:74664045-74664181
  hyper
cggcgcgggctgggcggcggtcaccgtgtcacctccgggtggcctcgtgccacgcagttagggccctcggaacacggggttaaggcaggaattccacttctagaaaagcctcctgcagctgcgctcccacaagtgc

SEQ ID NO: 91323 - DNA, 15 bp, Homo sapiens
  chr3:75955796-75955811
  hyper
gaccgggaggagcct

SEQ ID NO: 91324 - DNA, 125 bp, Homo sapiens; identical to SEQ ID NO: 28248
  chr3:75955872-75955997
  hyper

SEQ ID NO: 91325 - DNA, 399 bp, Homo sapiens
  chr3:75956026-75956425
  hyper
cgttattcacacggacgctgcggagcttcccagggctgcttccctgtccccctgggtggaggctgccgtctaaacctgactccaggtgagttcggcaaagaggtgaaccgaggggtctcgaaccagagacgtggcattggcgaggctgctcagctcccccaagcgctgctgcctttatatttcccaaattcacggaaggtcttggcggtggctgcacaggctgggagggggcggagggtcggtgggtggttgcgatcctcacggccagcgtgggggcattcggatggaattagcttaagtgaatggggttttaggaaatgtccccaaaggcacgcgttatatatgtgtttctagacaagcttttaagacggaaatttggtttcccggatgccctttttg

SEQ ID NO: 91326 - DNA, 30 bp, Homo sapiens
  chr3:7630527-7630557
  hypo
tgagatgtgatctcacgttagtgatttatc

SEQ ID NO: 91327 - DNA, 20 bp, Homo sapiens
  chr3:7690771-7690791
  hypo
tttgagatggagtctcgctc

SEQ ID NO: 91328 - DNA, 67 bp, Homo sapiens
  chr3:77089144-77089211
  hyper
cactatcctcagaggcggcaccgcgggggtgtctgcagcctcggcctccgcccggcccctccctccc

SEQ ID NO: 91329 - DNA, 60 bp, Homo sapiens; identical to SEQ ID NO: 28251
  chr3:77089428-77089488
  hyper

SEQ ID NO: 91330 - DNA, 170 bp, Homo sapiens
  chr3:77918482-77918652
  hypo
ttctcatttcaattgcggccttttttctcccagcatttatgtccctgaaatgggagacatcctcattaaagagaatttgagaaagatttctaggccctgatctttgcataacgctatacacttagtgacagatccgctcaccatggaggaggaggcggtaccatttgtgc

SEQ ID NO: 91331 - DNA, 33 bp, Homo sapiens
  chr3:79067168-79067201
  hyper
ccccagggaagcagccggcggctgatactcact

SEQ ID NO: 91332 - DNA, 194 bp, Homo sapiens
  chr3:79068137-79068331
  hyper
tccggaggaagggctcggggtgccgggagtgtgactgggtgactccgcgcgcagagagcgagcgagggggcggtgcggcgacagcggctgcctgggcgggcccttgttcccatcacttgggggatgcggagggtactggagacagcagcaggaccgcggacactcgcacgtcttctgggcgcccccagccccgc

SEQ ID NO: 91333 - DNA, 448 bp, Homo sapiens
  chr3:79815465-79815913
  hyper
cttttttcttgggggcgcaggtcctctagatgcttggggtgcacactaaggatatttgagtagtgggagctccgactcgaggcaggagtgggatgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaaccgaaggctcatggaagcggggctggcaagat

SEQ ID NO: 91334 - DNA, 136 bp, Homo sapiens
  chr3:79816272-79816408
  hyper
aaatccacctagtaacgcttattttcaaagcccccacgcgcatccattcctggagaatgctttcaaagtttggaagctccctgcagcctgcccgtgtctatgcctcagtcagctcacatcacgaacaacggtgcgg

SEQ ID NO: 91335 - DNA, 222 bp, Homo sapiens
  chr3:79816778-79817000
  hyper
actgcagagtcctctcggcaaccattctgcactccaacaaccactagtgtaaaacccagcgtgtccccttttacaaatcaaaagccagctgtcacttcccttgcaaccatttccgagacttacccttccataagactgttttcagcaatctagaggctccgtagtgcagacgcagccctgcaactttgctgtgcactgagacctttccgagtttaaaccaag

SEQ ID NO: 91336 - DNA, 142 bp, Homo sapiens
  chr3:79817216-79817358
  hyper
tgggtcctactgctccggtctaaactacacagcaacactaggcacgcagctttggagacgccgaggggaaaatggatttaattgattcgttacctctggtattgtaatgcctgctgcgatgtttaaccgaggggggaggaaa

SEQ ID NO: 91337 - DNA, 30 bp, Homo sapiens
  chr3:85000786-85000816
  hypo
ggtggggatggttaacgggtgtaaaaaaaa

SEQ ID NO: 91338 - DNA, 997 bp, Homo sapiens
  chr3:85007729-85008726
  hyper
tgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccct

SEQ ID NO: 91339 - DNA, 15 bp, Homo sapiens
  chr3:85008802-85008817
  hyper
cgggctcctgctaca

SEQ ID NO: 91340 - DNA, 104 bp, Homo sapiens
  chr3:85009234-85009338
  hyper
tcccccttttcaggtcgccttttcttttccccctcttcccaccatcatcatatccgtgtgtctttaaaaagtgtgtgagagcctgggagcgagctaccaagacg

SEQ ID NO: 91341 - DNA, 96 bp, Homo sapiens; identical to SEQ ID NO: 28259
  chr3:85009769-85009865
  hyper

SEQ ID NO: 91342 - DNA, 40 bp, Homo sapiens; identical to SEQ ID NO: 28260
  chr3:85010590-85010630
  hyper

SEQ ID NO: 91343 - DNA, 30 bp, Homo sapiens
  chr3:85393239-85393269
  hypo
aataattgtatgggccgggctcacgcctgt

SEQ ID NO: 91344 - DNA, 145 bp, Homo sapiens
  chr3:86061726-86061871
  hypo
ctgcccccaactgcacgcgaagcgcacgcagtccgacctggccttcttcaggttcccgcgggacccggccagatgccaggagtgggtggagaattgtaggagagctgacttagaagataaaacacctgatcggctgggcgcgttg

SEQ ID NO: 91345 - DNA, 86 bp, Homo sapiens
  chr3:86960155-86960241
  hypo
gccactgggagttaacgacagccccctaacacaagtgcaaaaaactggattcttagaagagtccaagtgagtttgaaagttgacac

SEQ ID NO: 91346 - DNA, 892 bp, Homo sapiens
  chr3:87039656-87040548
  hyper
ccagagcatcctctgcgccacgcgtgccggcgggacgtcgccgagccccagaccgatactctcgatgcccttcgcccccgcccccagcaggctgcccgtccggtgactcacctgctggccaggttggggcgccggctgatagtaggctgtggggcaggttgtcgctgccatggggttgggcagatactgggacgctccataaggctgggggtgatacatcacctccgcacaactcatggcagccggggcagtggcggcccccgagctgccgccgccgctctacgcgctggcgcgaggggcgcgggcgccgccgccgccgcagctgccgcctctgtcgctgctccagctgctactgcggcgaaggcgggtcctcggcggcctcgggctccgcgcggggcgcggggtcgggagggactggcaatcagcgggggcccatgcgcgggcaccttcatcttcagcccctccggatgttccctgccgcgcttatatagcggctcagggacgcagccgcccgctgcgccgctggggcattaccgcgtccggctcccgcgagggctgcggcgcccacggcagcgccagtcacagccacagcccaggcccgggtcgggcagccgtggggagcccagctccggtttgcatatacacaatgcacgcccggggctcgtcctatcacgggtgctcccggctgtgcgaggacagggaggcgggggcagagggagggggaacgccggggagaagggggagcactttgcctccccaggctctgacgcggaactttgcaaagtttctccaactcgctttgcagcgggcgggtcaccctgcagggggaccccggggaaggctggctgcggattggagcgaagtttgcagccctctccgcctcccagcatgg

SEQ ID NO: 91347 - DNA, 30 bp, Homo sapiens
  chr3:87128365-87128395
  hypo
ttgtcttttattatacgaatttactgcgtg

SEQ ID NO: 91348 - DNA, 38 bp, Homo sapiens
  chr3:87226517-87226555
  hypo
tgctttttattcagtgtgtttcacggaatagttttgga

SEQ ID NO: 91349 - DNA, 163 bp, Homo sapiens; identical to SEQ ID NO: 14551
  chr3:87782694-87782857
  hypo

SEQ ID NO: 91350 - DNA, 395 bp, Homo sapiens
  chr3:87841397-87841792
  hyper
tctacctataattcccgttttgctttctttatctgacctctctcattgctagccacccagctggataaaaagagtcactgggaagaagacgcaaagatgaaaaaatgtgaggcaaaaatcattttattttaaaggttttcggaaaagtgattcacgtcatttttcggattccatgaacagataatctcgaaggtatcactcaagtttaagagactggacttttttctcccccgcccttctccacgcatcagtgaaagaggagggaggagacggaggagagaagaggcagggaggcgaaaaagtgacagaagcaagagagaaagggagagaggggtgttgaaggaaggaagggaggaaggcaagaggagagggctgctaggcgtgctggagagcct

SEQ ID NO: 91351 - DNA, 188 bp, Homo sapiens; identical to SEQ ID NO: 28264
  chr3:87842058-87842246
  hyper

SEQ ID NO: 91352 - DNA, 165 bp, Homo sapiens
  chr3:87842247-87842412
  hyper
gagatagtggtcaaggctgggaggaagggaggggtctgacccgggcccaagggcgaggggtggcggtccaagccggcgagaccccacttagggcgcaggctcctggcgctcctacctcgggaagccgctggggtggagagagacggggcacgggccagaatccag

SEQ ID NO: 91353 - DNA, 38 bp, Homo sapiens
  chr3:87881745-87881783
  hypo
gggattacaggcgtgagccaccgcgcccagccagaata

SEQ ID NO: 91354 - DNA, 337 bp, Homo sapiens
  chr3:8809378-8809715
  hyper
caggcagccgagccacgtggcgagcactgccaggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagc

SEQ ID NO: 91355 - DNA, 132 bp, Homo sapiens; identical to SEQ ID NO: 28042
  chr3:8810151-8810283
  hyper

SEQ ID NO: 91356 - DNA, 693 bp, Homo sapiens
  chr3:8810758-8811451
  hyper
tctgagtctcaatcccgagaagtcactttacaatctctcggaacaccccgagctcctccaggaacaaggagtgcgaggcaccccaccacctccactcgggtcccgatggctccaccggccctagccatcccgtccacccctgcttagcacccagctacctgcaccgagtccgcaggcgaacctaaagttgactccccccggggaagttgcacggcgactgacggccccagtgacgcgtgcgctcccggcccgagttgggatggcctgccggctgcacctaatgtgatgctaagctgaggtctctcactggagcctcggttggaatcccctcgccgcagcctggctggtcgctggatgggtacaggaggcgagcgaggagcgcctcccaggctgcgcgcgcggacagcgtctggatgcggcgctgtgcgctggggctgaggctgcactatcgcacgggtccgctagggggcgggcgaggccagccgcgcagacccctccggagcggagctggttcgcccagcgttggtcccagagccttaacaaatgggtttattttgcagtggtttaaaactgcgagagggagggaactcgtcaataacccgcccgtttcttcctttcttggtttagaagctcttgactccgagacacataggaggcttgaataataatgttcttccccgggtagatagtgat

SEQ ID NO: 91357 - DNA, 27 bp, Homo sapiens
  chr3:88248022-88248049
  hypo
accccgcccgcccgattctttaacatt

SEQ ID NO: 91358 - DNA, 22 bp, Homo sapiens
  chr3:89098883-89098905
  hypo
gggcgcggtggctcacgcctgt

SEQ ID NO: 91359 - DNA, 73 bp, Homo sapiens; identical to SEQ ID NO: 28266
  chr3:89156550-89156623
  hyper

SEQ ID NO: 91360 - DNA, 44 bp, Homo sapiens
  chr3:89157055-89157099
  hyper
cgaagccttgcacgtcgggaaggtgcctccgaatagagcagttt

SEQ ID NO: 91361 - DNA, 25 bp, Homo sapiens
  chr3:89219100-89219125
  hypo
ttgagattatagcctcggcggggcg

SEQ ID NO: 91362 - DNA, 30 bp, Homo sapiens; identical to SEQ ID NO: 39855
  chr3:9006374-9006404
  hypo

SEQ ID NO: 91363 - DNA, 22 bp, Homo sapiens
  chr3:9177880-9177902
  hyper
cacaaaagactcgtgcgctgcc

SEQ ID NO: 91364 - DNA, 135 bp, Homo sapiens; identical to SEQ ID NO: 28045
  chr3:9177995-9178130
  hyper

SEQ ID NO: 91365 - DNA, 40 bp, Homo sapiens
  chr3:93698209-93698249
  hypo
gattacaggcgtgagccaccgcgcccggccccaaatggtt

SEQ ID NO: 91366 - DNA, 30 bp, Homo sapiens; identical to SEQ ID NO: 39959
  chr3:93801136-93801166
  hypo

SEQ ID NO: 91367 - DNA, 680 bp, Homo sapiens
  chr3:9541700-9542380
  hyper
tctccacctctgccccgtctctctcgatctctcctcctcgcgctgtttctctgtgcctgtgcgtccccctcgctccttctccaatcatctctcatctccctgtctctgcacccctcttctcctcaccccagtgtcttctcccattcccagtcgcttgctgcgcccctcccctcactctctcctaactctgctctccccctccaacgctgggcttggtttgcatctttgaggaactccctcctaccccaactccctcccacggggctcccgcatcctcccgcatttaactcggaccctctgtcccgcagcgcccctaccccaggccgactggactgtccgggaaggcgccggcggggaaggggagcccagcgctgggaccagagcactgcggggaggctttgcccgggaggagtaagtggaggagtgaagtcgggacttggtaagttccaggtggcaggaacccactaggtcccaacatctgattccggctagggtccagagtggggagacaggcaggggacttctagggtctttcttggaaaccctaactctcaggtccaagtcctgtggaaatgaacacaaggttggcaaacacatggcgctcaagcgaccctctcccctccgccgaggcccgaggcggcttcccctggcatcctgcagggcaccgccccttccctgca

SEQ ID NO: 91368 - DNA, 89 bp, Homo sapiens
  chr3:9550664-9550753
  hyper
cgcgggtcctgcagtagtcggtggctcccgccaggagcatccccgtctccgtggaaaccgggcctgcatcccggcgctcccagctgcgc

SEQ ID NO: 91369 - DNA, 93 bp, Homo sapiens
  chr3:9593963-9594056
  hyper
agagctgcatccaggcgcagatcttgtagaccgtagccgtgttgcagaagaagaaaagcgaaaagcaggtgatgcagccgaggatcagcacca

SEQ ID NO: 91370 - DNA, 77 bp, Homo sapiens
  chr3:9594366-9594443
  hyper
gcccggaggcggggccggcggcggcggcggctggcgggggccgccggcccgggacggagcgccgggctgccgggcgg

SEQ ID NO: 91371 - DNA, 30 bp, Homo sapiens
  chr3:9594966-9594996
  hyper
atatgggggctgggacggggaatgggggct

SEQ ID NO: 91372 - DNA, 108 bp, Homo sapiens; identical to SEQ ID NO: 28050
  chr3:9595395-9595503
  hyper

SEQ ID NO: 91373 - DNA, 83 bp, Homo sapiens; identical to SEQ ID NO: 28051
  chr3:9595598-9595681
  hyper

SEQ ID NO: 91374 - DNA, 160 bp, Homo sapiens
  chr3:96147753-96147913
  hypo
tttgtatttttagtagagacagagtttcaccgtgaggcaccgccccagggcgacttgggtactcttactttacaatggactgccttttaggtattttaatttgaaaatatattcccctatggctccttctgattttgcttttgcccgtaaatgttatgtg

SEQ ID NO: 91375 - DNA, 1704 bp, Homo sapiens
  chr3:96532078-96533782
  hyper
atccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctgggcgcccgcctccgccgcggggcgaggtggtggagaccgcggacgccgagggtcctcccagtcagcacgccgcgttgccccggccctggggcgggggccgcggagtcccaccaagtggcccgcgcctcggcttccgggagacccgagcgcggggagggagtgggtgccgcgagggggcggctcgcgcggggagagccgtcagcccacggcgcccctgcgctgctgtggatgtggccacgcgccactcggcccttggactgctaggagagcgcggcccgacgccaccacgccgtggacgctcggggacccctgaatcccagcgtcaaggctgcgacgatgctcgtgacctccaccgcgaagtcacctccgcaaggcgacgcaaggacctcggcgatcccgggcgccgtacacccgccactttccagcctcatgtaaccccccctctgctgcttcctcccggcgctttgcttttctacaactggaagccgcgaaggcggctactgcgctgagccgctcgctctgctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgtgggactaagggcggcctcagagatgcccggaaaatcgctgccacggccagagtgcggcgcagacgcggcagagttggaggtgtccgcggtgcaggctgctgcccacgccgctcaggccaggtgctgagggctcagcccgcgcctcggccgaaccactctcagccccgttgagccacctcgtccgcccggctttcatcgcaccggccagaggaaagttcccgcggcccccacgcctcttcacagctgcagcgcctcccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttg

SEQ ID NO: 91376 - DNA, 61 bp, Homo sapiens; identical to SEQ ID NO: 28271
  chr3:96534035-96534096
  hyper

SEQ ID NO: 91377 - DNA, 113 bp, Homo sapiens
  chr3:97200376-97200489
  hypo
gggggtccctagagccgccggggcgcggcgcgtccggcgctgggggactgttgggtcagaaagtcttcagggagcagctgttgcgccctccctaggcccgccgcttggagacg

SEQ ID NO: 91378 - DNA, 470 bp, Homo sapiens
  chr3:9745353-9745823
  hyper
caccccagagacttgcgcagggcagactctaccaaggtgtgggttggagttgggagtcggggtgaggttccccgctggctccaggctgctccaatggggcgggggccgcccgcagggccgggcggggctgtgctgccatctggagccgctgccgccggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggtgagcgggccgcgctggggagggcttaggcactggcactgccccagccccagccagccgcggggctcagcctgg

SEQ ID NO: 91379 - DNA, 55 bp, Homo sapiens
  chr3:9746288-9746343
  hyper
taccttctccaagtccgaccccagtaggcggctccaggaccgggagggggaactt

SEQ ID NO: 91380 - DNA, 31 bp, Homo sapiens; identical to SEQ ID NO: 39961
  chr3:98029454-98029485
  hypo

SEQ ID NO: 91381 - DNA, 16 bp, Homo sapiens
  chr3:98161422-98161438
  hypo
gcgtgagccaccgcgc

SEQ ID NO: 91382 - DNA, 42 bp, Homo sapiens
  chr3:98170629-98170671
  hypo
taaagaaatgattctcggccgggcgcagtggctcacgcctgt

SEQ ID NO: 91383 - DNA, 42 bp, Homo sapiens
  chr3:98313028-98313070
  hypo
caggctggggccgggcgcggtggctcaagcctgtaatgctag

SEQ ID NO: 91384 - DNA, 102 bp, Homo sapiens
  chr3:98313310-98313412
  hypo
tctcagaaaaaaaaaaaaaaaaaaaaggtttccccaggccttgcttctatagtgcctacttgattattttagaaaaaggaaaagcaacgtgactgttttggt

SEQ ID NO: 91385 - DNA, 61 bp, Homo sapiens
  chr3:98450986-98451047
  hyper
aaaagataaaaagtacgaacacatttgcccttgaagggcagagccccggaattcaggagct

SEQ ID NO: 91386 - DNA, 109 bp, Homo sapiens
  chr3:98451370-98451479
  hyper
cgaaaggtaggggttcggctgtgctcccgcctggtccccaacgcctcaccctccgggagacccgcagcctcccaccactttgcaccttcctcctcgaatttgggggcgg

SEQ ID NO: 91387 - DNA, 686 bp, Homo sapiens
  chr3:98451685-98452371
  hyper
ggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccgggtgagggaaattgggggtgcgggaagaccggtctgggccggggtccgggcggcctggggtctgtgctgccccgaccctccggctttgcagcctctgaggctcagggttgggggtggggacacggagcgctgtttgcccctccacatatcctgccagcaccaaggaggtggcgtgcggaggcgtaaagggaccatgggcgctgggacccgcgagccagccggcgtgcgccgcagccaccgccgagagggcacccggggatcctggagccccagtgaagggcgggagggacgcgcagcctcgcgggtaagcccaggagccgtgggggccgagagaatctgctctgggaccctcttttgtcgaatcgccggcgaggttgtgcaattgggaagccaagaggagtgtccagctcctcgttcactattgttttcttgtaaaagggtctgtacgcgaggagggttgaggggtctggaaggttctggtctcttaccgtataaagtttttcgagaaacccttttt

SEQ ID NO: 91388 - DNA, 186 bp, Homo sapiens
  chr3:98452640-98452826
  hyper
agtagcgagggttggcggggacagtggggaggagcaggagggggagaagaggttgctgttgaaaggtaatgtttaaaaacagtgtgtgggggtagggatgaaaataacgtggtgactgctagtgtatcagaaatcacaccgagtctaaagtcgtaagtcccatttgccttacgaggaccagctggg

SEQ ID NO: 91389 - DNA, 41 bp, Homo sapiens
  chr3:98471752-98471793
  hypo
ctccccttgggcttccgtattctctgagacacaacaatatt

SEQ ID NO: 91390 - DNA, 30 bp, Homo sapiens
  chr3:98555269-98555299
  hypo
tgaaaagggcccatgcgttatgaaatttga

SEQ ID NO: 91391 - DNA, 41 bp, Homo sapiens
  chr3:98613834-98613875
  hypo
gttttgaaggctgatcgagagtttaccgagaagacaaggaa

SEQ ID NO: 91392 - DNA, 1072 bp, Homo sapiens
  chr3:98620054-98621126
  hyper
cagggagggagggagcgggagagggggagcgcggcccaggcgggggcggcggccgcggcccggacttggggacactgcgggcagcgcctggctctcaccaccgcccggctcgccatcgcggcggccggcagtctgcctgcatagtgcgggtgcctcggcagccccgcgcgcctctggccgcggcacccgaccaggagacggcggcagcggcgggagaacaagaggcagccctcgcctcaccccgcgccgggacccttccgcccctcaccccgctttcacctactcctccttcgtcccttccctccgctccccgcgccgagaccccaggccggagcgcaggggaggggagggaaggaagcggagtcctcgagccgcggaggacggccgcggcggagctaaggaacgtgcctcccgcgccgcgctcctcaccagggtcgccgctcgccgcgctcacccgcggctccggctagctggcaggcaggcccgcagccagctccctcgcgctccctctcgcgcgcgccggccacgccccctaggcaccgcggccaatcctcggccagctctggtccgtctccttccgcgaaacccaatcagcatgctcgctcctcgctcgacccgctagttctccggcccattcctcgagctccaccgccccttacctccctcttccaatccccttcggcctttggaggcgtcccacccgcctcctccaatccaggtcccgccctccagcttcggatccccgcggcccccgcccggcccgggcgcctgttattgttgggccctcagcccaaactgatcccgcagaggcggcagccagctcgtcagtgacttccgggacgtcccccatcccgcgctccctgctcctcaggcccagcttgctccttgctcctttctcctcgctcctccgacgcacatcagaccactggaagggggtgggaaacctggatcctgggttgttttagctgggagctgagtctaagggactttttttttttttttaatggcagagcgtggcttgttttgttaaaactgccgccagttgttgcaacagctccgagttagaataata

SEQ ID NO: 91393 - DNA, 29 bp, Homo sapiens
  chr3:9886216-9886245
  hypo
agcttccccagctcacgattgtccaacct

SEQ ID NO: 91394 - DNA, 19 bp, Homo sapiens
  chr3:98902515-98902534
  hypo
tttgagacggagtctcgct

SEQ ID NO: 91395 - DNA, 489 bp, Homo sapiens
  chr3:9904219-9904708
  hyper
tggtcctggggcagtcgcgtccaggcaggcggcacttaggaaggacaaactccaaaacccagggatccaaaggatccatgggaagatcgggtggctcaggggagtgactccccggcttggtcggcgctttgaggccccggggacccagcggagagggctcgggtgaggcatctggaggcgctgaatggggccgggagccgcgggacccgcagagggcgcctgtccgtgtgggcgcagcagcgcctagagggaggcggccccggcagcccgcaggggtcaggctctgctggagcaggggcgtccctgtctccgcttcccagcgcaggctgggtggggccgatggccattaaagccccgccccccgcggctcaccgccgcctggccccgtccccgaggccagaaaagaggagacccgaggccgtcagaccgcctgtcaagggctgtcctggagcctggcaccttcccctcgctccccgtctgacccccaga

SEQ ID NO: 91396 - DNA, 116 bp, Homo sapiens; identical to SEQ ID NO: 28277
  chr3:99356783-99356899
  hyper

SEQ ID NO: 91397 - DNA, 41 bp, Homo sapiens
  chr3:9941469-9941510
  hypo
actcattatttgggccgggcgcagtggctcacgcctgtaat

SEQ ID NO: 91398 - DNA, 1064 bp, Homo sapiens
  chr3:9956682-9957746
  hyper
cagaaatccagcctgcgctgtactcgcccagcctggagccctgaccctctcttcagaaggggtgcctttatctaattagcccataagcaccctataggctagggctgttttcggtaccaacccccagagcaaataaggggcgggggcgggggcggagaggcgagcaccctacggtatcccgagagggtggggagaagagggctgagcagtccctcagccgcccagccttcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttc

SEQ ID NO: 91399 - DNA, 423 bp, Homo sapiens
  chr3:99594891-99595314
  hyper
gcgaagttgctctcccgggcttacctgaactgcctgcgccggggccgggcgggggccgggccggggccgctgtagtgccgcgctgcgagccgactgtgcgcgctccgagagtcgcccgaacaatgcgagcggggcgctgagcgcgcccggcctatgggcgttacgtcactgttctgccttataaggcgctccgcgtgtgcggcgctgtcggcgggggcgccggtgaccgcgggaccctcggccgcggcggcggcgcagccacacaccccagctcccgcggatgttccggccgtgtgaacggaccgtggttcccggctcccagcggagggaatgagtggtgggccggtgggccggggcgccggcgccctcctgtcgggctaacaaagtcattgggaggcagggtcgatccgcttgtaacttttt

SEQ ID NO: 91400 - DNA, 218 bp, Homo sapiens
  chr3:9993715-9993933
  hyper
ggctgtggggggtggcggatctctctgccgcagggactggggagaggccggcctgggggcagggcgaggccgttgcggggcagcctcggagctggtccatctcgggttacctctcctcctcctcctcctcctcctccgtctcctctctccctggctccgcgccttcccgcagtgtcctggatgggggtgggcgccgtgcaggcctggtcgcctgcgcc

SEQ ID NO: 91401 - DNA, 165 bp, Homo sapiens
  chr3:9993964-9994129
  hyper
cggggtcccgccatcgccccctccctgggccagctcctcacctgcgcgccgcagcccccgtgttcaccttgcgcgcgtccctgcagccgatcgccgcgccgcatcctccgagatgctcagactcggctaacagagcccggcgctgccgatcgcgagcccgcccac

SEQ ID NO: 91402 - DNA, 78 bp, Homo sapiens
  chr4:100729677-100729755
  hyper
gcacagccagtagggcgaatccacaaattaaatacacccgggggttgggggtggcgaggggagcgctagagtaaggct

SEQ ID NO: 91403 - DNA, 147 bp, Homo sapiens
  chr4:1008582-1008729
  hypo
gggaatcgggccagccgccccgtttccatctcggggccccactcctggaagggaaaataaatcactgtccccttggggggagggagggagccgtgaacaaagtcgcctttggctgggcctggaaacgccgaccgcagactcctttat

SEQ ID NO: 91404 - DNA, 627 bp, Homo sapiens
  chr4:101111245-101111872
  hyper
ggctcctaaaatgcccggcgtcccgggagcgaactagcggaggaactcctttgccaaaggggtggaaccggcctctgcaactcaatttgacaaagccctgggagcggagccgcaacctgaaactaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcacccctcccgggccaccctgcgccggctcctcgcagtagcatagcctccggggcagcgagaactttataggtccagtccccaccctgctcaggcccgcccacctgcaccgcccctccccggccagcgccccgcccctcccctccagagtctggtcccctttcaacctctacacttccagggagcccgagcctagccacagggagttgaggataagcctgtggtagagcggacacctgttgcttccagggtagatctcgggccactgggaccgcaattccgggtgcac

SEQ ID NO: 91405 - DNA, 97 bp, Homo sapiens; identical to SEQ ID NO: 29057
  chr4:101111873-101111970
  hyper

SEQ ID NO: 91406 - DNA, 35 bp, Homo sapiens; identical to SEQ ID NO: 40174
  chr4:1016331-1016366
  hypo

SEQ ID NO: 91407 - DNA, 499 bp, Homo sapiens
  chr4:1016612-1017111
  hypo
gttcagaggagccgccgggatgcgtggcctttctgttctcttctgcgcctggggcccgggcgctgggcttggacaggtgtccagagagacacgccctccatacctagggacccggcaccccgcctgctccgctgggctcctgggtgtggggccctcgggtggagctcctgggagctgggctggcccgtttcttttttttttttaattctactttaagttttagggtacatgtgcccgttttctgaatacaggagcctggcccaggccccagcagggtctgggggtgcggcctgagacagcctggtcctgggctcagtgaaggagcggctgtcacagggtggatggaggggacattccacagcacgccctgcccctcggcattgtgtggaatgggaaaactggctgtcccccacccccaccccacagtcctttcaaaggggacgatgaccgggtggtatgagagtctcgtctgttcaccagccctcggccccttgatgta

SEQ ID NO: 91408 - DNA, 30 bp, Homo sapiens; identical to SEQ ID NO: 40271
  chr4:10200240-10200270
  hypo

SEQ ID NO: 91409 - DNA, 30 bp, Homo sapiens
  chr4:1020713-1020743
  hypo
gcacgtgtgcatgctcgtgtgtgctcacat

SEQ ID NO: 91410 - DNA, 30 bp, Homo sapiens; identical to SEQ ID NO: 40177
  chr4:1022834-1022864
  hypo

SEQ ID NO: 91411 - DNA, 333 bp, Homo sapiens
  chr4:1024175-1024508
  hypo
gcctcacagtgtgcccggcccaggtggctgcctgggttggggaaggggctctcctgggggctggtggggcctggcgggtcctgggcctcagccacacaagacccaggcctgtgttccagggctctgggttgccgatgaattttaggtttgcattgcagtgcctgaggagagacgccagtccctgagaaacaccggctctgcccaggggccgcactcgccaccgttggcctcctctgctcggcctgtctctcccttgcctctgccttgggaggagtgtggccagcgaggggatgcaggtgggtctccccggaaggctcccgccactgtgctggc

SEQ ID NO: 91412 - DNA, 471 bp, Homo sapiens
  chr4:1025819-1026290
  hypo
cagctgctaggatcccggagccaggggctgccgcagggcagccctggatgtgccctcctgggcacgcaggccgacatggattctgtggctgaggccgtcagcgtgtgaaagccacagacacaggcgggcccggagtgcctgtccaccccgaggcgcctgccctggcccggcctctccttcctgggtgtcggaagaccttcatctatgcccctgccctgtacccgctcagtgggctgagcacgggcagggtgtggttctgaggggcaaccccaccagcctgcttgggccccagcgtcttctcagcgtctgcctcctgtgaaaaccttccactcagtaaaggagcacagtaggttggttgccgggccaggctgggggcacagtggctgctgggggccgaggcggctcctggggtgtgtcctctgggaagatgctctctgcctcagggctgggcgcagccgtgtgccttgtaca

SEQ ID NO: 91413 - DNA, 30 bp, Homo sapiens
  chr4:10319571-10319601
  hypo
gtgcagtgctgattgcggtcatgtcagcag

SEQ ID NO: 91414 - DNA, 24 bp, Homo sapiens
  chr4:103350988-103351012
  hypo
ctgaggcaggagaatcgcttgaac

SEQ ID NO: 91415 - DNA, 17 bp, Homo sapiens
  chr4:103399288-103399305
  hypo
ctagccaagggaagccg

SEQ ID NO: 91416 - DNA, 327 bp, Homo sapiens
  chr4:1036212-1036539
  hypo
ccacacatgcacacacgcacatctacacatgcacacccacacacacaccgacacacacaccgacacacacacctccacatacacccccgcacactgacacacccacacacacaccgacacacacacctccacaaacacaccccccgcacactgacacacacccacccccacacactgacacatccaccccccacaccgacacacacctacagtgacacccgcacactgacacacacccactcctgcacactgacacccactcctgcacactgacacacacccccgcacagacacacacccacccccgcacaccgatacacacaccta

SEQ ID NO: 91417 - DNA, 30 bp, Homo sapiens
  chr4:103658311-103658341
  hypo
ggtgaaggaagctcccggctgaactttgta

SEQ ID NO: 91418 - DNA, 66 bp, Homo sapiens
  chr4:1036897-1036963
  hypo
acacacacccaccaccgcacacctacccacacacgcgtacccacccacccccgcacacaacacaca

SEQ ID NO: 91419 - DNA, 27 bp, Homo sapiens
  chr4:103811714-103811741
  hypo
ggcttggtgcagtgacgacacacctgt

SEQ ID NO: 91420 - DNA, 30 bp, Homo sapiens
  chr4:103941455-103941485
  hypo
tgaaagaaatgaaagcggagctgcgttgat

SEQ ID NO: 91421 - DNA, 298 bp, Homo sapiens
  chr4:103997871-103998169
  hyper
agcttacccagagagcgcggacccaggcgccgagtcttcccggagatgacgagacaccgcgagaggagcacagcgcaggctcctcgggactccgcggcgcaggccgggcagcccgttacttgttttatcgttcccgaaaccaacctctaagttgtctatcagtcctccaccttttagctgtacctcttagaagtgtcttctcagctgcggtgggaagataggattctttcttaaggtgaccaattaaatggccggataaaagacttgttctgcccccctttatcgcttaacacctgcc

SEQ ID NO: 91422 - DNA, 30 bp, Homo sapiens
  chr4:104073705-104073735
  hypo
ataaaaagagttgtacgagaatgtttacag

SEQ ID NO: 91423 - DNA, 30 bp, Homo sapiens
  chr4:10412582-10412612
  hypo
caccactcggggaagcggaggctattccct

SEQ ID NO: 91424 - DNA, 955 bp, Homo sapiens
  chr4:10458372-10459327
  hyper
gaagaaaaccaaaaccgtcaacgctcagctccgaggcccgcaggaggctttaaaaatggcctcctgacgacacttcctgctcggcgcggacggtaggagccctcggaggaggcatccttcataacgctgggggcggggagcgcaggccgggccagcggcgccacacgaacggccccgcgggacgctgccacccccgcctcggtcgccccggcgcgtcggccgagtccgcggggtcgcggcgcacaaaggcgagctgggggcgccgggccggaccccgaccctaggccaggcccgcgtacctgctcaacgcgcgccaagccgcggcccgggcccccaccccagccggtgccccacgcccaccagccggagcccgcgttcggcctacccggtgccacttgccacgacgccagccctcagcgcgggcacgcggggccgcggccgctcgacccgccccggcctggccccgtcaggcccccgccccgcgcgcccccacgacccggccgcagctggcgcttcggtcacgtacacgcggatccgggggccctcgccctcccgctcagctacttacccggcaggccggattcgggtgccaggtcccggcgaaggggcgtctacaccgccggccgcagaccgccggcgccgcgcccgctgtaggtccctacccggggggcggagcccgcgccagccccgcgcgtgcgcaatgtgaagcggcggcgcggctccagcgaggccggcgcctgaggtctctaaggctgcgcccgcccccgccgggcttctaagctgtccagagcggggagcctcagacccagccgagccccacttctgggcttagagcttgacccaacacgttcgcaccgtagcgagcgaggtccacatttagccatgccgcaggcaaaagaaggattcggcttcggtcctggcccagtctgccatcccggggcgcctgccttgtacc

SEQ ID NO: 91425 - DNA, 273 bp, Homo sapiens; identical to SEQ ID NO: 354
  chr4:10462775-10463048
  hyper

SEQ ID NO: 91426 - DNA, 184 bp, Homo sapiens; identical to SEQ ID NO: 355
  chr4:10463072-10463256
  hyper

SEQ ID NO: 91427 - DNA, 280 bp, Homo sapiens; identical to SEQ ID NO: 356
  chr4:10463257-10463537
  hyper

SEQ ID NO: 91428 - DNA, 35 bp, Homo sapiens
  chr4:10501134-10501169
  hypo
tctttatgcagcctgcgcatcgatttcacacgtgt

SEQ ID NO: 91429 - DNA, 30 bp, Homo sapiens
  chr4:106046597-106046627
  hypo
tgctaggattacaaacgagatcttatattt

SEQ ID NO: 91430 - DNA, 147 bp, Homo sapiens
  chr4:106067073-106067220
  hyper
aatttcccagtttgtcgggtctttaaaaatacaggcccctaaagcactaagggcatgccctcggtgaaacaggggagcgcttctgctgaatgagattaaagcgacagaaaagggaaaggagagcgcgggcaacgggatctaaaggga

SEQ ID NO: 91431 - DNA, 15 bp, Homo sapiens
  chr4:106689465-106689480
  hypo
cgtaagtcatcgcgc

SEQ ID NO: 91432 - DNA, 47 bp, Homo sapiens
  chr4:106816754-106816801
  hyper
ccccaacctgttcctcgcgcgccactgcgctgcgccccaggacccgc

SEQ ID NO: 91433 - DNA, 30 bp, Homo sapiens; identical to SEQ ID NO: 40328
  chr4:107134495-107134525
  hypo

SEQ ID NO: 91434 - DNA, 30 bp, Homo sapiens
  chr4:1076633-1076663
  hypo
tgcgtctggcagggccgtggcctggctcct

SEQ ID NO: 91435 - DNA, 668 bp, Homo sapiens
  chr4:107955181-107955849
  hyper
aaaggatagctgaaacggttcacacttcaaagctctgggaagagttctggaactgcaaaactagcaaaactgcaaaattgtccccgtgagagggcagtagggggccaagcccgggtcttgtctctctgtccatcccagaatggctcggccctctcaaccaaccttcagccggctggctgcgctgtggacaggggcggcggaggacaccgagagcgcgcaaaacagcagcatcagtcggttccaaggaaactcggatctctggggcgtgggccgctgccaggggttgacacttgtgttgtgcgaggtgcgtgtgccattggtaaaatggctttctcagttttggcttcccacaaaaggagcggaagggggagctgtcatgattcccagtgcccacagagccccctctcctggccacagcgcgccagccacaactggtaccgagtgtgcgcgctcgtctctgtgcgtgtctatttgtataacagtttgcaagtggctttcaatctatctgtctgtatgacagagacagaggcgcctgcggaaagttccctctctcaaaaacgccttcagtgtcctgctgtatcgctggcgcctacgacgctgtcattgtcatctcatcattttgcttccttccgggtgatttatgtacaattctgcgtgagtgagaaatg

SEQ ID NO: 91436 - DNA, 948 bp, Homo sapiens
  chr4:107956414-107957362
  hyper
ctgtatctggggccacgctccgaatgttgcaagatgcaatggcaaaccgctagcccaagagagctggcccctgcctcttctgtctgaagaatgtgtttgggggttttcctacctgccccaggtttttgcccttcttactgccgccgaatgccagtccttggtacatgcccgcagatcgattggcggcctgaccaggcgtctccccgcccagagaggacttgatggagttgagtttggcccgcgaactgccgatctgtgagctctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtgacccaaggtgcaagaaaacccagccctgtggatcgcaccgcttccgttccttcttgccccgcacctccttggtcccgccgggatctcggcggtttaactctcctcttaattgatcaggaggcccgcatcagctccttctccttcaactcagttgcttttctctcctctcttttcctatcctttatgtgtcaaactttgcaggacacagtgctccttttcaaagttagcaggcgctttagtaggggatcaggagacgtccccggaccgaatcctcgagatctgaagagaatcgaggtcccccacacgcgcactcacagttgccccgaagc

SEQ ID NO: 91437 - DNA, 630 bp, Homo sapiens
  chr4:107957363-107957993
  hyper
ttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaagagtgacaaagagtgaaaatttttctctcactccccaccgcttccgcccccctcctctctgcgtgctgcttctgcttctgcggctttcactccagcttttcctcctcctcatcctcccgctctgtctccacccacaactactggaaaagggggatctagcttttccatgaggtgaatggaacataggggctcctaattcctgacaacaactccagcggttggaggggtctttggaaactggcagagaccaaaggtggaaacggagtggggcaagctgacaccacttgatcgctgccaccctttcttagatcttcccacccatcttcagcccctgactccgcgaggagagctggaaaagccctatggaagctttagagaagtgagcatctgcgcatctgctcattagtattgtgttctttgtgagctcacgtttggttttagac

SEQ ID NO: 91438 - DNA, 247 bp, Homo sapiens
  chr4:107958393-107958640
  hyper
attcctgtcagcccccgggtctctccaggtccaattcccttcggccgaaggtcgaaggctgctccgggaacgactgggacgcgctggcgcttgggggcgccagtggcagccgttcagcgagccacggaattgctgcaggagacaagcgctgagttcggtgatgtctggtggccaagtgcgagactttccaagcaaagcaagggattgttcgaaagttattgcatttctgcttcgcagacactaatgt

SEQ ID NO: 91439 - DNA, 33 bp, Homo sapiens
  chr4:107994285-107994318
  hypo
gtggcacttgcaggccagcgtgagttcggggtg

SEQ ID NO: 91440 - DNA, 30 bp, Homo sapiens
  chr4:108044889-108044919
  hypo
agggtagtgctgtgtcgaaaagaatgtgaa

SEQ ID NO: 91441 - DNA, 200 bp, Homo sapiens
  chr4:108302104-108302304
  hypo
ttgtcagctcttaatcgagcgtgttaaggataagagtcctgtctcccaggaagaaatcgtttacgccctctgttggcagcaggggcctgtcctcctttactctttagaatctagagggagaaagccaaaaaccaacctctctagaagggaaagaccggtgtctagacaacccacacccactaacacgtgggtctagatca

SEQ ID NO: 91442 - DNA, 30 bp, Homo sapiens
  chr4:108745720-108745750
  hyper
attgatctctgttgccgctcagggaggtca

SEQ ID NO: 91443 - DNA, 57 bp, Homo sapiens
  chr4:108746014-108746071
  hyper
gcgctgggcgcagggcgcagggagcgggccgcgcgcggcgggcggggagagcgggcg

SEQ ID NO: 91444 - DNA, 128 bp, Homo sapiens
  chr4:108746391-108746519
  hyper
agccctggccaccagcgggtaaggagcgcgcggaggggccaggaggaggatgggctggggagcggagagtcctccgaagcgcgggaggggaaaggtggattgcgaagcggggacgtggctctaatccg

SEQ ID NO: 91445 - DNA, 111 bp, Homo sapiens
  chr4:108853176-108853287
  hyper
ggtggtggtcctcagcgacttccacagcgtgcgcgaggcgctggtgcagcaggccgaggtcttcagcgaccgcccgcgggtgccgctcatctccatcgtgaccaaggagaa

SEQ ID NO: 91446 - DNA, 473 bp, Homo sapiens
  chr4:109087990-109088463
  hyper
aactagagttgggggcggtacagccagggtgtacccttgcggtgggtcggctcggcgcacccacagctcccagctgctagcccaggcgctggggccgcagggactgaaccccgcaccgcccccgcagcccgggtgcgcgccccatcggccggcctgctccccgcggcccggctcaccggtggtagggacggccccgcctgccccagcccacgcccgcctccccttcctcccgcctgtggctctgctcgtctccacctaagcctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaact

SEQ ID NO: 91447 - DNA, 645 bp, Homo sapiens
  chr4:109088669-109089314
  hyper
acccgccacgcctctcggaactggggcagcggcccgctcacctcgtgtccgttgctggccgggatgatttcagactcgttcaccaaggaagacttgatgtcagctaaatcgccttcctcttcgggatgactgatctcggcgaagatcttttccttctgaggatcgccctcgtccttgaaggggatcatctcgtccgtggcgcagagttccgggtcccccccgccgccgccacctcctccggagagttggggcatcccggcggctctgtaatctccgctccgctgtgggagcacccgcgcaacagcaggaaagacagaggggtaactcaagggtgggggaggaaaggagagttggaagggttcgtgcagcaggacagcgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgaccccgcgtcgccgggatttgcgcgcggagaacgccggtt

SEQ ID NO: 91448 - DNA, 50 bp, Homo sapiens
  chr4:109090370-109090420
  hyper
ctgcttataacccaccgaaaggcacgctttgcccgcgtgaaactgacaag

SEQ ID NO: 91449 - DNA, 122 bp, Homo sapiens; identical to SEQ ID NO: 29069
  chr4:109092563-109092685
  hyper

SEQ ID NO: 91450 - DNA, 1182 bp, Homo sapiens
  chr4:109093101-109094283
  hyper
gcgggggagaagagacggcctcgctgctcactgggtaagcggagcccagccccgctcgggagcgggcaggagagacagggtagtgacccccactcacaccagaaaacccctccccccggcgattttgctgccaactcgagtcggctacagacagtccagtgagtccttaattacaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtc

SEQ ID NO: 91451 - DNA, 55 bp, Homo sapiens; identical to SEQ ID NO: 29071
  chr4:109094529-109094584
  hyper

SEQ ID NO: 91452 - DNA, 184 bp, Homo sapiens
  chr4:109183797-109183981
  hypo
tccttctcttcccatcgctgccctgtcactagcaggtatgctgtgtcgtgtaagaaacagcacagagaggtatttcttgagacatataacatttctgcttaggtgataggtgatggccacactgttacttgctgatcacaaaagggcttaaaacagggacattaaatatcggaggaaatcgcgg

SEQ ID NO: 91453 - DNA, 16 bp, Homo sapiens
  chr4:109311251-109311267
  hypo
aataaaaacagccaac

SEQ ID NO: 91454 - DNA, 75 bp, Homo sapiens
  chr4:1093400-1093475
  hypo
caggaaaatcacaaacgaatgttttcttttcgtatttaatttttaaaaggggggtgtgtgcgccacaatggtaca

SEQ ID NO: 91455 - DNA, 506 bp, Homo sapiens
  chr4:109683609-109684115
  hyper
gtttccaaaaactttcgagttgtgtgggggtggcggagcgctatccttcttccacccatctcccatccctggaatggtgtctgctagggctattggccgtcatccaccaacccctctagccggccggcagcccccgctagtccgccggctgcagagcgagccggggactttcgagcgggcaggaagcccagcgttccgggttccaggagcgtttctgggagtccgcgcggcccctgcaggtggaggcgcgcggggcgcgtgcacaggcgcggcgggcacggagtgcggctgcagcgcatcgtttgttccctagccggctttctctctccaccttctgcactcgttattgccccctctctgcacttacttccgggccagggtgcccttacccgatgtgcttcttcctcagccccagagtgtcccgcttactgtacagctcgcacatggtggcggggtgcagggcgctgcgaaggtgcaaggtgcaaggtctgcgcgcctcctacgcg

SEQ ID NO: 91456 - DNA, 473 bp, Homo sapiens
  chr4:110222955-110223428
  hyper
aaggggcccctttggcggattcgagagcggcgatcctcgcctggaggtcgttggttttcacacccaggtacaggcaagacaccacggccaccactgacaggagggccgccaggacggcacacgggggcatggtccgggcacaatgctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtgg

SEQ ID NO: 91457 - DNA, 20 bp, Homo sapiens
  chr4:110223578-110223598
  hyper
cggaggaccggacctgttgc

SEQ ID NO: 91458 - DNA, 368 bp, Homo sapiens; identical to SEQ ID NO: 29076
  chr4:110223599-110223967
  hyper

SEQ ID NO: 91459 - DNA, 466 bp, Homo sapiens
  chr4:110223968-110224434
  hyper
cgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatctctactgatcttcactcaaaagcagccgcaggagctgttgctatctcgctgtggtgcagcgcttttccctcctc

SEQ ID NO: 91460 - DNA, 79 bp, Homo sapiens; identical to SEQ ID NO: 40332
  chr4:110735440-110735519
  hypo

SEQ ID NO: 91461 - DNA, 19 bp, Homo sapiens
  chr4:110735819-110735838
  hypo
gccccgcctacaaaggtat

SEQ ID NO: 91462 - DNA, 30 bp, Homo sapiens
  chr4:111215543-111215573
  hypo
ttatgtttggttaaacgtgtgaataatgag

SEQ ID NO: 91463 - DNA, 72 bp, Homo sapiens; identical to SEQ ID NO: 29078
  chr4:111531853-111531925
  hyper

SEQ ID NO: 91464 - DNA, 46 bp, Homo sapiens
  chr4:111531943-111531989
  hyper
cgcgcctccccttcgtccccaggccctggtccggggctcttgctgc

SEQ ID NO: 91465 - DNA, 216 bp, Homo sapiens
  chr4:111532245-111532461
  hyper
ccctcatttgtcctccgcttcctgcggctgaacggtccttgataagtggcctccagaagattcggtactttgggccaggggcaaggctggggctgctctaggtgcagaactctctataggtcctctctcccaggaccggatagatgattcatttttatacgtaacgttttaccccagtctattcccgcagctggttaatgttcaacccccgggcct

SEQ ID NO: 91466 - DNA, 495 bp, Homo sapiens
  chr4:111532704-111533199
  hyper
cgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccc

SEQ ID NO: 91467 - DNA, 32 bp, Homo sapiens; identical to SEQ ID NO: 29082
  chr4:111533328-111533360
  hyper

SEQ ID NO: 91468 - DNA, 30 bp, Homo sapiens; identical to SEQ ID NO: 29083
  chr4:111535304-111535334
  hyper

SEQ ID NO: 91469 - DNA, 413 bp, Homo sapiens
  chr4:111536093-111536506
  hyper
taataaaacaaaacccgaggataggccaaagataccgagagaagaaaaggtgcctgctagtaacaggtgagggatggaagggggtggcggggagaaagcccccagacggcggatcgtctgcgcggggttcctgccccaggcctggcgaacctctgagcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaac

SEQ ID NO: 91470 - DNA, 414 bp, Homo sapiens
  chr4:111536561-111536975
  hyper
cgaggggactgactgcaccggctctgggagctaggtttctctcgctggatgggaaaaggaggtgcggaaaggggcaggcggcctgcgggctagcggggatgagagttgtggggagaacggaggagagagtaaaattattccttttggaagtccaagggaagggagctgaggtgagagaaatggcctctcttaggtcccaagtctccgcccccagcctgcaccactcaagtcggggaagtgacaactcttcctaaacctcgacttccattttttgtttcctgcagattgattgatgtcctcgcgttgttctagttcagcaaccaaactaggccgaggtacacctcttttacccagagctcccaaatcactcaccaacctgcaggagacctaaatcctccgggcaggtctcgttag

SEQ ID NO: 91471 - DNA, 178 bp, Homo sapiens
  chr4:111537066-111537244
  hyper
cggagaggccgggaccgctgggccctgcggctccagaagccaaagtccgcccgtggggaccgttttcctctccactgctctcaagtgaacaacatggtgggaggtgaccctcgtccaaagggcttttatctgccccccactgctgcgtgatccctccgcaagtcggaggcagagcttt

SEQ ID NO: 91472 - DNA, 45 bp, Homo sapiens
  chr4:111537452-111537497
  hyper
ctctaagttccccagcgtggtgtttgttctcgcccactttggttg

SEQ ID NO: 91473 - DNA, 117 bp, Homo sapiens; identical to SEQ ID NO: 29088
  chr4:111539478-111539595
  hyper

SEQ ID NO: 91474 - DNA, 57 bp, Homo sapiens
  chr4:111539809-111539866
  hyper
tttctccatttggcccgacgattcttgaaccaaacctgggggcggttggggcaaggg

SEQ ID NO: 91475 - DNA, 458 bp, Homo sapiens
  chr4:111540186-111540644
  hyper
cggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtc

SEQ ID NO: 91476 - DNA, 537 bp, Homo sapiens
  chr4:111542809-111543346
  hyper
atttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttgggg

SEQ ID NO: 91477 - DNA, 293 bp, Homo sapiens; identical to SEQ ID NO: 29094
  chr4:111543403-111543696
  hyper

SEQ ID NO: 91478 - DNA, 4 bp, Homo sapiens
  chr4:111543720-111543724
  hyper
cgct

SEQ ID NO: 91479 - DNA, 214 bp, Homo sapiens; identical to SEQ ID NO: 29096
  chr4:111543967-111544181
  hyper

SEQ ID NO: 91480 - DNA, 409 bp, Homo sapiens
  chr4:111544298-111544707
  hyper
cgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaacta

SEQ ID NO: 91481 - DNA, 1098 bp, Homo sapiens
  chr4:111549751-111550849
  hyper
ggattacagggtattcgcctagatgaagagccattaattacccattcagtcaatattaggaagacgacaaagctttttacataggattaagaagacatcagattgttccattagtatattcctgctcacgaataagctttcgttatacatttccttttcccccgagccgctctaacaactgctgcatatattagcagcgggcggtgaggaataacagccgaaccagccttaagaaactttgtgtaccgagtcagcagcgaggaacgcgacctgtgaagaccacttttgcgggcagggatccgcagggactgactactttcggacaactggtacaatttcccctgggggtgaaaaaccacaacgcggcggggcacctttcaagtgagctgcagatttgattggcgcggggggtgggggaggggaggggagaatgggatggcggaggtcgggcggaggaaagaaaatggaaaactctccttacccctatttcgttgctttttcctcaagcctcatgcccccttcggcaagcacctgtcccttccgcgctagccacagctagagttctccacctttctctacacatccccttctttctgacaaggctcaggaccttggtcaccaccccacgcaccaccattttgcgttttgctagagacggtctgggctgatctcgctggtgtccatgttaggattaaaatcccttcatgacggcgaggaaaactgtattatttgctttcagggggtacattaggagtccacgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagccaggcgt

SEQ ID NO: 91482 - DNA, 139 bp, Homo sapiens
  chr4:111552072-111552211
  hyper
ctcctctagtctggccggagccagggctgagcccgcgcaaagcattctccccagaagtcatcgctgctcttgatttttaaccatatcccaaacatactacggtctaataatttatttttactaccgattatcaaacaga

SEQ ID NO: 91483 - DNA, 60 bp, Homo sapiens
  chr4:111552448-111552508
  hyper
ttcttcttagtaatacggtttgtttttttgaccggggtcccaaatcgcccccctccatcc

SEQ ID NO: 91484 - DNA, 1225 bp, Homo sapiens
  chr4:111552914-111554139
  hyper
tacttcaggcaggttcgcgtcgacaggggcaaacctccattctaccctgggctgctaagcacagtggctgccctccagctcttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactggcgatttggttctgatttccttcctgcccaggctggcccctcggggaagcgcccctcgctggggcctcgccgcagggccagtgccctcttgccgccctcacgtggcgcggcctcccgtccgatgacccgggcaggagaagggggttcttacctaattgcacacacgccgacaccagtttgcg

SEQ ID NO: 91485 - DNA, 30 bp, Homo sapiens
  chr4:111554631-111554661
  hyper
gacagcagtttccctcggttttctgtaatt

SEQ ID NO: 91486 - DNA, 15 bp, Homo sapiens
  chr4:111554950-111554965
  hyper
tccccctttctctcc

SEQ ID NO: 91487 - DNA, 603 bp, Homo sapiens
  chr4:111555193-111555796
  hyper
cgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 91488 - DNA, 815 bp, Homo sapiens; identical to SEQ ID NO: 29104
  chr4:111557628-111558443
  hyper

SEQ ID NO: 91489 - DNA, 753 bp, Homo sapiens
  chr4:111558498-111559251
  hyper
cggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 91490 - DNA, 556 bp, Homo sapiens
  chr4:111560186-111560742
  hyper
gggggaaaatgcccacgtgctgtttaattgtatttcctctctgactctgagaatttctatttctggtttttgaaatctcgccgaggcaagaaaatcaaatttcttcaacaagtcccacaactgaactctagttacaggacaccggaaagtgcagtccgagaaagacatcttcacctctgcccatcgacgatttttgcagcctccccattcctctgagtaatgggctaataatcctccctttttttcttttcattttgtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtctggagtctcgcccgccagaggct

SEQ ID NO: 91491 - DNA, 35 bp, Homo sapiens
  chr4:111562342-111562377
  hyper
aacagaccaatatctcgcactcaaaacggagtttc

SEQ ID NO: 91492 - DNA, 199 bp, Homo sapiens; identical to SEQ ID NO: 29110
  chr4:111562491-111562690
  hyper

SEQ ID NO: 91493 - DNA, 30 bp, Homo sapiens
  chr4:112059654-112059684
  hypo
agtttaatgcctcatcgttgctgtgatctc

SEQ ID NO: 91494 - DNA, 209 bp, Homo sapiens
  chr4:112244823-112245032
  hypo
tcctgacatagttatcggtttaatcatgcattcctttttgttttgagtagagaagtgctgttaatgttttcgatgtgtgttggttaggaattcatggttcggaacctgtcatattgctaacaattcaattttggacataagttctgagtctcatttttcatttggagtacagagatcattttcatttctgttaacgtagctagttttgt

SEQ ID NO: 91495 - DNA, 198 bp, Homo sapiens
  chr4:113154853-113155051
  hypo
ttttcatggggtctccgtagagtacggcattaaaattgtaggttctactccctcagctcgtgagcttggcagcacagggaggtggcaggaggaaatccatgaatcagcgtgagtgttaattgtctgtagatatgccataaaaacataagcaggtggagtatttctttctttttttttgagacggagtctcgctctgtc

SEQ ID NO: 91496 - DNA, 164 bp, Homo sapiens
  chr4:113199029-113199193
  hypo
ttcatccatttctgtcggagaactgctttgggaggagcagagcgaataagtgccatactccggtatgggcctgtgtggtggccagttgttttcttgcaagagtgatcttggagataaaataaattgagtctcaaaaaattccaatgactcgccatcttccttct

SEQ ID NO: 91497 - DNA, 539 bp, Homo sapiens
  chr4:113430619-113431158
  hyper
ctccaatttggatcccgggaggccgagcatctctcacgcggttgacacctctccaggctggagcgcgaagccggcgcctgcccgggtaatcagggaggcctggcctttcacgcggtgttctcagtcagtaatccaagttggcatttcccccttcgcgctctgagcagctggagaagcagagaatgctagcgaaagcagacagaaccacccctgtctcccctcccccgaccctggcaccgagagggggaaaaaagtcgtttgttgtaacgcacacaccatcaggattcttccccattccatcctcccgactcacgccaccttgcagggaaataataggtccggccacactggctttcgcgttctgctttccggatgactgaatttctttgctcgcctctcctgtcggggaccatctgaaactgcctccaagctgcgttcccagggaaccccccaacccccactcattccactcggggactaaagagcgactcacttcaacgtcctccataagatgaaccccatcccggctggaaaaatca

SEQ ID NO: 91498 - DNA, 132 bp, Homo sapiens; identical to SEQ ID NO: 29113
  chr4:113431723-113431855
  hyper

SEQ ID NO: 91499 - DNA, 240 bp, Homo sapiens; identical to SEQ ID NO: 2445
  chr4:113431915-113432155
  hyper

SEQ ID NO: 91500 - DNA, 278 bp, Homo sapiens; identical to SEQ ID NO: 29115
  chr4:113432226-113432504
  hyper

SEQ ID NO: 91501 - DNA, 91 bp, Homo sapiens; identical to SEQ ID NO: 29116
  chr4:113432518-113432609
  hyper

SEQ ID NO: 91502 - DNA, 33 bp, Homo sapiens
  chr4:113435442-113435475
  hyper
ctgcaccaagtccttcggcgttaaagagaaagg

SEQ ID NO: 91503 - DNA, 811 bp, Homo sapiens
  chr4:113435774-113436585
  hyper
cccactaaggcctggcgtgggtagcagaaatggcagctctagatacaatccctggctatggggaggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtggggagcacctcgcgcagcgcgtccagtgccgcgttgaggttgtgcatgcggtttcgctcgcggttgttggccttcagtctacgggtcttcttgatgcgctgcaccgtctcggccgtcttggcgcctcgggagacggcccgcgcccgggaagggcgccgtttgcaatcgtgtaccagacccagcagccgtgcgggccggcagccctccgcacccgcagccacgccgccccgcgccccctgcccggcctcagccccgcgctgccgacgcgccccgcctgacgcgcccggctcctcctcctcttcttcgtcggcgctggatgacagcggggtcagggccgccaaggcgggggaggccgatccgagcagcactaaca

SEQ ID NO: 91504 - DNA, 488 bp, Homo sapiens
  chr4:113436827-113437315
  hyper
ctgctgccagtcagccgggtcctgccctccgcgggcggtcctgcgttccctccccgagaagggactgcggcctccgcgacaaagattctgcgcggagcagagggcgtgcgggtgtggttggactgagtgcggggaaaccacctgcgtagttggaagcggtggctcgaatacttacttagttggctctaactgtgcctcagcgttgctgtgactttggcctgtgccgggaatctccgcgcagctgcgagcgcagcgccgggtccttcgcccggcgtgaaagctgcaagcccggcgctactgtggcgcagctccgcgggggacctctgcgaccggcgagtttgccaagagccccggcggcggcggcggcggcccgcccgggtctcgtgtgttgtggtggtggtgcgtgtctgtctgtcagtcagtccctggccgtgcggctcctggcacgcgactcccaggcactccagttaacgcgaagctgcttgtgg

SEQ ID NO: 91505 - DNA, 656 bp, Homo sapiens
  chr4:113437622-113438278
  hyper
ctcctgttggagctccgggctgcggccggagctggcgaagccgcagcggccgcagaggctcaagctgcggctgttgtcgccgccgctgtccattgtgattggtggctcgcgctcggctggagcgtgccgctaatttattaatgaatggaggtcgcgaggcgcagctggccaatcagggcgccctggactccgggaggcctgcgagccacgcgcaccggagcccgctccctttcagcagctcattaggggcccgagcgctgggggcggatggggggacccgtgctaccgcccccgccttcgtcctcgctgccgccgaggctccccccgcccggcgcgcgcgcaggcaccgcacccggcgctgccggccctcctaactcccgggtgatgggaactaggaattagttaatgggggtcagaatcccggggaaagcagttagccctgtggtgctgccgggcgtctcttggcaaagcctcttaggggttgtatcaaatagtaaacgattttaaaatggattcatttggttaggggaggagaatggcgtggatggagagatgtggacacctcgtgaacaagtgtgtttggggtccgtcgaaactggcgtgggagagtgaagggagaggacactggggattcaaacaggcgtctcttgggaggg

SEQ ID NO: 91506 - DNA, 198 bp, Homo sapiens; identical to SEQ ID NO: 7510
  chr4:113438506-113438704
  hyper

SEQ ID NO: 91507 - DNA, 662 bp, Homo sapiens
  chr4:113441524-113442186
  hyper
attccctccacacttcgacctcacaagttgcgaaagaggacaaatggtcgccgcgctagtcccttgctgttgcaggtgactgtcgggggcgcgaaagagggcgcccttccctgagaggacaaaagccaaggtttggctatccagcgagcctgtcccccaattcacagtaaaccaccgtcggccaaaggagatggcgtgtctactctctgctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcc

SEQ ID NO: 91508 - DNA, 306 bp, Homo sapiens
  chr4:113442246-113442552
  hyper
cgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatccccacctgctctggggaaggcaaagctccgcagacttcttatccctgaggcaacccgctacccaaatgtc

SEQ ID NO: 91509 - DNA, 178 bp, Homo sapiens
  chr4:113442754-113442932
  hyper
aaagagagcactaatcgctgaaccaggagacaaacacgattaccagctccgagccttgagtcagaaagtctcatagactttaagatgttaatccccagcataatccttcctttggcgtgtaggaatagtgcagccacaagagttgttttgttatttatattggcgtttaataaaactc

SEQ ID NO: 91510 - DNA, 293 bp, Homo sapiens
  chr4:113444002-113444295
  hyper
gaaaaaaattgttttatatatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataac

SEQ ID NO: 91511 - DNA, 152 bp, Homo sapiens; identical to SEQ ID NO: 29124
  chr4:113444296-113444448
  hyper

SEQ ID NO: 91512 - DNA, 500 bp, Homo sapiens; identical to SEQ ID NO: 29125
  chr4:113444944-113445444
  hyper

SEQ ID NO: 91513 - DNA, 41 bp, Homo sapiens
  chr4:113559124-113559165
  hypo
agcttctcaggaaaacgtgcatgtacctattaaaacatttt

SEQ ID NO: 91514 - DNA, 101 bp, Homo sapiens
  chr4:113559405-113559506
  hypo
cgcgccactgcactgcagcctgggccactgagagaggctgcgtctccaaacaaacatttttcatataatttcctcaggagaaattacgaaatacttttaaa

SEQ ID NO: 91515 - DNA, 30 bp, Homo sapiens
  chr4:113626216-113626246
  hyper
aggtcggcccctgtgcgggatttatgactc

SEQ ID NO: 91516 - DNA, 469 bp, Homo sapiens
  chr4:113626447-113626916
  hyper
gcgtgaaggacacaccgtttgggacacttcatccatcagcccacatccgacaggggttgaggtcccggtggcatttcacaccacgttctctccgtaaatgaattcccccttatcaatagggagtagttggcagaacaaagaatgtgtgcgcgtggaggctagaggtgggtgggtgggtgggtgggtgccttagcacaactccagcggagagtgagtgcggataggaaatgtgtgtatggcatgaatggaaagagccgagagtgagtgtggagatgggcagggaagagctggacgcgccccaacagccaggggcctcccgagggaacgtccgccagtgatgcgggagcgcccgcggaggagcctccttctccccacccacctcccgaactccggcagtcagtggtgcatatagacatatttctgggagctgtccatgagctcatggctctcctggcgatagcggcagcgg

SEQ ID NO: 91517 - DNA, 97 bp, Homo sapiens
  chr4:113627374-113627471
  hyper
tgggtgcacaaagtgcgggaggggcgccggcaccccattgtcctcgcgtcccccaagggcggggacctcaaccccaatgcggcggctcccctaggag

SEQ ID NO: 91518 - DNA, 30 bp, Homo sapiens; identical to SEQ ID NO: 40338
  chr4:114176916-114176946
  hypo

SEQ ID NO: 91519 - DNA, 30 bp, Homo sapiens
  chr4:11428999-11429029
  hyper
gggaggagaagagggcggactggctccttc

SEQ ID NO: 91520 - DNA, 145 bp, Homo sapiens
  chr4:11429558-11429703
  hyper
agaggtcaagctccgcgaataagacccttcctgggagctggggtctaggcgttccaaccgcgggttcgcaccccgccatccctcacctccatccgctgccactacccaagggcccggaaatagaaaaccacgaagggggaaaaaa

SEQ ID NO: 91521 - DNA, 48 bp, Homo sapiens
  chr4:11430659-11430707
  hyper
gctgcccggcccgctcgggtgccgcccagagtccggcccgctaggtgc

SEQ ID NO: 91522 - DNA, 64 bp, Homo sapiens; identical to SEQ ID NO: 29128
  chr4:114900586-114900650
  hyper

SEQ ID NO: 91523 - DNA, 373 bp, Homo sapiens
  chr4:115519455-115519828
  hyper
cttgatgataaaaggcgggcacagggactacgtgggtggtggcagaaagggcgcgggacacgcctcgcaaagagggaagagtgggcggggccacgtgccgttgtcagagttcgcaactcgagcgcccagagggctcgcgaaaagtcccagcctgcaagccaacctcgctcagcggacgactggccggatcccaacgcgctgccccttgcccagcctgcgagcgcgtggtacgaaggcgcgtctgcatccatgccccagcccggggagctggaggcgctcgcagtcagaggcgagtgatgctaggctgagcgcgtggcggcccgtgtcgtgccccgctgagccaagtgcggaagggcagcggcgcgctccgact

SEQ ID NO: 91524 - DNA, 94 bp, Homo sapiens
  chr4:115520056-115520150
  hyper
aggtcccttctgtcccggatacaattacgcggcagacacacactcaaactcgcgcggggcagccaagagacgaggtgagcggagggaccacgcc

SEQ ID NO: 91525 - DNA, 571 bp, Homo sapiens
  chr4:115520374-115520945
  hyper
gcccctcatagcgcccgcgatcctgtttctgccatatggcatccgttcgagggttctctcgcgtttgtgcgctcaaggcagagggagggtataacggggaggcgattcggccgaggaccttgtacttgacccctgaagggatgggcaccgcggagcccagaggccagagccagctgccagggcagggatggaggtgggggaccaggaggagcttcgggacctcttcaactcccctttactccgtcttccccctaaggaggaacaagagcgggatgtgttgggggtggggaatgtcttggggctgtacaagctcgctgagacttttcggggcccgccgtttccgcgtgcccgcgcgactctcgacaatggacagtgtacagtggtggcagggtttcacgggtccccgcgccgatttgggaatggtacggggtgcccttgcattagagaagcctgtgcgggcccccgggattagagaagaggtgagcgcctgcgggcggggagagaaggacgcgctgctggcaaaaagaagggcgccttccatggactggaggagcggcgagggagcctggta

SEQ ID NO: 91526 - DNA, 25 bp, Homo sapiens
  chr4:116217409-116217434
  hypo
cccaaagtgccgggattataagctt

SEQ ID NO: 91527 - DNA, 234 bp, Homo sapiens
  chr4:1165449-1165683
  hyper
cgtgagcgccccctgcccccaccgcatccccggaaccgcacaccgcaggcgctcggcaaacattctggtgttagagtctcccgacgtcagcacgccccagactgggaagcgccgccgtgcagctgtgcggggggctccggcgccgcagccctcctggtggagcaggaggcgaggagggggctgtacttacccagcagcgaagaccactgcgcaggggggcggaacagggggtac

SEQ ID NO: 91528 - DNA, 369 bp, Homo sapiens
  chr4:1165990-1166359
  hyper
cgcaaagctctcctgcggtgcttccgagacccccatcagcggaatggacggcgcggggttagatcgcccgtgcgcctgcgagcgaccaggggtaacgggcaggttttcagtccgagtccctgcagcttgccgggccggtctgggtgcggcctccgggatgccttcgccgtcgcagggacccggggccttggccgactggctgcccccgggactagacccttaaagctcggtcgcagccagtcctgggggtccctctggaggtgccacaaggttctgggccgcggggaaagtgcaggaggcccgggccctctctgggtgtcccgggggcacgcagtactcacccggcaggagcagcgggagcgcggccgg

SEQ ID NO: 91529 - DNA, 19 bp, Homo sapiens
  chr4:117179151-117179170
  hypo
ctcacgctgggagctgtag

SEQ ID NO: 91530 - DNA, 30 bp, Homo sapiens
  chr4:11781107-11781137
  hypo
gctgaattctgtgaacgtatccagtcatcc

SEQ ID NO: 91531 - DNA, 57 bp, Homo sapiens
  chr4:117847229-117847286
  hyper
tccccagggcggccccgcgtccgggcggctctctgaggctacgcggtgcccggtgtc

SEQ ID NO: 91532 - DNA, 153 bp, Homo sapiens; identical to SEQ ID NO: 7517
  chr4:117847306-117847459
  hyper

SEQ ID NO: 91533 - DNA, 39 bp, Homo sapiens
  chr4:117847469-117847508
  hyper
cgggcccgctcgtcctgggactaacgaagcaaaggcggg

SEQ ID NO: 91534 - DNA, 79 bp, Homo sapiens
  chr4:1189021-1189100
  hypo
tcaatgtcccactcccgcatctcctgcggtcccagggcgggtcccgctggtgtgtggccggcctcgcaggaaccacttc

SEQ ID NO: 91535 - DNA, 80 bp, Homo sapiens
  chr4:118954370-118954450
  hyper
tttgaaaaaaactggcgaacagaggaaactcttgcagcctcgcagccgccctggtccagtgccaacggcaggagcaccac

SEQ ID NO: 91536 - DNA, 120 bp, Homo sapiens
  chr4:118955005-118955125
  hyper
gggagcggctgaggccgaagacccgagggaaggaggagcccgcggacggctgcagccccaggtaatctccatggaggacggggccggtctcctcgcccagaaacccgatccgggcgcctt

SEQ ID NO: 91537 - DNA, 61 bp, Homo sapiens
  chr4:118955468-118955529
  hyper
gcatctgtcttcccccgaagtggtaccaaagccggtcccttggcgacgggtcttgcatgtg

SEQ ID NO: 91538 - DNA, 71 bp, Homo sapiens
  chr4:119273444-119273515
  hyper
gcgccgtcggggctccgacaaaagttgtggcgctgtcctcgcagctgagcccagctcgctgggggcgaccg

SEQ ID NO: 91539 - DNA, 166 bp, Homo sapiens
  chr4:119273737-119273903
  hyper
gtaataggggtagtgcggacccgcagggggcgaatggcggtggctgtggtggagggaatcattgaggacagaatcaaagccgaccacttcggggagcgcccctaacatcagggctagcacgaagcgggcgagcgtcatggtgccagcgctgcggggtctggtccat

SEQ ID NO: 91540 - DNA, 110 bp, Homo sapiens
  chr4:119274104-119274214
  hyper
cagccgagccccggccggcggagaggaccggaaaagagaaggcgcggacgcagcggggagcggttgggcctgagccccaggtagcggcgcaggcacgagcccgggaactc

SEQ ID NO: 91541 - DNA, 147 bp, Homo sapiens
  chr4:119483379-119483526
  hypo
ctgactatggctgggcgtgggggtagaagtgggaggttaagagttacgattaaaaggcacagagttttcttttggcatcatgaaaagattcaaaattgattgtggtgatgcttgcactgctgtgtaaatacattaaaaaccattgaa

SEQ ID NO: 91542 - DNA, 30 bp, Homo sapiens
  chr4:1200560-1200590
  hypo
aaccccagtctaaggcgaaccccaggtgtg

SEQ ID NO: 91543 - DNA, 30 bp, Homo sapiens
  chr4:1200921-1200951
  hypo
gaggctgacctgggacgccagggctgctgc

SEQ ID NO: 91544 - DNA, 157 bp, Homo sapiens
  chr4:121843147-121843304
  hyper
acggcctgcgtggagcggcgctctgggctgctcctcccatccccgcatggaaagttaggcgtttctagccacattaattcatcctaaaggaaaagaggcgacagcggagcagcgtgcgcgcgggggaaaacacccgcccacgcgtgccttcgccaac

SEQ ID NO: 91545 - DNA, 167 bp, Homo sapiens
  chr4:121843564-121843731
  hyper
gaccggggtgaagcccgccgcgccccgggccctgcggcagggcgactccgggaggcacagggcgcgcgaggtgcaggggcgcgcaggccgccgccgggtcacccacctttcgcactctgcgggccgtgtagagccccatgccgtcctgaacccgggaggacttcagg

SEQ ID NO: 91546 - DNA, 199 bp, Homo sapiens; identical to SEQ ID NO: 29138
  chr4:121844007-121844206
  hyper

SEQ ID NO: 91547 - DNA, 30 bp, Homo sapiens
  chr4:121844427-121844457
  hyper
ctttgctttttttcacgtttgttgcagagg

SEQ ID NO: 91548 - DNA, 648 bp, Homo sapiens
  chr4:121992048-121992696
  hyper
acagctcagagacagcgtagaggtgcccgcggcaaactccgaggagctgatgcggggcgggtccggggaactgccgggagctctcacgcctgggcctgggatagggtgcgggcagaaaggtgaaccgagagcgcacaatgcaacgaaaccgcactccaaattcagcagtttgcaaagtgcctccaagaaaacagctgggacctgcaatcactcgttcggactcctaggttatcggggccgcggcgactccgctcagttagaaaggtagcgcgggtgagagcgaaccccaactcacgcacagacaggacgagggcacgaagccgagtctcctggctggggccgtagggggcgtcacctcggtggccgctctgctctccggaagaaagtatgagccggtcccaggccacctcgctcagcccaaggaagtttctataacgatgctcgcctaccacgcagaggacaaatgaggagccagagcggttgggggtcgggccaaccgaactcccggccccggctgcgcagctcccagacgcccaccaagaactcgtgcgctgcctggacctctagcttttcgccctacacgcagacgccctctgcaaaaccccagtcccgcagactttccctagcggcgggcggagggcatgaacc

SEQ ID NO: 91549 - DNA, 524 bp, Homo sapiens
  chr4:121993212-121993736
  hyper
aatagtccacgtccccggaccctgccaagatgctaagcaccaatatccaggaacgagaagcctggagggcggggacggaggcagataaaagagaaaaattcaatccgctgaagtgtcccaactttgcggtcggcacagcaaacttcaaaggcgggcgagggcgggcggcgcgcggtcgccgaagttgctgcgaagtggagtagggagccgcgcggggctggggaatcccggggcagcgccgagaagcggcgggaggtccttttaaactgcagggagcgtgcgggggctgggcggcgggaggatgccgcagcgacccgcggggctggcgcgggcttcgccggccgccgctagtcgcacaggcgcctggctggagcgccgcgcggggtgctgggagagccgggcgcacggggcggcagcggccgtggcgggtgcgctgctcagttagctccactctctcgcggctggaagtggggagtgtgtgttcgctcccgagtgtcactgctgaagcccggagtctcttcccc

SEQ ID NO: 91550 - DNA, 359 bp, Homo sapiens
  chr4:121993995-121994354
  hyper
cccaaacaggaccctcgcgggcggcatcgcgagggacacgctgctgtcctaaccttagcgccactcggggagaatgaaggaggcccaccgagcccccgacaaagctgcaaaacccaggagacgcgcacgcgggaccatcacactgtcaagcagaccggggtgcacaatagagggaaactctggggttgatctgggggcagggagggggacgtgttaaatccagaaggttggtggttggaggcggaaagcagagtgtgcaaactgtgcattcatgtcccacttttcacccgaacgcctgcctatcacagccttcactcagggagcgcttccccctcggcgcagaccgagcctcctccgat

SEQ ID NO: 91551 - DNA, 21 bp, Homo sapiens
  chr4:122144242-122144263
  hypo
agccaccgcgcccagccaggt

SEQ ID NO: 91552 - DNA, 291 bp, Homo sapiens; identical to SEQ ID NO: 29142
  chr4:122301422-122301713
  hyper

SEQ ID NO: 91553 - DNA, 383 bp, Homo sapiens
  chr4:122301962-122302345
  hyper
cgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctggggtgctggagcgccacgcgagggtcctggcgcctctggctccccgccttctggccatgcgatgcggacgccggacccgcttggggagcggtggagggtggggctgaactcggtgacgcctccctcacacccagcttcagtggcgccaacgccgcttccccgcaccctcagggcgagggaagacttccctggctcaccaacttgctgccgcccagcgcctttctcagggc

SEQ ID NO: 91554 - DNA, 72 bp, Homo sapiens
  chr4:122685819-122685891
  hyper
tctcgaagagcacagcgccagcccagaccccatacacccaccgtccctggcacccgaacgcgctgcgagccc

SEQ ID NO: 91555 - DNA, 340 bp, Homo sapiens; identical to SEQ ID NO: 29145
  chr4:122686113-122686453
  hyper

SEQ ID NO: 91556 - DNA, 232 bp, Homo sapiens
  chr4:122686454-122686686
  hyper
gcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaattaatt

SEQ ID NO: 91557 - DNA, 2006 bp, Homo sapiens
  chr4:122871189-122873195
  hyper
aaaaccttagggagacggggaagtgagctggtggcgctttcatcccaaaggatataccttccctccatttcctgggccgtttccattccacgcttatcttcagcaataactgaaccacatcgggatgcgtcgctcatttaaaatcagaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgtctcgcactgattaaaagctgtctccaagattggaaattaagaaaagttgctctttctcatgcattagcgcgccgaccgctccttcgtttagaaagagagagagggaaagaaagaaagagaaaaagagagcccgcgcgccggggcgcgagccgctgaccctgcaccgcctgggaaccgcagtcaaagttatcactaaagcggttccccggctgcccgatgcccactctctccctcaggggaccctatagggcttcggttccagttttaccccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcctccggccgaggtctgtcccctccaaatcactccaaatcgaactgcctggccgtaccatgtgggtctcggaggtcccgggctcgacgtggagccgcccggcgcgcgccttcccgccccccgcccggcaccgccctccgaggcgcgggccgcggccgggcccggtactcacaggtccggcccgtgggagaagggcggcgggcagtagccgtgcggctcccgctgcgagggcgccgagcgcggctccagccccccgttgacgcccctccagccccggcggcggcgctgcggctccgcgccctcgtcctcgccctcgtcttcctcctcctccggcgccgggaaggtcacccttgcttgttctttgcacttcctgaccttggtggacatcgcgccggctgcggtccgagtgtgggggtgccggctgccggcctcctccgccttcgcggcagtgcagtcttcccgcggcgccccttcaccacctcccgcggcttccggggccccgggcggcccagggcgggaaggcaggagcggagagcgtcgcggcccgcgatccagcagttagaggctagcgccgaagccgagctgccgccgcccaccatcaaaccgtgggagcagctgccgcggccgtggctgcgacgaggaagcccggggccgagcggggctctggtgctgggagaggctctccagccccgcggcggcggcgatgcctcctcggcgcccgtctcctgtctccgacagcatcacttg

SEQ ID NO: 91558 - DNA, 30 bp, Homo sapiens
  chr4:123505042-123505072
  hypo
gcatatttagagtctcggaccgtgaaagtg

SEQ ID NO: 91559 - DNA, 30 bp, Homo sapiens
  chr4:123591397-123591427
  hypo
tgcccggggtgcttgcgtgccagtgcgagt

SEQ ID NO: 91560 - DNA, 69 bp, Homo sapiens
  chr4:123664094-123664163
  hypo
cagaatcagcctgtgcgaatagttctcattgagggtgacctcacagagaattaccgccacctgggattt

SEQ ID NO: 91561 - DNA, 1268 bp, Homo sapiens
  chr4:123747725-123748993
  hyper
atgccaaagccctgccgcggcctccgacgcgcgccccccgcccctcgcctctcccccgcccccgactgaggccgggctccccgccggactgatgtcgcgcgcttgcgtgttgtggccgaaccgccgaactcagaggccggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacagtgagtgccgacccgctctctccgcctcatttccatttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacaggaaggaccgcagcagaacgaaacggtctttactggaaaaacacctttctagagtcctgcccttaaattccgactcgggacgacccgaggcatatggcac

SEQ ID NO: 91562 - DNA, 137 bp, Homo sapiens
  chr4:123866916-123867053
  hypo
gagctgttcctgttcggccatcttggctcctccccgaactttttgttttttactgtctagtggcagaaagtaaatatgtgaaaataatataaaggtttggcactaagtcacttatatactaacgtgttagtaatttt

SEQ ID NO: 91563 - DNA, 154 bp, Homo sapiens
  chr4:124320676-124320830
  hyper
gcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttg

SEQ ID NO: 91564 - DNA, 17 bp, Homo sapiens
  chr4:124335280-124335297
  hypo
acaatgtttgcaggccg

SEQ ID NO: 91565 - DNA, 185 bp, Homo sapiens
  chr4:124426676-124426861
  hyper
caggctgtgtacacccgcaagtctggaagggtgatgatgatgatgtgatgatgagttagggcaattataactacggcaaaaaaaaaaaaaaaaaaaaaagagttcgcagggacgcagcgctgccgccgccgccgccgaggccgcgaccacggcccgagccggccaccgcgcgtcaaaggagccat

SEQ ID NO: 91566 - DNA, 67 bp, Homo sapiens
  chr4:124427070-124427137
  hyper
tgtagtcaggcagaacgctcgacaggaaggaaggaggaaggggcgctctgcgcggccattgtctggg

SEQ ID NO: 91567 - DNA, 30 bp, Homo sapiens
  chr4:1256143-1256173
  hypo
gtgatctctctcattcgggctttcctttgc

SEQ ID NO: 91568 - DNA, 67 bp, Homo sapiens
  chr4:125633717-125633784
  hyper
cactccaactgcagccgcctcctccgccgggcccggggcacgctcccagctccggatcctcctcttg

SEQ ID NO: 91569 - DNA, 291 bp, Homo sapiens
  chr4:126235709-126236000
  hyper
agcataacaacctaacggtcttcccccagaccctgccactaaagttatttatctgcaaacctgaccccacccccatctattctgcggcagccttttgctgttattgctctgacgccggccaagatttggccgaaaaggaaaaaaaaaaaaaaaaaagaaaagaaaaaaaatcacccccctttttagcgcctccgcctcgctgtgctcccacaccagaccgcctacagccctccgggaggctgaagtgattagcatcccgagaagccagtcggaggccgggcaaggcggagg

SEQ ID NO: 91570 - DNA, 210 bp, Homo sapiens
  chr4:126236242-126236452
  hyper
gtgtgcatgcctgtgcggcggggaaggggcggggagagtgtgagggaccaggcgggaggtggagaagggctcgcggagccctagctccaccgcagtccaaccttcggccccggccggcgagagggagagcgctgacaggcgccgtccggagctgcggagggcgtcactacagcccagcgccgacttcgccgcctccgctgccaactgtga

SEQ ID NO: 91571 - DNA, 346 bp, Homo sapiens
  chr4:126236714-126237060
  hyper
taatgggtcggcaggcgccccggcagaggtgaaaaatgccgaggagccctggctgttgtttgtgccggaccacgggcttgaagccgcaacaggggcggcggcggcggcggctgcaggaggggaaggggcagagttgagcgctcccgggtacgggagccagagcgcgaacgctagcgcttggaacgcagttcccgaactgcctgcgcgcagacgccgccgcctgggcctcagcggccactgccggcgccctgttggaggggcgttgcagcctggtttttgaggagtggggactccaggaattccatcgcctccagcttttgggaaagaaattcgattctcccggttc

SEQ ID NO: 91572 - DNA, 32 bp, Homo sapiens; identical to SEQ ID NO: 29153
  chr4:126237355-126237387
  hyper

SEQ ID NO: 91573 - DNA, 754 bp, Homo sapiens
  chr4:126237654-126238408
  hyper
tactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccgcagtaccagctcctggttgaggtggaggacaagggtgagcctaagcggcggggctaccttcaggtaaacgtgactgtgcaagacattaatgacaaccccccggtttttggcagttctcactaccaggcgggggtgcctgaggacgcggttgtgggttccagcgtcctccaggtggcggcggcggacgcggacgagggcac

SEQ ID NO: 91574 - DNA, 30 bp, Homo sapiens
  chr4:126444051-126444081
  hypo
tccagggaagattatcgtcccactccatca

SEQ ID NO: 91575 - DNA, 30 bp, Homo sapiens
  chr4:127173962-127173992
  hypo
cgaaggcatgatgtacggaagaagtaatga

SEQ ID NO: 91576 - DNA, 31 bp, Homo sapiens
  chr4:127411324-127411355
  hypo
ggtgcgccgggtcccccggcactgctggccc

SEQ ID NO: 91577 - DNA, 72 bp, Homo sapiens
  chr4:1282473-1282545
  hypo
taggaaggtcaggaacgctgttacggggagcagggttagaatgatggggatatagcccgggaaggggcagag

SEQ ID NO: 91578 - DNA, 388 bp, Homo sapiens
  chr4:128544016-128544404
  hyper
ttcctacactgggggcggcgcctggacgcgggtgtccctggccaaggcggcctcgctgtcctggaagggagggtgaagagctgcatcccgcactaggcggcgaaagagggcagcgccaagcggcggggtccggaggcgctcgacggctcgcgcccagcgccggagacgggctgtgtgttgggccagtggaagacaccggagaaacccagacgtggaagaccgggcagcctggacttcgcgagccctggtggggctggcggcccacagagcccccacctgccccgagctcccacagcgaggagtggccgcgccgcccgccagtgcgccgggctccgagaccggcaggggagcacgcgggcgaaggaggggccgccgtcgctgacaccac

SEQ ID NO: 91579 - DNA, 160 bp, Homo sapiens; identical to SEQ ID NO: 29156
  chr4:128544646-128544806
  hyper

SEQ ID NO: 91580 - DNA, 30 bp, Homo sapiens
  chr4:128801420-128801450
  hypo
agatctaagtttgtgcgctacttctgtttg

SEQ ID NO: 91581 - DNA, 76 bp, Homo sapiens
  chr4:128887678-128887754
  hypo
tgtgtatcagccaggcgcagttcactggtgaacacctaaacttgaaacgtgcggtctgggtgcgatggttcatgcc

SEQ ID NO: 91582 - DNA, 37 bp, Homo sapiens
  chr4:128889082-128889119
  hypo
tttcaaacaaacagccgggcgcggtggctcacgcttg

SEQ ID NO: 91583 - DNA, 100 bp, Homo sapiens; identical to SEQ ID NO: 40341
  chr4:128984233-128984333
  hypo

SEQ ID NO: 91584 - DNA, 30 bp, Homo sapiens
  chr4:1290639-1290669
  hypo
gctctccccacccctcgctgcatgtcctca

SEQ ID NO: 91585 - DNA, 40 bp, Homo sapiens
  chr4:129233933-129233973
  hypo
aataagacatatggccgggcgcggtggctcatgtctgtaa

SEQ ID NO: 91586 - DNA, 30 bp, Homo sapiens
  chr4:129729959-129729989
  hypo
tgggagtttttaatccgtacttttttctta

SEQ ID NO: 91587 - DNA, 579 bp, Homo sapiens
  chr4:1299056-1299635
  hypo
gtccctgtggaaagccgctgcactaggtgagcccggccctggtgagggtgccttgtgagtggagcctgcttgtgctgctgtgccccgctgcttccaggcggcgcggccctccgtctgattgctggaggactcttcggtgtggacacaccgtggtttgtttacccatcctggtcaatggacaattggaactgtggtgaacaagcattcctgcacctgtatgtggatattgtatgtccatttttcttgggagtggaatggctgagtcatctggtaggtgtctttaccttttaaagaactaagcgctttttccagaaggatcatcagaactgctgccagcaagagtccaggtatcccggctccaccagcatgtggtggcggcctcttgacttggaactgttcttctgggtgccggggttctccagagaaacagagccagtggcacccacatgtgtgtgtgcgcacgcgtgtgtgggagtgtgcgtgcgtgcacgtgcgcacgcgtgcgtgtaaggagctgtgtcacaaagaattggctggtgcagttatcaaagctaagtcccgagccggagacccaggaga

SEQ ID NO: 91588 - DNA, 30 bp, Homo sapiens
  chr4:130931683-130931713
  hypo
accatacagaatgttcgggcccattgaaaa

SEQ ID NO: 91589 - DNA, 20 bp, Homo sapiens
  chr4:131702671-131702691
  hypo
taccgcgcctggccattttt

SEQ ID NO: 91590 - DNA, 30 bp, Homo sapiens
  chr4:133093073-133093103
  hypo
catgtaccccatcaacgagaagcaattgac

SEQ ID NO: 91591 - DNA, 107 bp, Homo sapiens
  chr4:1331010-1331117
  hypo
catcatctcagaggccgccatgggcattgatctaaaagcccgattttgatgtgttctggcagccggcagattaccattcagaatagttttcccgtgtgattaccaag

SEQ ID NO: 91592 - DNA, 163 bp, Homo sapiens
  chr4:1331733-1331896
  hypo
gcagtgagtgtttcgcgattgctgctggtacctggctgtgccggggtatgaatgagactcaggccccctcccttgtcccctctttgtggaactctgggcgagagggctggcgtgcttgcccactgcctgttcctaggtgccagcagaacgtccctgctgggtg

SEQ ID NO: 91593 - DNA, 392 bp, Homo sapiens
  chr4:1332268-1332660
  hypo
ccctgaacaagctggcgcagcccctgcccatggcccactgtgccaactcccgcctggtctgcaagatttctggcgacgtgatgaacgagaacaatccgcccatgatgctgcccaacggctacgtctacggctacaatgtgaggggggcagggcaggggggccaggctggcacgcatcgccatcgggacagggctgtgtgggacgggcagggcaggggggccaggctggcacgcatcgccatcgggacagggctgtgtgggacgggcagggcggggggccaggctggcacgcgtcgccatcgggacagggctgtgtggggcgggcagggcagcggggccaggctggcacacgtcgccattgggacagggctgtcctctcgccccaccctgcct

SEQ ID NO: 91594 - DNA, 305 bp, Homo sapiens
  chr4:1332878-1333183
  hypo
tcaagatgataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttgcgaccaaagatccgtgagcaacgataaatactcttaggaagagagaaaataaggtttcataagtttgtacttgaaaacatttggattggtaggattttgtaacacgtcaaccatttgat

SEQ ID NO: 91595 - DNA, 322 bp, Homo sapiens
  chr4:1338490-1338812
  hypo
gtgaagagaaaaaagcgaatcacctagtaagacagtaagtctgtgtgacacaagggccagaagtgccctgggaacaagcacggcaggtttagaaaacggatggggggtgttgagccagggaggtgagcgggtgcagaagtatttgctcagggtgagacatgagcagtggctggaaggaggcaaggaactctgtggatactggcagaagcttcccggcagagggatccgctccccagaggccgtgtggcagcaagagcaggctggagaagtcaaccggtgggatgcagggggcagcaaacacaggccacgacaggttttgcct

SEQ ID NO: 91596 - DNA, 43 bp, Homo sapiens
  chr4:1339099-1339142
  hypo
gataattggtccaagcgaacagaaggatgcagggcaggcccag

SEQ ID NO: 91597 - DNA, 227 bp, Homo sapiens; identical to SEQ ID NO: 29157
  chr4:134067790-134068017
  hyper

SEQ ID NO: 91598 - DNA, 505 bp, Homo sapiens
  chr4:134068272-134068777
  hyper
tcccacatgcaaacacgcgcgcactcgcgcgcacacacacaagtgtttccatacgtacaaatgaacgcattagaaaattaccgtcattttttaaaaggctccaggattctgacgagtcagcttgaagagctcaaaacatttcatttcaattctgcagatctgaagaaaaagaaaggggggaggggtggaagtacagatgcaataccgtattaatattcagatacactataatctccttttcattgatccacaggtccctttatacactgccgctccattctcagccgcagacgtgatgctaaaatcattttaactgcagcggttttcgcttggctttggccagtcttcaatttactgcagctggaaaaggattagccatttttgctggaatcctttccttctaagcgctcaaaggcaggacccatcttcatgaaagagccaagtgcgggggccggggggacccggcgttgcggggagttggggcgcggaaatcagggcagtagac

SEQ ID NO: 91599 - DNA, 143 bp, Homo sapiens; identical to SEQ ID NO: 29160
  chr4:134068778-134068921
  hyper

SEQ ID NO: 91600 - DNA, 592 bp, Homo sapiens
  chr4:134069304-134069896
  hyper
gtgttcgcagatacccgcagcggtgcacactcgggcccctcgtgtgcacgggccctgcccaccaccccgcccgcgttcgccgccgccccactgtcctcatcccgcgggctgaccccaggattggcagaaatcagtggtctaatctagcatggtgggtaaagggatcgatctccaattgccaaaaaaaaaatagaaaatagccggtgttcccagccgctgcgtggcacttggccgcacaaggcgcagggatatcagaggcgctttgcagcgcttggcggtgctgtgtgccggatgccccagagcccggcgttaggatggcgggcttgtaggaagcggctcaaatcaactcctcagtcactgatgaacgcgctcacggctcgaagctaggtcctcgagtgagttaatctacttggtaagtattttgtgaatatgtattttgggaggaaagaagcacgtcgaacgcgtctgcccgtctgtaagcgctgtcatccccacatcctttagcgtgaattcctccgctttttaggagtcacctccaccccctactccgtatgcttcgcgcctttcctcacggccccgtcagaccccctca

SEQ ID NO: 91601 - DNA, 176 bp, Homo sapiens
  chr4:134070193-134070369
  hyper
ggactgggaactttccgcggcattgtccccagccagcgcctcgggacctgcggggctgttctcgctctcacactcacactcaccccggccgctcgggcgagagttctgtcccgccccgcccggctgccgcgtgacgtgtctgtttggcggccagtttggccaatcatcggcagctc

SEQ ID NO: 91602 - DNA, 85 bp, Homo sapiens
  chr4:134070370-134070455
  hyper
gtgggtggtgctcctgggcgattggttggcagaatgagggcgctgcgcaaaaacggagaagccgagcgctcggagctcagaaact

SEQ ID NO: 91603 - DNA, 1559 bp, Homo sapiens; identical to SEQ ID NO: 29164
  chr4:134071052-134072611
  hyper

SEQ ID NO: 91604 - DNA, 405 bp, Homo sapiens
  chr4:134072676-134073081
  hyper
cgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagc

SEQ ID NO: 91605 - DNA, 578 bp, Homo sapiens
  chr4:134073127-134073705
  hyper
cgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccga

SEQ ID NO: 91606 - DNA, 126 bp, Homo sapiens; identical to SEQ ID NO: 29167
  chr4:134074030-134074156
  hyper

SEQ ID NO: 91607 - DNA, 304 bp, Homo sapiens; identical to SEQ ID NO: 28813
  chr4:13523948-13524252
  hyper

SEQ ID NO: 91608 - DNA, 246 bp, Homo sapiens
  chr4:13524529-13524775
  hyper
cgaaaactactgggaggccgagagaggtcccgggagcaggggcttgaggaggcaccttggggctacggacttcgctgccgtggtggcctcgcaggagaaagtggcttaaatgaagagtcctggctccaggcttgacgcccagctagataaacgatcacctccctgagaggaggccttgggcatgccgtgttcccagagcccatggcacagtggcccccagaacacgctgatcgagcagaggccaga

SEQ ID NO: 91609 - DNA, 30 bp, Homo sapiens
  chr4:135248649-135248679
  hypo
ttttccaccttcccccggactgacaagtgc

SEQ ID NO: 91610 - DNA, 49 bp, Homo sapiens
  chr4:13525379-13525428
  hyper
acactggcctggctgcgctgtactgccaggtggccttctcaggatccct

SEQ ID NO: 91611 - DNA, 131 bp, Homo sapiens
  chr4:13525473-13525604
  hyper
cggccactagcccattttatcccattgagcccccgtccttccccatcgcggggttccactccactggtgccagggctatgcccctcacccacccactccaccggtgctggctaccgcaatctctacccggg

SEQ ID NO: 91612 - DNA, 197 bp, Homo sapiens
  chr4:13526768-13526965
  hyper
cggagccaggaggggcctcaggggcctccaaccgcatggctcttcccagctttcccggacaccagcgctgagcactggggagccggggagcaagcgccaagaggagcttttaaattaaaatttccagagtagcctcagagagggagggaaattccagttgaaaagccccttctgcctcaggacgttattcagtaaaa

SEQ ID NO: 91613 - DNA, 58 bp, Homo sapiens
  chr4:13529323-13529381
  hyper
gggcagtggcgcaggcgccaggaggcaggtgcagcaccgagcccggtgcgccgctgca

SEQ ID NO: 91614 - DNA, 37 bp, Homo sapiens; identical to SEQ ID NO: 28814
  chr4:13529606-13529643
  hyper

SEQ ID NO: 91615 - DNA, 254 bp, Homo sapiens
  chr4:13530726-13530980
  hyper
ctataaaacaagtcacggaagatgcaacagtctctgaggccccgtccaagctctggtctttgctccttggtgtagggggccctcaggttggaggaagtggttcaaaggctaaagttgggtccgtcccgtgggcccctcccactccccccttttgggcgcggctcgggggtggaagccctgggcgacagcacagcttcgctgcggcggggaaggaggaccgtcgggcccagagttcccgccgccacatatggtct

SEQ ID NO: 91616 - DNA, 99 bp, Homo sapiens
  chr4:13532820-13532919
  hyper
atgcaaagattggcccgcacaggcttggaggtttgctgcccagggagaaggagaagcagctctcaggccctttcggcaacttctcggcttcccttgcat

SEQ ID NO: 91617 - DNA, 41 bp, Homo sapiens
  chr4:13536477-13536518
  hyper
tggaccgctgggggacgctgaggttccgagttggcattgtg

SEQ ID NO: 91618 - DNA, 204 bp, Homo sapiens
  chr4:13537569-13537773
  hyper
attgcagaagcagtgcggattaatgcaggcgctcacaggggaccaggagggctgcagagactaggtgctcttggctccgcgggcgcacaaaccgcaactgctggcggcaccagggactgcgagcaggggcatggagtgggagggaaagctgaggagagcgggctttgagcctggagaactcgtcacgcacgttcacgcaagctt

SEQ ID NO: 91619 - DNA, 30 bp, Homo sapiens
  chr4:13537979-13538009
  hyper
agcaaaaagcagaaacggcaggactcaagg

SEQ ID NO: 91620 - DNA, 30 bp, Homo sapiens; identical to SEQ ID NO: 28817
  chr4:13539344-13539374
  hyper

SEQ ID NO: 91621 - DNA, 15 bp, Homo sapiens
  chr4:13540888-13540903
  hyper
aagggaaggggcgcc

SEQ ID NO: 91622 - DNA, 123 bp, Homo sapiens
  chr4:13540945-13541068
  hyper
cgccaggggtgcgaccgggacctctgtggcttttcctactctaaagaaactcccggattctttcaccgcccaatcggcaaagatggagaacaaactaccctcttaagacgcagcaacaagcaa

SEQ ID NO: 91623 - DNA, 173 bp, Homo sapiens
  chr4:13541822-13541995
  hyper
gtgtgtaccaaatgacgccctttcattgagtgcggggaagcgctttgaaaccttgtagagccccaattgcacccgtccgaggaaaacgctcgggtgacccttctccgagagacaggttattcacgcctggtttgcaactaatcgcttcagaattttagcgggagttttcacta

SEQ ID NO: 91624 - DNA, 2 bp, Homo sapiens
  chr4:13543579-13543581
  hyper
ag

SEQ ID NO: 91625 - DNA, 125 bp, Homo sapiens
  chr4:13544277-13544402
  hyper
ggaggtctgggaggccctgggcccgggagaccagtcttagactcttgccccactgggtatcccatctaggcctcttctggggagggcggcagactcagccgctgtgtcaacgctgtgttgtcgag

SEQ ID NO: 91626 - DNA, 816 bp, Homo sapiens
  chr4:13545940-13546756
  hyper
cgcccctctggcgcggccagcccgccgcgctcctctttcttgttgaggatcgcctggatggagaaggacgtcaaggtgttggcgccgcgcacagccatctgcgccgcgggcaggagcggccggcggggcgggcagctggggcgccgagcagctccgagcgggacagagagcgccggcggccgcagcgcgagtgagctgggtgtgcgaggccgccgccgcccactgctgcgcggcccagcagctcccgccccactccgtcccaggatcagcgccgaccctcgcccccaccttagaggcccaccccgcccggagaccccctccccccgaatccagagccagacgctctcctttcgcagctcagctggattatctcatcgcttctcgcccttaggggcgggctggggtctgccccctcgggggacgtgaaggaggattggcgggggcccctccgtggcagcagtcccctcccgagcgccgccggggcgcacagcccgagtcactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaacttttttaccccctgccctggttttatctgtttcttttctctttccttcccttgcgttccactgtaccacccccctcccgcccgggtgtcattcctcactgctgagtgacagcctgaggccacacccctccactgggctgtcccgggcgctcccggccgtcc

SEQ ID NO: 91627 - DNA, 88 bp, Homo sapiens; identical to SEQ ID NO: 28821
  chr4:13548502-13548590
  hyper

SEQ ID NO: 91628 - DNA, 1230 bp, Homo sapiens
  chr4:13548634-13549864
  hyper
cgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcgggcggcgggcggagagcgggatttgactgcgaaagccaagggggcggggaaggggaagccccggccctcgggggcgcgcagtaaactgctgcacacgtgcccgcgctcccgaggggggcgcccagtgggctcgggatttcctggctgcgccaccgcgcgcctcgcccccgacgcccgccacctgtgccctgggccgccttccctgacgccagcggccggaggtcgcgcgcgccgggtgctgcccagcaacgaaaggccatgcggggttcgtccctcagatgccggtgaccttgattgaagtcacctgccttctctagcttccagtcctttaaaacgagggtttggacccggtgccttctgaacccggtgcttcactgagtgagcaagtgaagggtgtgtgtgtgtgtttggggtgggggcgggggcgaggggagggaggggcagcgttgccggctccccagagccaggtccaggcagaggtcgcgcccagcactgaccgtcggtcccaatccgcagactcccgagg

SEQ ID NO: 91629 - DNA, 30 bp, Homo sapiens; identical to SEQ ID NO: 40342
  chr4:136320705-136320735
  hypo

SEQ ID NO: 91630 - DNA, 140 bp, Homo sapiens
  chr4:138453793-138453933
  hyper
ggagaaggaggaaggcgggggtgggtgcgcgagggagagaaggggagatgggctggtgggggctgggggaggagatgggagccagtccttccctgttccttccttcttcctccccactccccctccgcctttcaatctac

SEQ ID NO: 91631 - DNA, 187 bp, Homo sapiens; identical to SEQ ID NO: 28684
  chr4:1396406-1396593
  hyper

SEQ ID NO: 91632 - DNA, 103 bp, Homo sapiens; identical to SEQ ID NO: 28685
  chr4:1396594-1396697
  hyper

SEQ ID NO: 91633 - DNA, 521 bp, Homo sapiens
  chr4:1397259-1397780
  hyper
cgcgccccccggcgccgctgcacctcccggtgggccctgggcaacgggcgagttctcgcggggtccgggggccgctgcctcgtcgacggtggctccgggggacgcgtcggtctcagccgcgccctggcaacccgacccgcgggccccgaggccgccgccgcctccccgcgcctcctccgcgcctcgcgccgcctccgtctcgggcgcttcgtcctcgtcgtcgtcctcgtcgtcgggaacctcgtccccgctgtccgcgctcgggctgtggccgccgccgccgctgctgtagccgttggtgtcgttggtctcggcctcccctgccttgaaggggtcgccggcgtctgcgggagggagggacaaggacagggcagggcagttaggaccggccggttcccagatcccgccctccgcgcgccccgcttcctcccccagggttccctcccgccccctgctcagcgcctcctgcttcgtcacccgcctcctctctctctccttcgctctgtcgtttccctcccctc

SEQ ID NO: 91634 - DNA, 101 bp, Homo sapiens
  chr4:1398277-1398378
  hyper
gggtagggccctgctcggcctcaccaggagggctgggcgggcgtgcaggtcggagtggctccccgcggcctaaaggcccggtcggccgagtctgaacagca

SEQ ID NO: 91635 - DNA, 39 bp, Homo sapiens
  chr4:1398676-1398715
  hyper
agcaggagtaggatccgcccctagacgaccgcgagcgcc

SEQ ID NO: 91636 - DNA, 189 bp, Homo sapiens
  chr4:1399065-1399254
  hyper
aggtcgaatgcaattcgcgatcaatagcggcccctaataagtgtaataggttttaatcgagtaattatccgaattttgaccctataatttagatgttcggggggagtttgcaaggtgcttgaaagagatatgcacgcgccgtaatgggatatcgacccgaccgggggcgcgggccgccccattaccggc

SEQ ID NO: 91637 - DNA, 64 bp, Homo sapiens
  chr4:1399500-1399564
  hyper
aggcgaaccctggaccggcctcacagccctgcagcccctgggcctgacccggctaagcttctcc

SEQ ID NO: 91638 - DNA, 47 bp, Homo sapiens
  chr4:139952127-139952174
  hyper
ttggtttttaatcagcgtttttgccaggccaccgtttcaagatacta

SEQ ID NO: 91639 - DNA, 25 bp, Homo sapiens
  chr4:1399990-1400015
  hyper
ggtggggcgcaggggcgctgcgggc

SEQ ID NO: 91640 - DNA, 92 bp, Homo sapiens; identical to SEQ ID NO: 7213
  chr4:1400248-1400340
  hyper

SEQ ID NO: 91641 - DNA, 525 bp, Homo sapiens; identical to SEQ ID NO: 28691
  chr4:1400997-1401522
  hyper

SEQ ID NO: 91642 - DNA, 28 bp, Homo sapiens
  chr4:140100690-140100718
  hypo
tgggcaacgagagcgaaactccgtctca

SEQ ID NO: 91643 - DNA, 226 bp, Homo sapiens
  chr4:1401642-1401868
  hyper
cgcgtgcaccggcgggtgtgcgcgccgccttacactgcggtccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagccccagggagcctggaactggttgggcggggcggggggggggcgca

SEQ ID NO: 91644 - DNA, 728 bp, Homo sapiens
  chr4:140200429-140201157
  hyper
gctttcctatatgtccgtttttatttaataagcctccagttcacactgcaactccccctttagttaattgctgagtattctgctttttctcgcgtatcctcagaaccaaaggtgtcgatatttggactacagagccaagcagttgcaggacgacgtgcaacctcaaaggaaagtgtcccgaaggccgcttcctttttgggggttgtggatctcagagccaggcgctcgcggggttcaggctgctgagaccctgccaagggttaggtttatttaccccacgaacattcgcccagcgtccactgagcgggccctgcctcactgcctcccagcgcttgccgggcccgctcgctgatcggcgtccaccttcccaccgttcctctgcttcctcaggagattggagagcgaatggtgcctctaacaataaaagtggtaagctgcgactttgtcagccaggcacgtttttaagtgcttttaaccatacattaactcattaaaaaggaaaaccatcatcgccctcattttatagatgaggaaacaggttaagccatttgtccaagatcaggatgcgaacccagataatctggactctgaggcaccctggaaaagttccctacttccaaagtctgcaggagcttcgggacgtcttcccgggagtctcccccagtctcctcgacctccaatccaggcttctgctgctctgggtcgggtttggccaactgggtgccggc

SEQ ID NO: 91645 - DNA, 402 bp, Homo sapiens
  chr4:140201192-140201594
  hyper
cgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggagacctttgtagtcctcaccatcctcccctaacccatctccagctctgttgctatccctgaggtctctagagctgaccgcggcatctcagaaaagggatggggaacctacaagtcgccgtcgcctgcctggctca

SEQ ID NO: 91646 - DNA, 216 bp, Homo sapiens
  chr4:1402196-1402412
  hyper
ccgttcacgagcatccgttcacgagcacccaggcacacaagccctgcagagccctcacaaacgcgctggcatccctgcatctccctcttccccgccagcgccagcgccagctccgcgctggtgttggttcctctttcactgtttcccgaggaggggcacaccagacactttccagattgctgcgccccctccccaggagaccgctgggtggcgggc

SEQ ID NO: 91647 - DNA, 103 bp, Homo sapiens
  chr4:1403963-1404066
  hyper
gtatagtgtttgcctcgtgcgaagtgcactccaccccacacttggccccacagcctcgctgtgcacctccttgcatcggccggacgggggcggggggtgcggg

SEQ ID NO: 91648 - DNA, 485 bp, Homo sapiens
  chr4:1404120-1404605
  hyper
cgcgccacggcgacccatgttgatcaccggagtttgggaagtcagaggggagccctctgctttcaggcctgggttccttctctaagatatgcccacttaggggcctgtgactcctccagaatgagtgtaccacactcgggacaccagaagcgagaggggacacaggctctgacctcgagagcacgtcagctctggagacccgcggccccagcctcgtgtgcctccgcacagggcagcttcagcactgcgaacagcgccagcaccgcggacagcgcgctcccacctcgcccccggaggccacgggctcgggccgtgttcagcaccgcggacagcgccagcaactccgagggtctcctggcctccagcccgccgtctctgacctccctgccccgccctcgactccttctcaaactttgggatgccccaggggaggaagagggcggcaggctgtgtgtggagtcttggcacggcgtacattacacagc

SEQ ID NO: 91649 - DNA, 39 bp, Homo sapiens
  chr4:140566713-140566752
  hypo
attacaggcatgggccaccgcgcccggcctgttttacca

SEQ ID NO: 91650 - DNA, 629 bp, Homo sapiens; identical to SEQ ID NO: 29170
  chr4:140655870-140656499
  hyper

SEQ ID NO: 91651 - DNA, 176 bp, Homo sapiens
  chr4:140656999-140657175
  hyper
gcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcgtgtgtgttagtggctgggaaggacacgaggacagagatga

SEQ ID NO: 91652 - DNA, 30 bp, Homo sapiens; identical to SEQ ID NO: 40344
  chr4:140753539-140753569
  hypo

SEQ ID NO: 91653 - DNA, 139 bp, Homo sapiens
  chr4:140754226-140754365
  hypo
gactacatcgataaacggaggttcagctccctcactcttcgtcacgtcaccagcagcttcttagcagcagaagtgagccaaccagggaagcagaggaaaaacaaaaacagtcaacacacaaacacgcaagttagcccag

SEQ ID NO: 91654 - DNA, 191 bp, Homo sapiens
  chr4:1407940-1408131
  hyper
taggagtttgaggaacgctcctgcggaagccttggagagtgattctggcgccaccgcctgcttggggccgcccgcagggagggagtcggggtgggcgcgtgtccgcgggagggagtcggggtgggcgcgtgtccgcgggagggagtcggggtgggcacgtgtccgcgggagggagtcggggtgggcgcgtg

SEQ ID NO: 91655 - DNA, 38 bp, Homo sapiens
  chr4:1408475-1408513
  hyper
gtgggtgggggtgggcgcgtgtccgcgggaggtgggtg

SEQ ID NO: 91656 - DNA, 30 bp, Homo sapiens
  chr4:140970389-140970419
  hyper
taccatctccctcgccgcctccctttcctg

SEQ ID NO: 91657 - DNA, 321 bp, Homo sapiens
  chr4:141031289-141031610
  hypo
acaactctagttcagcgatgatcatctcaagattttttaaaatttgagtaaggaaatcagacggtaaaatgtcctagtttttggcctattctaaaggcatttcattactaccaacaaaacgcttgcacaggggcaatgagccccctacgactgcatgcagcaggcacagcgacactgcacagtgcaacggttcaggcaagtggaaagggggaaacggcagatgccttccacacgaacactttacctatcgtcgtttttccagcattcttcacacctttccttcacgctctaataataagatggatacgctctaataataag

SEQ ID NO: 91658 - DNA, 30 bp, Homo sapiens
  chr4:141272492-141272522
  hypo
ctttatacaagagcacgattcttttctgat

SEQ ID NO: 91659 - DNA, 102 bp, Homo sapiens
  chr4:141294316-141294418
  hyper
tttagaattaaggaacgacggtgtcgcgttgactttctctgcttggttcgcaaacgctcttttctcgaacttgaatgacttctctgtcgctcataccaacct

SEQ ID NO: 91660 - DNA, 654 bp, Homo sapiens
  chr4:141294633-141295287
  hyper
ggcaaaggtggatcccggtgctttgagattggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaaggtgagggccgtcccgggcagcggagggcctggccccaggcgactagagctgcatcctcagtacctccgagggcctggagggcggggcgggctggacgcggccctgcgcaccgggggcccgggaggagcggtctcgggcctgggcatttggtgggcggcggaggcctggctcccggcagaacccttgcgcgacctctttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcgagagcctgagaga

SEQ ID NO: 91661 - DNA, 813 bp, Homo sapiens
  chr4:141348027-141348840
  hyper
tcaacccagccctttcgcccgccccccggcggcgcacaatgggctctgcgcgggtatcgagggagcggccaacagtccctggccccaccgccgtgaagtggggtcccttcgcttccacataggtggagactgagacagccgagcctattttgatctcgtttgggtttctgtaaggagcagtcagcagagtgagcagcgcccagacgcgccccgggccccctctacaaccattgggagagcgccccgggctcaagcgtggaacggggctgcaatggcaaccgctggaataacggcctcggctcccggtggctcctcaagcccgcaggggaggccggccgggctaggcacctagctgtccccgtgctcgtccgccccagcccgggcgcagcaggtggatgcggcggtgctgaagacacaaagggtcccaggtggcaccacctcctgcgtccacccacggggccgccagagcccagtcaagaccctagctcgctgcagccccatcgccagactcaacatccaccctcacttggccccgaccggttcagccctctggcggcaaagtaacggggtgcctgggggaagcagcaacgactccgcttcctcaccccaatctgcgcgcaaagggcagcgggacagcgggaacgcggcctgctgctcacgcacctctcttgcggcctgttttcggcagtgacagctcagatgtccaagtcgttgccacttggtccccgcgtctcttcagaccagtcccgccggcggccgcgcagcagcgactactaaccgcgcgtgcgcgtgcggtggcgggcgggaggcggt

SEQ ID NO: 91662 - DNA, 590 bp, Homo sapiens; identical to SEQ ID NO: 29176
  chr4:141418867-141419457
  hyper

SEQ ID NO: 91663 - DNA, 266 bp, Homo sapiens; identical to SEQ ID NO: 29177
  chr4:141488816-141489082
  hyper

SEQ ID NO: 91664 - DNA, 598 bp, Homo sapiens
  chr4:141489783-141490381
  hyper
gcgggaaggtgatcacgtccgccaagcacgccgctattccagctgagaagagctggacccccagggtcgggtgtacgtccgaggctgtcaggccccccatcttcactcagagactggagatgcagaggaaaagggctccagccccgaaggtggaggaagttcctttcccttgctcttcacgcctgtccgccgggcagcaaacccgatttctgttttttgaaccgaccgccgggcagcggcggtgcagaggcggcggctgcagacggagcgcggtgttgggggccgagtccccgcgtcccctcctacccaccctcgcgccagcaggaccctctgcgttccggtcttccgctgggacttatatagctgggccgctcccgggctgggccgcgcgaggtctcagaagacccgggcgtgggacctgccgggggcgtgtccgggagcaccgggtccctcccattcccattctcgctcggtgcctcgggagccctgcttcgctccccgaaagccctgggccggccgctggttgtctgcgccccgcacaccgcacgtcggagggagggcgcaccgcggcggtcagcacccgcgcccccgcacgtgc

SEQ ID NO: 91665 - DNA, 1023 bp, Homo sapiens
  chr4:142053231-142054254
  hyper
gaacccctgtccaagcggcgctatgccaagctctccggcagcctctcccctacccaatacagttaatcttctcctctttgtaaaccccccaagtgacgcggagcaaaacttaatcggtccagggaacccagacacgtcttccgcgccgcacggacttcccagaaggagcctggaggcaggcgctggatccctctaggcacctccgtccccgccggctcccctcccccgcgcccgctgggccactcacccgcgtggggcatggtgatggtctcgttggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgcc

SEQ ID NO: 91666 - DNA, 339 bp, Homo sapiens
  chr4:142054255-142054594
  hyper
agcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcgga

SEQ ID NO: 91667 - DNA, 103 bp, Homo sapiens
  chr4:142054654-142054757
  hyper
gtgtgcgtgcaaggaggagcttagtgtgatgtcaaagcccctgggattctcttgccatgttcccttggtctctctttatgggcagcagcgacccctgtcgggt

SEQ ID NO: 91668 - DNA, 30 bp, Homo sapiens
  chr4:142846491-142846521
  hypo
agcaaactactgccacgtgttaaagccagg

SEQ ID NO: 91669 - DNA, 24 bp, Homo sapiens
  chr4:142846965-142846989
  hypo
ccacccgcccggccacatttgtac

SEQ ID NO: 91670 - DNA, 589 bp, Homo sapiens
  chr4:143766796-143767385
  hyper
aaaaaacaaggcaaccgggaccaccaacatcagtcaccctcactccccaccactgcctctattccttaaggacttcttcccaggccggcggcggcggcggcggcggcggcggcagcttgcgatcatcaggattggaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgctcggcgagagggtaggcgcggtgacaggggtaccccagcagccgaggagagacagcccaccccaccctttaagctaaagagctggaggggtgatggaggctgcaagacggagaaacttgatgcaaaacagacaggctcccccctccaagacgtgccgccacgctctcagacacgctccctcgcctcccggattacccaccatcaaccaccccaccctgcaaaattcccccaccgagccctaggatcccaggcgggtaattacctctcccggaggcggagtgggggg

SEQ ID NO: 91671 - DNA, 653 bp, Homo sapiens
  chr4:143767625-143768278
  hyper
ctcgcctaccagccccgcgcgcgccccagagaagttgtcaccagcgcggctggctctccggctgctcacacgccccctggcacaattgctactttcttccaccccaacccccaccctccccgctcctcttcctcctcctctgctctctccaagcggtctcctcccaatgtcaccagcgaccgagtagaggcggccgtggcagcgacagtcgcgcaactggcgctgctcgcttcccgctactgatagagcggagatggtggcccggctgcccaccccgaaattaccacgctggctccgtgtgctcacaccccgtaccccgacccctttctgcggcccctctgcccgctgggtcgcccacccagactgggctgtgggatcaccgctaccgcgacgaggggggacccgaggccgccacgctgctgcgggggcaggagaaaccacagagaaagaacccgcgggaggaagaaagcgccccagaccccggcctatggcagcgcagtccctagaccgagggtttttggaaggggcttgggatccctgctgtcactgcctgcgtctaggcatccattcacgcctgctggaccccagtctgcagccgcgctgggacccctgtctcttgcccctcctcccccttgccccgggcagaggtcggg

SEQ ID NO: 91672 - DNA, 328 bp, Homo sapiens
  chr4:144100297-144100625
  hypo
gtttgaccagttccccgtgtaccaattcttttcccttgctatttattaggccccgctctgtccagatttttccaaaagtgtgtaccaccccataggcacatttagaatcagtatatatatttccttcctggccttcaaggagctttagggcctggtcaagagcatgtaattcacatttttgggccgaccagccattaggtaatctacctttctcacataatgagtgtttatttccatcaaagacagcataaccattaagtcccttgccatctatcactccggatgacccatccacaaacagtctaatccatcacgtagtggagcttcc

SEQ ID NO: 91673 - DNA, 31 bp, Homo sapiens
  chr4:144220336-144220367
  hypo
gcttgccctgggtgcccgtggttctggcctg

SEQ ID NO: 91674 - DNA, 30 bp, Homo sapiens
  chr4:144265355-144265385
  hypo
gctagcgtcttatttcggactttggaagcc

SEQ ID NO: 91675 - DNA, 42 bp, Homo sapiens; identical to SEQ ID NO: 29183
  chr4:144480322-144480364
  hyper

SEQ ID NO: 91676 - DNA, 473 bp, Homo sapiens
  chr4:144620967-144621440
  hyper
gcggaccagcacacccgcggacccagcgtcttggccctcaggccccagcagctccaccatcatgggcacgtagtcacggttgggcgaggaggtggctgtgtgctgatagcgcaccccagcacggaggaaagcctcacagtctacgcccttgcccctggggagaggggcccccaccgcgtccaccaagcgcccgtacttgggcagggggccgtcctcgtgaggaagtggggtaagccggcacctgcgggtggccgtggctccagacttcagggaggcgaagtccagcactctcctgtctatggcgcggctccagcttcgcagcttctccactaccaaaggcctgttacgcgtcaccagctccagctgggagaagaccaagtccaccgccagcgtgaagggcagcaccagagtgtgagtcggggcgtcgtagcgcagctgcagcagcacccgggcgcgtccggggctgtgggagc

SEQ ID NO: 91677 - DNA, 383 bp, Homo sapiens; identical to SEQ ID NO: 394
  chr4:144621514-144621897
  hyper

SEQ ID NO: 91678 - DNA, 250 bp, Homo sapiens; identical to SEQ ID NO: 29187
  chr4:144621981-144622231
  hyper

SEQ ID NO: 91679 - DNA, 30 bp, Homo sapiens
  chr4:144742636-144742666
  hypo
gctgggccataaatgcgatggttggagcca

SEQ ID NO: 91680 - DNA, 85 bp, Homo sapiens
  chr4:144766556-144766641
  hypo
tggtttgctgggaacctaaattaatagactacacaattgaactctcatttttcttctgattctgagttcacgttgcatatttaca

SEQ ID NO: 91681 - DNA, 237 bp, Homo sapiens
  chr4:144785182-144785419
  hypo
ggttttcattgctaacgatgggctcctagcatgaagagattcaggtaaagcctgcctcgaggagtgggccggtatctctgatgagagctggcgcaagcttgagtagtgacaatggggagatctccaaaagtgccaactcctaccacccaacacccaggagagaataacttcttactccctcctcacagatcctgagctgagctaaacaacctcttcagttctcgcaatccatgtgtc

SEQ ID NO: 91682 - DNA, 18 bp, Homo sapiens
  chr4:144981012-144981030
  hypo
gagcgagactctgtctca

SEQ ID NO: 91683 - DNA, 257 bp, Homo sapiens
  chr4:145567145-145567402
  hyper
gaggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgc

SEQ ID NO: 91684 - DNA, 1040 bp, Homo sapiens
  chr4:145567625-145568665
  hyper
aggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataaggtaggcactcaccggcttcacggatgcgtacttggcatattggctgggtggggttccctgtggctctggcaaagccggtggttgtaagaaggtcaaaacttctttgggggagttctttccataacttttctatagcgctaacgtgattccgttgtgtgttcctctggggtaagcaagtagcatttcctcccccagagtccgcggtcgggatgctgtgcaaacttgcctatctctgaaaacagacgtttctgcggtacccgcaccctgggctgggtaaatattttaaaagaatcgcgatgaacagtgtgttttggatcgaatggggcattggctgcggtgaaactgtaaattaaggtggctgtggtttccggcttatttttctagggtaaaaagatttgtgctgttttctccacgtgctcggttagggagaggattgaatcgtaaaggatgttgaagcatggttggtttatgatccccagccccgtcagaggggggtgtcttgcattacattagttaaaccaacagaaaggaactcctggtcctccggttagggacctga

SEQ ID NO: 91685 - DNA, 23 bp, Homo sapiens
  chr4:145689704-145689727
  hypo
tgctttcaagatggccgaatagg

SEQ ID NO: 91686 - DNA, 98 bp, Homo sapiens
  chr4:146853883-146853981
  hypo
ccaaagtgttgggattacaggcgtgagccaccgcgctcagcttgtattttaaaccaacttctgacctcaggagaagcctgcatcgtcactccaccaac

SEQ ID NO: 91687 - DNA, 32 bp, Homo sapiens; identical to SEQ ID NO: 40349
  chr4:147048518-147048550
  hypo

SEQ ID NO: 91688 - DNA, 157 bp, Homo sapiens
  chr4:147554067-147554224
  hyper
caaggaagttcactgcgatgaaaaataatagttcgttgggacaagtagacaccagggagcctgcttctgaacagaacgcagaggtctgcccccctcccccaagtggtgcgcgggaagaagaggggagaaacataaacgtgtgcgcctctgaatgggt

SEQ ID NO: 91689 - DNA, 373 bp, Homo sapiens
  chr4:147558009-147558382
  hyper
agcacttacttgaaccgtccggcacaagccacattcattcacgtgaacactcccctttccctaccccatgtccaggtttcgctgagctcacacccggcaacactgctgctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggcggctcctgaggacagcggtcccatcttgaaaccgctattccgcccggctgaggtcaggggtggacaggcggtcccctactctccaccgccgcttccgggagctgaccacc

SEQ ID NO: 91690 - DNA, 176 bp, Homo sapiens
  chr4:147558476-147558652
  hyper
cgccttccccaggcgcccagtgcctgcacctgctcccggtcaacccccgtccggattgggccacccgcgggttcctgcgtcggggtcccggggccttctcaccctcgcctgcaccctgctccttccgctctctagggaggtgacagcagcccccaacaccgcgggaagtatagaga

SEQ ID NO: 91691 - DNA, 889 bp, Homo sapiens; identical to SEQ ID NO: 396
  chr4:147559190-147560079
  hyper

SEQ ID NO: 91692 - DNA, 286 bp, Homo sapiens; identical to SEQ ID NO: 397
  chr4:147560133-147560419
  hyper

SEQ ID NO: 91693 - DNA, 109 bp, Homo sapiens
  chr4:147560459-147560568
  hyper
cggcggcggcggcggcggcggcggcggcggcggaggccgaagcagcagctccagcagcagtggcagcagcggcggcgggggctcggaggctatgcggagagcctgtctt

SEQ ID NO: 91694 - DNA, 259 bp, Homo sapiens
  chr4:147560887-147561146
  hyper
ttattattattttaacgatctgggaatgttgtaggcgcggcgacggtgtcgagccctgggccggggcttccggagagagggcgtacaattccctgctgagcgtaatgtgtgccttctacttacaattgcagagcaatatattcggcgggctggatgagagtctgctggcccgcgccgaggctctggcagccgtggacatcgtctcccagagcaagagccaccaccaccatccaccccaccacagccccttcaaaccgga

SEQ ID NO: 91695 - DNA, 591 bp, Homo sapiens; identical to SEQ ID NO: 29197
  chr4:147561359-147561950
  hyper

SEQ ID NO: 91696 - DNA, 122 bp, Homo sapiens
  chr4:147561999-147562121
  hyper
cgctcttttctctcctctcttctgcctcttttcacttttggcgactagaaacaattccagtaaatgtgaatctcgacaaatcgaggactgaagagggagcgaacgagcgaacaactgagccc

SEQ ID NO: 91697 - DNA, 632 bp, Homo sapiens
  chr4:147568636-147569268
  hyper
ttttcaggaacaaatcgatgagatagggatgcgagagagggaagatgaaggcttttcccaatctaggtcacttctttgcggagaggccttctcagagctttgggtaagtgaagaggcgccttaagttcgcggtcccagctgctcaggctccgcagcctggaggcgggaaagggaacagtgagactgagaagcaggacgcggggacagcgatctcccagaagctttcctcgcttttggtggctaatgctacgcgcctgcctgcggagctcaggcggcaccgaggaatcaagatcctcgtccccaccctccgactcaccacctaatgctttgcacaagctggccttgggttccctgctagtcccatctcccctctccacccctctggttcctggtgcgcactggtgacaggcggtttgggagagggtgaggggtagagtccaaagggctggggctgcgtggggtcagagcagaacctccctccctcgctggaggagctcgcccggtccccgaggggcccccagagctggggaagcaggcgtctcgccaggcgctcagcaaggaacccgcaagaaagagaggcccgggcgcctcgcccccttgcattttactaatcacgtctatttaaattctag

SEQ ID NO: 91698 - DNA, 315 bp, Homo sapiens
  chr4:147569278-147569593
  hyper
cgcgctctcaccgggaaagctctggagaactggacccatcaattattctgaaaaaatccctgactacgtgaggcttccagccagcgggagggaggcggcgggaggaggtggagaacccagcccctacccctctcccctcctccccgcccctcccagcgcggcctcttgatatacactcatcttcagggttctggggccccagggagacttgtgcgcattttcagggttcgagcttttgtggacgaggaaggaaggtggtgggagaaagttgggacctggcctgtgcagggcatccgcttccggagctgctatccc

SEQ ID NO: 91699 - DNA, 286 bp, Homo sapiens
  chr4:147569793-147570079
  hyper
aggatgccccgaggccgagcagcaatccaggcgctcagctggacgcgcaaaaagaacgcgttcgccctaaagtagggaggcgagtgagcatggctagtaattactgcttcccccacccccgcccagcttcacccgcccccaccccgcgctgggtctgcagccattactccagctgtcactgggcggaaagcaagcgccgtccccccagccccagaattggctgtagctaacagaagctagtgtccccctcaccctcccatagggtctggatcgtggatcttaaaaa

SEQ ID NO: 91700 - DNA, 170 bp, Homo sapiens
  chr4:147576032-147576202
  hyper
acaggaatgagacagcggtgacagatgagcggctgggtcaggaaggagcccagttggtggaaatgacactctttccccgctccgggtcccctcccccaccccattcgcgttttctctctcggcctctcctccctcctcgccttgccctcaggcagccgaccggggacaca

SEQ ID NO: 91701 - DNA, 515 bp, Homo sapiens; identical to SEQ ID NO: 2470
  chr4:147576329-147576844
  hyper

SEQ ID NO: 91702 - DNA, 67 bp, Homo sapiens
  chr4:148079423-148079490
  hyper
cctctctccctgaagcgacgcccccttccttctcagagggccccctgagctgcgtccctctgcccca

SEQ ID NO: 91703 - DNA, 528 bp, Homo sapiens
  chr4:148402212-148402740
  hyper
gttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtcggtgcaagtctttcttatcggggactgggactggggcgggtgcggggatggcggagacgctgcctgggcccctcggtcgggagaagacgagagctgggaacgttctggcccgaccgccctgcagcttgggcgacccgtcgcagcaggggctggcacccacttgccccagggcgcgcggggaggcgggcgccttccgtgaggggtgcgct

SEQ ID NO: 91704 - DNA, 37 bp, Homo sapiens
  chr4:148628963-148629000
  hypo
tagagggttgagccaccgcacccggccatttctgtgc

SEQ ID NO: 91705 - DNA, 30 bp, Homo sapiens
  chr4:148652683-148652713
  hyper
agcggagatttaccacgcatctcactttaa

SEQ ID NO: 91706 - DNA, 546 bp, Homo sapiens
  chr4:149364884-149365430
  hyper
agctgtgcggcctcccgcctcaccctcgcttcgcgcccgccaaagcccgaggcgggggaccgggggacaccctgtgcccaaaggcccctcctctccttaacagttagttaagctccgggattccggacccctaacccagggctgagacttgaactctcagccgctccagtcaggaactccctggagataggggcgacagcggcagcgccgcgagctggtcctgaccccagactctaatgcccctcggtccccagcttggagctgcccccggcgtccccgcagccaggagtccccgccgagcgtcccaactttcccgcggggcccaccgtcacgcgcactctcccggcccagcgaactgggcatcgatctcacgtcggcagagcgcgggcggcgggcgggagcaaggggagtcccggacctagagcctgggcacgcgaggcggcggcggctccgcaagcgttgccgaattattcattattaaaggaatggacgtgtctcttttactaagtttttatctcctttgaggagggccggtcttgccctgga

SEQ ID NO: 91707 - DNA, 43 bp, Homo sapiens
  chr4:149365868-149365911
  hyper
gaggcggcgaggcagcggcgccaaatcgcgcagagggggacgc

SEQ ID NO: 91708 - DNA, 211 bp, Homo sapiens; identical to SEQ ID NO: 40189
  chr4:1504889-1505100
  hypo

SEQ ID NO: 91709 - DNA, 140 bp, Homo sapiens
  chr4:150756466-150756606
  hypo
cctgctgccccaaggcgactcacctgtgcttctgcctcagtcggactcagctcctgaagcactttgtgcctcctcagcgtgctgcacctccacccactccacccgcctcatcaagccccagcccgcgccctgccccgccc

SEQ ID NO: 91710 - DNA, 235 bp, Homo sapiens
  chr4:150999354-150999589
  hyper
aggagctgctcctcccgcgccggcgctcggccccctcctccgccccctcctccgccccctcctccccttctccgcggtttggcatccccggggccgggaagcctcctccagcgctgacagcctgtcggcggcggagggaggccagagcgcggatgcttgccagtgggccgggcctgaccgctgcgtgggaggcgggctgcattatttcccgctagggccgcgctccagggaagga

SEQ ID NO: 91711 - DNA, 430 bp, Homo sapiens
  chr4:151000151-151000581
  hyper
ttttgcggacgccctcggagcagccgcgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagc

SEQ ID NO: 91712 - DNA, 30 bp, Homo sapiens
  chr4:151177716-151177746
  hypo
ctttattccagcattcgatgcatttttata

SEQ ID NO: 91713 - DNA, 157 bp, Homo sapiens
  chr4:1512241-1512398
  hypo
ccccaccgcgatgcacgcacactcccccgtgtcctcacctgcacttggcaaggttggtctttgtaatttcagctgctccaataggtgcacagtggcagctttgtgcggttttaacctgcgttttcctgataattagcaatgtcgagcatcttttcat

SEQ ID NO: 91714 - DNA, 224 bp, Homo sapiens
  chr4:1514843-1515067
  hyper
aggagggtcccagcacggccgcagggcacgcggcgctgtggagcgcatgagcggggtgcgccctagggtgcggcccgcgctggcagccccagcccgactgccgaccgccgctgccgtagaaactgggcccatccgcggtgccggtgcaaggtgcggccgtggggaggcggcggggccgggccgccgggagctgggagccgcggccacatcggtggagcagggcg

SEQ ID NO: 91715 - DNA, 30 bp, Homo sapiens
  chr4:152246132-152246162
  hyper
tggatttagtgtgcacggaaaatttgagtt

SEQ ID NO: 91716 - DNA, 50 bp, Homo sapiens
  chr4:152246492-152246542
  hyper
gccctcagccatgggcgaggcgcggggcgcagccgcgggatggccagcga

SEQ ID NO: 91717 - DNA, 117 bp, Homo sapiens
  chr4:152928973-152929090
  hypo
gaaaactagaaagtacgctaatggaatgtgagctccgtgagagtagtggctcagctgcctgccgcctttcctgtgttctggatggtgcctgtaagattgtatcggttatttcgtatc

SEQ ID NO: 91718 - DNA, 55 bp, Homo sapiens
  chr4:152932523-152932578
  hypo
tgattccatgaactccgagtaaacctacctagtggttgtgcgtgtgtgtaggggt

SEQ ID NO: 91719 - DNA, 20 bp, Homo sapiens
  chr4:153437373-153437393
  hypo
caactggtactggtccgtgg

SEQ ID NO: 91720 - DNA, 100 bp, Homo sapiens; identical to SEQ ID NO: 40351
  chr4:153535608-153535708
  hypo

SEQ ID NO: 91721 - DNA, 30 bp, Homo sapiens
  chr4:153601131-153601161
  hyper
gcagcctctctgaaacgtgaacatttcctg

SEQ ID NO: 91722 - DNA, 146 bp, Homo sapiens
  chr4:153702689-153702835
  hypo
aattggccatttcattgctgttctctcagagcggctacagattactatattttactgctgccttaattctgcttttctttcgtttgtcctgtggtgttttttgttttgttttccttgcttagcatgacccacgtcttctcccaact

SEQ ID NO: 91723 - DNA, 99 bp, Homo sapiens
  chr4:153774393-153774492
  hypo
tttatgtgtttgctttacctgtgagttttgtatgttcatgtgttttgatgatggtaaatgttgcccttttgcttccaggtttagcgctccgttgagcat

SEQ ID NO: 91724 - DNA, 96 bp, Homo sapiens
  chr4:153821363-153821459
  hypo
atagaacaaaaaaggcgaaagactttttttgctaaaggtgagaaaatctccgcactcagaatgttaatgtatgtaattattcgataaagaattata

SEQ ID NO: 91725 - DNA, 78 bp, Homo sapiens
  chr4:1538540-1538618
  hypo
cccagccagaggaaccgcggggacccaggggcctgcctggaaaatcaatcagcatgttggccccgccaatttccagga

SEQ ID NO: 91726 - DNA, 197 bp, Homo sapiens
  chr4:153918948-153919145
  hypo
ccctttcctctgcaccgatgctcggactctccgtgtgtgccattttgcagtggggtcacgctccacgtgttgttctgccactgcctttggtttctcgacactgcctcgtggacacgcagggagagcttgcagctggtgacaagctctccagcaggtgagtaatccagcagctctttctgcctcgaggtgagtgaggt

SEQ ID NO: 91727 - DNA, 30 bp, Homo sapiens
  chr4:153943304-153943334
  hypo
ggtccaggcacctcacgaggtaggtccagg

SEQ ID NO: 91728 - DNA, 188 bp, Homo sapiens
  chr4:15412373-15412561
  hyper
atcaccaggatttcacgtgaatatgctttctctctggttttcagaactattaggggaacaaatcttttgcaaagcagcacgaaggcagcctgtaatctaccagagacatacagaattgcaacaaggtcaaagggcaccactttatttggctgctacaatatcaacatcaatttcgagttacaacccag

SEQ ID NO: 91729 - DNA, 369 bp, Homo sapiens
  chr4:154143815-154144184
  hyper
cagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggtgcgaagtcctgggtcgcctgcccgctgcctgatgtcgtgagctagggcacctcggccctggctgggcgcgcagcgaggcccaggcccgaggggtgaggcccaggccactccggagcgcgcgctgttcccgcgaagcgagtcgccg

SEQ ID NO: 91730 - DNA, 79 bp, Homo sapiens; identical to SEQ ID NO: 29210
  chr4:154144397-154144476
  hyper

SEQ ID NO: 91731 - DNA, 525 bp, Homo sapiens
  chr4:154216373-154216898
  hypo
gtagagtctccttctcgccggtggagggcactgccccgggctaggccccgccctgtgggacgagctcaccaggcctccggttttcccgcaggtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacgggga

SEQ ID NO: 91732 - DNA, 30 bp, Homo sapiens; identical to SEQ ID NO: 40356
  chr4:154372568-154372598
  hypo

SEQ ID NO: 91733 - DNA, 115 bp, Homo sapiens; identical to SEQ ID NO: 40357
  chr4:154540115-154540230
  hypo

SEQ ID NO: 91734 - DNA, 43 bp, Homo sapiens
  chr4:154605841-154605884
  hyper
agtgccaatgggctgcggctgggctgagcgcccttccaacctt

SEQ ID NO: 91735 - DNA, 438 bp, Homo sapiens
  chr4:154680759-154681197
  hyper
gagggactggcaccccgcacggtggcatcttccagaaggtcatgcgtccgtccccacgtctttccagggccggttctccccggtggggcccggggtcttggagaccagtctgtgcagcctgcccggcaccagcgtgagccccgggaccccggcctggcgtcccccacgcccgcgcccccgcgccagtacctgctcctgctgcgggggggcctccagcaccggcgctgccttccgcgccgccgtccccgcggccatgcctgagccactgtgccttctccagggcacagcgcctgccggggagggtcccgcagagtccgcagaaggaggcgccgcggggcctcgggagccgagggtgagagccggatctgcggcggcggcggagcggcggccctgcccgggttgtgcggggcgggagatgggagcctcccggcacgcccc

SEQ ID NO: 91736 - DNA, 167 bp, Homo sapiens
  chr4:154681198-154681365
  hyper
cctccgccccctgcacgctggccagcgtcctccccagcagcggcctcgaggtcccggtcgccagcaccccggttccttcagaacctcaggcctcccattcagccagccattgtcgccgataaagcgtcttgagccctaccgggtgcgtgtggcgggaaccccggttt

SEQ ID NO: 91737 - DNA, 232 bp, Homo sapiens
  chr4:154702510-154702742
  hypo
agtgtgcttggggaacgggagctgagatcccggagcagaaatggtcagccgtgctctggagcaggcctgtcggagccatcaggatgccgggactagcactgcagcttgcggatgctgcgggagatgcgcttgaactctctctgccccttctgccaccgcttcaccgaggtgatcaccagctccccaccctgtttctgtcccatgaccagatagggcgcgttgatgtcgttca

SEQ ID NO: 91738 - DNA, 505 bp, Homo sapiens
  chr4:154709106-154709611
  hyper
aaacaccacttccaacgctctgcgcagctccagtgctagcatctttaacaataatcgtgtatctatttttttttaaaccgccgttcagttcttcgtttttttagttttgttgtttttgtttgtttgttttatttttaaactgcccttaagtatagctggtacaactcgggaggagaatgcgcgagacttgggcggcgtgggaggggtgcctcaaatttgatacaggcttgttgtgatgacagaccaggtcaggcagaacttctgcccttcccgctactggcaccccaagcagggatgcactgggatgcgtggcaggggcgggatctcctgggagcgtctcagcccagcagggagtggggaagcaagagggaaggcttaccttcctcggtggctggcaggaggtggtcgctgctagcgagggggatgcaaaggtcgttgtcctgggggaaacggtcgcactcaagcatgtcgggccaggggaagccgaaggcggacatgaccgggg

SEQ ID NO: 91739 - DNA, 70 bp, Homo sapiens; identical to SEQ ID NO: 400
  chr4:154709758-154709828
  hyper

SEQ ID NO: 91740 - DNA, 769 bp, Homo sapiens; identical to SEQ ID NO: 29217
  chr4:154709829-154710598
  hyper

SEQ ID NO: 91741 - DNA, 19 bp, Homo sapiens
  chr4:154710599-154710618
  hyper
ggcttgttttgccccagtc

SEQ ID NO: 91742 - DNA, 186 bp, Homo sapiens; identical to SEQ ID NO: 29219
  chr4:154710728-154710914
  hyper

SEQ ID NO: 91743 - DNA, 708 bp, Homo sapiens; identical to SEQ ID NO: 29220
  chr4:154712003-154712711
  hyper

SEQ ID NO: 91744 - DNA, 289 bp, Homo sapiens
  chr4:154713500-154713789
  hyper
aggtgaagtgactaccgggctagccttggggacctgtcgcgacttgtcgggtgtctccaaccgcgttgccgcctggctttcagccgtgcgctggccagccgggcgggtgacgtcacctctccccgggtccgtgcacccaggccttccctgctccgggtgagtattttttcatgggattcagccatctgggggcgccatttcccaaaacagagattgtccctttgaggttgcaagtcaggttcctttacgctgagatcccttacatttttacttttaggaaggttttttc

SEQ ID NO: 91745 - DNA, 220 bp, Homo sapiens; identical to SEQ ID NO: 29222
  chr4:154713790-154714010
  hyper

SEQ ID NO: 91746 - DNA, 52 bp, Homo sapiens
  chr4:154727418-154727470
  hypo
aaggaaaggcatgggcgggagccagacggtgcggttccggatggctgtggcc

SEQ ID NO: 91747 - DNA, 569 bp, Homo sapiens
  chr4:155254047-155254616
  hyper
cagcatttgtgtcatcggtgagagagactcactgacttccacttgatagaccaaatgttcgaaagtccaggatgggctgtgttcgcgtttctcgataacgactgtcagcaccagcagggctgcctgaggatgcacgccttggtcctcggccctgagagtcagcgtgagctcccgctgctcgcccgcgcccaggctgccgttgaggaacagcacccccagggctctgtcgatggcaaagacgcctggctgcgggctggcgatggagtaccggatgagtccgttccgcccactgtctctgtcttccgcacgtgcgaggtacaaggctgtgccagggggcgtggtctgggatattctaatctcatccgaggtcctgaggaacgctgggtggttgtcattgacatccatgactgttatgttgacctcggtgctgctgcaggctggggcgctgccgagctgcgcctgcaccgtgagcacaaccacgggctgcgtctcgtgatccaggggcttccgggtgcgaatagtgcccagccgcgggtgaatggagaactttccgccgagatcaccagaag

SEQ ID NO: 91748 - DNA, 40 bp, Homo sapiens; identical to SEQ ID NO: 40359
  chr4:155321157-155321197
  hypo

SEQ ID NO: 91749 - DNA, 73 bp, Homo sapiens
  chr4:155337912-155337985
  hyper
gcttgtttaaatctccgagctggcggcgccaggcaggaaagtgtctgctccagctcctcgctgcaccttcctc

SEQ ID NO: 91750 - DNA, 173 bp, Homo sapiens
  chr4:155411321-155411494
  hyper
tggcaacctcaggctcggcgcctccatcgcgggcctccaccaccaactggtgccaggcctgtgcctcgcggtccagaggtctccacactcgcaccacgccgctcagctcctccaccgcgaagtaggccgcgtcgcccagtgccccgccgccgctacccgccccaggcacttgc

SEQ ID NO: 91751 - DNA, 429 bp, Homo sapiens; identical to SEQ ID NO: 29225
  chr4:155412014-155412443
  hyper

SEQ ID NO: 91752 - DNA, 30 bp, Homo sapiens
  chr4:155412753-155412783
  hyper
ctggatttctttaaacgaatctcatctctt

SEQ ID NO: 91753 - DNA, 33 bp, Homo sapiens
  chr4:155413097-155413130
  hyper
ctccgacccagcctccgccgcctgccttcccct

SEQ ID NO: 91754 - DNA, 185 bp, Homo sapiens; identical to SEQ ID NO: 29226
  chr4:155413374-155413559
  hyper

SEQ ID NO: 91755 - DNA, 88 bp, Homo sapiens
  chr4:155444677-155444765
  hypo
atgccgaaggaaacccgtcttccctaccgccccctaacgcaccggcctgcttggaacgcagttggaggctgcgcggtaccagtcccat

SEQ ID NO: 91756 - DNA, 72 bp, Homo sapiens
  chr4:155445409-155445481
  hypo
gcactgaattcataccgatctcatgctgggcaggtcacctgtgctgctgcctctccccgcaaggactctgtg

SEQ ID NO: 91757 - DNA, 289 bp, Homo sapiens
  chr4:155548046-155548335
  hyper
ctgttttctgggctccggcccccagcccagcccagccgccgcaggagcgctcggccagtaggtgtctctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggtaatcccccggcggcctgcgccaggcagtcatg

SEQ ID NO: 91758 - DNA, 66 bp, Homo sapiens
  chr4:1555624-1555690
  hypo
tcagccctgcacctccgcagctgtgggacgccatgcctcctctgagatctccggtctgtgccgcct

SEQ ID NO: 91759 - DNA, 110 bp, Homo sapiens; identical to SEQ ID NO: 40191
  chr4:1556398-1556508
  hypo

SEQ ID NO: 91760 - DNA, 446 bp, Homo sapiens; identical to SEQ ID NO: 29228
  chr4:155663475-155663921
  hyper

SEQ ID NO: 91761 - DNA, 179 bp, Homo sapiens
  chr4:155663970-155664149
  hyper
cgccttccttggccgtctccgggaggttatgcttaaaaacataaaaataaaaataaaaataaaaataaagggaggcggacaaagtttcggtgggtgaactgaagctgggtccatgtgaccctgaagccggagaaataaacttaacatgaatcttgctttcctggcgggcgttgggaccc

SEQ ID NO: 91762 - DNA, 156 bp, Homo sapiens
  chr4:155664189-155664345
  hyper
cggccacaggtgcctaggagcgcagagaggcctcgggttcaaatcaccggcgcgcagggactggactcgcgggtagcgacccccccaacccccccccccccgccctacacacacaccctcgcgccggctgaaagcatggaggattcagggcatttg

SEQ ID NO: 91763 - DNA, 183 bp, Homo sapiens
  chr4:155665292-155665475
  hyper
ggtcgccaggcctcgctgtcctcctttgccttcctctctcctcagcggccgtactttgcgccgtacctcacctggcctgcaggtgagcagcagcgcagcacccctgcccggcgagcttaacttgcccagcccggcccctgccggagtggcaccggcacctctccaagacgccctcttccctgc

SEQ ID NO: 91764 - DNA, 57 bp, Homo sapiens; identical to SEQ ID NO: 29231
  chr4:155665721-155665778
  hyper

SEQ ID NO: 91765 - DNA, 179 bp, Homo sapiens
  chr4:155677682-155677861
  hypo
gtgttagggatgttgcggttgcggggagaaggcagactgtgggttgagatttaaatggaaaatgactacgagcttctctttgtagcagtttggtgggagaagaaagaaacagataaagcccaaagactcagaaagcagtataacgtgatatctcttactacttccgcatgctttagaac

SEQ ID NO: 91766 - DNA, 64 bp, Homo sapiens
  chr4:1556783-1556847
  hypo
tgcaggtgacaatgacgctcagaactagacctgccacagagtcaacaagcgtggaccgcctgcg

SEQ ID NO: 91767 - DNA, 234 bp, Homo sapiens
  chr4:156129153-156129387
  hyper
agcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagccccta

SEQ ID NO: 91768 - DNA, 854 bp, Homo sapiens; identical to SEQ ID NO: 29233
  chr4:156129443-156130297
  hyper

SEQ ID NO: 91769 - DNA, 275 bp, Homo sapiens
  chr4:1561925-1562200
  hypo
actccagcttcaccccggcagccttaggacatggcagcggcctcctgccgtgggccacggattcccgcaccgcctcggtcacccggtcttcaggcgcggcccctgtcgagtcacccgacagactcgtaggtttgttctgtttttcagcgccctgcgtcagctgcctgcacaccgggcccagctcagctgtgcatggctccagcaccattttaattatcgtatccactgcaaaatgcgtcatttcttgttgtgttagcggtcgctgtttcctgact

SEQ ID NO: 91770 - DNA, 347 bp, Homo sapiens
  chr4:156297387-156297734
  hyper
cttcaaaataagtcacgtcttatttaaaaggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaagccaatttttcctctcacaaaagtgttaaagagagccagacaaaacgacgaagctttcgcgatgagccgcattaaaatcgcggtttcccgtactcggagcagaggcctggcagggccgcccatagcgttgtgcgccccgggttccgttccctaccaggccaggtgacgtccgggtgct

SEQ ID NO: 91771 - DNA, 92 bp, Homo sapiens
  chr4:156297941-156298033
  hyper
cgcccgcagagccggtcctggaccgagcgaggaggaggggctaataacagaggcggagggcggttgctaggaaacagcgtcttcgggaggaa

SEQ ID NO: 91772 - DNA, 30 bp, Homo sapiens
  chr4:1564339-1564369
  hypo
gtgcctcaaatcctgcggctcccgcctgct

SEQ ID NO: 91773 - DNA, 84 bp, Homo sapiens
  chr4:156588083-156588167
  hyper
cttagagaccccagccgggcgtgatctcaccatggtgcgttttggctgctactttctttttcagtctttcggtgcggagaaggg

SEQ ID NO: 91774 - DNA, 227 bp, Homo sapiens; identical to SEQ ID NO: 29237
  chr4:156588456-156588683
  hyper

SEQ ID NO: 91775 - DNA, 355 bp, Homo sapiens; identical to SEQ ID NO: 29238
  chr4:156588684-156589039
  hyper

SEQ ID NO: 91776 - DNA, 69 bp, Homo sapiens; identical to SEQ ID NO: 29239
  chr4:156589040-156589109
  hyper

SEQ ID NO: 91777 - DNA, 30 bp, Homo sapiens
  chr4:156589333-156589363
  hyper
tggtgtgaggggctgcgttgcaatgtggtc

SEQ ID NO: 91778 - DNA, 85 bp, Homo sapiens
  chr4:156676892-156676977
  hypo
cgtgagccaccgcgcccggccgattacaatacttttaatacttaacttaccaaagtaatttatttttattcgctgaaaatgtgag

SEQ ID NO: 91779 - DNA, 217 bp, Homo sapiens
  chr4:156680166-156680383
  hyper
gttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctcggccggcctggcagcgagggaactggccgcgcagccggagcttg

SEQ ID NO: 91780 - DNA, 70 bp, Homo sapiens; identical to SEQ ID NO: 7591
  chr4:156680699-156680769
  hyper

SEQ ID NO: 91781 - DNA, 200 bp, Homo sapiens; identical to SEQ ID NO: 7592
  chr4:156680770-156680970
  hyper

SEQ ID NO: 91782 - DNA, 198 bp, Homo sapiens
  chr4:156681186-156681384
  hyper
ccaggaggggaggggcggctggggcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcc

SEQ ID NO: 91783 - DNA, 28 bp, Homo sapiens
  chr4:15697095-15697123
  hypo
acaaggtgaaattgacgggaaaaggaag

SEQ ID NO: 91784 - DNA, 17 bp, Homo sapiens
  chr4:157119858-157119875
  hypo
gtcgtgaggaacaccta

SEQ ID NO: 91785 - DNA, 250 bp, Homo sapiens; identical to SEQ ID NO: 40193
  chr4:1576408-1576658
  hypo

SEQ ID NO: 91786 - DNA, 406 bp, Homo sapiens
  chr4:1577697-1578103
  hypo
caccccccacctgcccggctgtgggctgcagcctccctcctggccatcccagcagcatctgcagctgggcctatgcggtgagtccaccttaagtgggtttgatcggcccgtgcactggtgagagcatgctaatattggctccaataaagagcaaatcagggccctagtcgacgcgtcttatcacacagtcagaactgatggctgcagaagtcataaagatcccatttaatctcgcgcctatctatcacgcggctgccttcatcctctttgtgccggggtaatatgtgctcattacaaaagcaaaacagatctggcatgaataaacgcaggatgaagtgctcactcggaaagtgacagcatgatcagtggcggcagtaatcgcagagaatcgcgggctaaattattc

SEQ ID NO: 91787 - DNA, 709 bp, Homo sapiens
  chr4:15780033-15780742
  hyper
ccctatggccaactgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgaggtgggttggcgactaaggcgcaccggtgggcactgcggggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaaggtgccctgagcccagcccctcgccgggctgcagcccaccctcggcgcgctcagcccgcttcaccgcttcagggacggaatagaactcgcagatgcagggtgtcgctgacattttcaactttttctgcggtttccgcccgctgtctctgacccgaaagtgcccccggacggttacagaggaca

SEQ ID NO: 91788 - DNA, 104 bp, Homo sapiens
  chr4:1578710-1578814
  hypo
actgcacactgttcccggcccctccctccctccagccctctgtgcatctggtagtgttccgggtcctctctgaggcaactgagcgggtacggtggggacagggg

SEQ ID NO: 91789 - DNA, 41 bp, Homo sapiens; identical to SEQ ID NO: 29244
  chr4:157892721-157892762
  hyper

SEQ ID NO: 91790 - DNA, 33 bp, Homo sapiens; identical to SEQ ID NO: 40273
  chr4:15789491-15789524
  hypo

SEQ ID NO: 91791 - DNA, 141 bp, Homo sapiens
  chr4:157997385-157997526
  hyper
actgccacctgggcccggagcctccacgatctcgcccggcgattgtgggcaggggcgcctccgggtaagtgccaggagctccacttaggaggaggggacgcgggttggggcggcgacggtggtctgaggacgggaatagac

SEQ ID NO: 91792 - DNA, 136 bp, Homo sapiens
  chr4:157997527-157997663
  hyper
cctttgcggaaacagcgggtcaagcccggggcggcggagcgcgaggagcactgcggcgtgcccgggaggacgcgcgctgccctgcgcgggagaggggcgcggggcgcctggcagcggcagccgggtccccgctgcg

SEQ ID NO: 91793 - DNA, 120 bp, Homo sapiens
  chr4:157997864-157997984
  hyper
cggccctcctttttgcgggggcaaggatgtgaaagtgggagaagtacctgctgctgtgggcaaggtgtctggaagcaggtgccgctgtcggatgggggaagggagcgtccaatgttgtga

SEQ ID NO: 91794 - DNA, 30 bp, Homo sapiens
  chr4:158006556-158006586
  hypo
caccattatttttaacgtatgtgttactat

SEQ ID NO: 91795 - DNA, 103 bp, Homo sapiens
  chr4:158141554-158141657
  hyper
gctgaaaggccgaggcgcgcggtgggcgcgacagccccggagacccgaggtctcgcggagggacagcggctacgggccccgagctgtgctttctcagcgccgc

SEQ ID NO: 91796 - DNA, 17 bp, Homo sapiens
  chr4:158141754-158141771
  hyper
gggactgcctgcccctc

SEQ ID NO: 91797 - DNA, 156 bp, Homo sapiens
  chr4:158141831-158141987
  hyper
gcgcgtgagtgagagaggagagagggagaagagagcgcgagagagggtgagtgtgtgtgagtgcatgggagggtgctgaatattccgagacactgggaccacagcggcagctccgctgaaaactgcattcagccagtcctccggacttctggagcg

SEQ ID NO: 91798 - DNA, 265 bp, Homo sapiens
  chr4:158142758-158143023
  hyper
ccctcctttccctcccggggcactgacactgttctcttgcttgctgtttgttctttgcaggggggctatttcctaggggcgccgatcaagaatacagtgcatttcgagtagggatggttcagttttccacttcggagttcagactgacaccccacatcgacaatttggaggtggcaaacagcttcgcagtcactaatgcttgtaagtaatgaatattcatgcctttcgggtgctgcacgcggaaggccagcgagtgtgagtgtgt

SEQ ID NO: 91799 - DNA, 175 bp, Homo sapiens
  chr4:158143291-158143466
  hyper
cacctcgctccccatcgagcgcctgttggcaccctgcccacagagaacacgttgttccccagggcgcgcagtcgggctgttggacaaatcccacgagggactgccggagcccagtggcctcctgccccagcagctgccgctctcgcccgctgcccccagtttagatccgcagcac

SEQ ID NO: 91800 - DNA, 95 bp, Homo sapiens
  chr4:158143609-158143704
  hyper
cggccgggtggcgtgggggtggggcggggaggcggtggaaagggggagcgctgtcaatttctcctgctcagttgcgcttccgcttaagttggagg

SEQ ID NO: 91801 - DNA, 252 bp, Homo sapiens
  chr4:158144020-158144272
  hyper
gctcccccgcgcaggcgtgggcaggcagtcgcggccactgtgccttcctgccctcttcccagcagctgccatcatttcctgccgactgccctgcggtgattctttcctgccctaatattcgcagtcgttatttcatagataacaatttgggggagatctgcggatggctcacttcccactttggctacagagcttggggaaaattaccacaggaaaagcccaactgcagttttcccacgtcacacaaacaac

SEQ ID NO: 91802 - DNA, 199 bp, Homo sapiens
  chr4:15826894-15827093
  hypo
tgaaggcctgaggctgtttccactcatggagaaggggaaggggagctggcatttacagagatcacatggtgagggaggaaagcaaggagaggtcaggggaggtgccaggctgtttgtaatgaccagctgtcctgggaactagtagagtaagaactcattactataaggacagcaccatgccattcgtgcaggatcatcc

SEQ ID NO: 91803 - DNA, 428 bp, Homo sapiens
  chr4:158740662-158741090
  hypo
tggccacgcaccagccgtcacgctccctctccacactgcagcttccttctgcctcacggcaactccccacttcacactgctagtacgtgtctgccaggtgtctgccaggtgagttctgcttctgttgccctgccagcacacaggagttcaatccacctccgatagccccactgactgccattacagaccgagccttgtcgggtacaaagccagccagccccattcctgcccgcaacccgctcttgcactaacactgtacagagaacagcagcagatcagcctccaccctaagtgactactcctgcttacagggcacagagaaagcacccagatctggactcgccagcgccccgccttggagccaacaccacctcaagtgcgacattgcacatagccgcaggcatgctccctcccgcacctcgcggcac

SEQ ID NO: 91804 - DNA, 46 bp, Homo sapiens
  chr4:1598363-1598409
  hypo
gctctttcactcacacggtgtccgcccgccgcgggctgctgtggcc

SEQ ID NO: 91805 - DNA, 43 bp, Homo sapiens
  chr4:159927254-159927297
  hypo
attatgtatgtggctcgaattatgtttccgttgaacagtgttg

SEQ ID NO: 91806 - DNA, 30 bp, Homo sapiens
  chr4:1603751-1603781
  hypo
atggtggaggtgggccgggggagatgggac

SEQ ID NO: 91807 - DNA, 179 bp, Homo sapiens
  chr4:1605588-1605767
  hypo
acgcagagcagacagcgattgctgcaggcctgacattggccggtgtcagttctcggggcgacagggccaaggccaccttgggccagccaggtaggagggttcccatccctcacaagccctcatgggcacagctgctgcctccagcctgccagaaaagccctgcccggctgccctcagag

SEQ ID NO: 91808 - DNA, 305 bp, Homo sapiens
  chr4:1608336-1608641
  hypo
ggacgggtcctctgacgatggctcgtttcactcagcatggtgtcccgaaggtgcgccttcctgaagcacattgaagaacccccttccttatcctggctgcataatagtctactgcacggatggacccctgtgtagcgttcccctgcgagggactcgggcagccacgccccctagctgtcggggaaagcgctgctgtgaatgcgggtgcagctgtcccagcccctgctttccactcccttgggcctgtacccagaggcggaatttcaggatcacctggagattctgtttaacgttttggaagctgc

SEQ ID NO: 91809 - DNA, 553 bp, Homo sapiens
  chr4:16083930-16084483
  hyper
ttcaacccaacatatcgcagcggttgttcgtgtcgcatgagtctcggggggcactcaagaactacgatcgtgcacttgctttcttaacaaagaacagctgccgccctcaggaactccagcaaacctttctccagaaaggtcagtcgccttagcgggctccaggagcaacctgttgcagaatgaagcctggggcgccggcttccccgccctttacctccaaaccacctccaggccaagccccctccaggcctagctcccttctgggcggaagcctctcgcgagctgcgggacacaaaagaatgagcggcggggcgggcgcgggaagccaagagactccaggaattcgcagccgcgcaggggagggggttgccggagtaacttggctgctctgagcgcgtcggcgccagttccccgccgcggcccctgttgggcaccgatcgggggcgatcttgccagagagaaggggttctggagctagttcctccctccgatccgactccctgcccctccagacacgggctttcggggaaactgatcccgagcctctgacttt

SEQ ID NO: 91810 - DNA, 112 bp, Homo sapiens
  chr4:16084707-16084819
  hyper
ccatatccctactcccgctgtggtcggctgcacagtgttggcccatttccgcactcagccagggaagctcagcgcctcacgtccccggggccatccctagagtttcctttac

SEQ ID NO: 91811 - DNA, 14 bp, Homo sapiens
  chr4:16085166-16085180
  hyper
cgcagagcgaaccc

SEQ ID NO: 91812 - DNA, 121 bp, Homo sapiens; identical to SEQ ID NO: 2386
  chr4:16085181-16085302
  hyper

SEQ ID NO: 91813 - DNA, 251 bp, Homo sapiens; identical to SEQ ID NO: 28829
  chr4:16085351-16085602
  hyper

SEQ ID NO: 91814 - DNA, 42 bp, Homo sapiens
  chr4:16085674-16085716
  hyper
cgagccctggacgcactctgattggaccggctgagctgcttc

SEQ ID NO: 91815 - DNA, 30 bp, Homo sapiens
  chr4:1614181-1614211
  hypo
cccctcagacacacacgaaggcatgcgcgc

SEQ ID NO: 91816 - DNA, 560 bp, Homo sapiens
  chr4:1616533-1617093
  hypo
caagctcacagccagcggtgccacagctcccacccagaggcaggtcgccccacacgcatttctccacggggtgccccatggccgtcctatgctgacggacaccagatggcatttcagcaccgggcacaggggccgctttaaacagcaaaatcaccaaagggacacgagagcaaaaacatggcacacgcaaaccacaaaaaaggacatttacagatgagcagagacagaaggcaggatgcggccacgcccaccccacctgggcacacagaaggcaggacacgaccacgcccacctcacctggggacacaagggaggcaggatgcagccacgcccaccccacctgggtacacacggaagacaggatgcggctacgcccaccctacttgggcacacacacggaaaacaggatgcggccatgcccatcccgcctgggcacacatggaagacaggatgtggccacgcccaccctacctgggcccacacggaagacaggatgcggccacacccaccccacctgggcgcacactgaagacaggatgcggccacgcccaccccacctg

SEQ ID NO: 91817 - DNA, 30 bp, Homo sapiens
  chr4:162044644-162044674
  hypo
ctgacagaggccaggcgcagtggtataatc

SEQ ID NO: 91818 - DNA, 81 bp, Homo sapiens
  chr4:1623676-1623757
  hypo
caccgcattcatgaacgaatcgatgctgctgtcttgggaacggggcacatattaaagggcaggttccgaccccatctgctc

SEQ ID NO: 91819 - DNA, 237 bp, Homo sapiens
  chr4:163085242-163085479
  hyper
ttttgcatatcaactcgccgagaggtgaggggccgcccccttgactgggcttctgctagagtcagctgcggcaatcggggcaacaaaattcaggcttaacgtcagcgtgggcatctttggacttcaggatgtattctcaaccagtccagtagaaactaaacgctttgacggtgctggagcctttgccttcgcggggactgccgtttctgcgcactctaagatcgctgcgggcacagc

SEQ ID NO: 91820 - DNA, 324 bp, Homo sapiens
  chr4:164252883-164253207
  hyper
ctcctaacccagccacgttccatcattacttttctaaaagaaagagctaaagagttccctgattagaactccgatgattaaaagcttcgggtgtctatcggggcgcagcgccacactcgaagcgcccggtactgcggagcgcggctcgattgcagccgagaagcgcggaacccgcaagtgggggtgggcttgcgcgctggggtccgcgccgagggctactcccacctccgccagctcccagcccgacacctgccgcgggacccgtgcgacgctgggcgacgcgccaagcccacccttctccggctcatcccagccagttactcc

SEQ ID NO: 91821 - DNA, 573 bp, Homo sapiens
  chr4:164253208-164253781
  hyper
cgaaaactccggtgcggccagagccagcgcctccagccagctcaagacacgtaaggaaaatgagcgggtgtgggataggcgaactcgggcgccttcccagtgcctcggccttttaaagagaaccggggtaaaggaaaacttggatccccatccagaaattccccgggagcaggtggtgggaaagcccgaactccgcgtagggtaccctctcctttcacccgcgtcgtccccatacccttcggcaggagcccgcgaacggtccggtgatttggagcaacctgcgacctgcctgcactggagaccccaccttggtcccccagagccagtttcggacactcgcatcgtttttcttcccctctcatccttcaccttgtcaatgagagatttcgcagaagtctctggaaaggcataaactcgcaacttaccctctttggaatttgtctttttcgctcctgcttattaaagaaggaagggtgggaatggaagggagcagagtggggaagatccgctggtatttctcctgctcagatcctaaagattgatgaagctaggaagagacgcctccttaaagcc

SEQ ID NO: 91822 - DNA, 183 bp, Homo sapiens; identical to SEQ ID NO: 29255
  chr4:164264670-164264853
  hyper

SEQ ID NO: 91823 - DNA, 250 bp, Homo sapiens; identical to SEQ ID NO: 29256
  chr4:164265192-164265442
  hyper

SEQ ID NO: 91824 - DNA, 406 bp, Homo sapiens
  chr4:164265443-164265849
  hyper
gttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaactcgaattccagaaacgggaattctttttt

SEQ ID NO: 91825 - DNA, 30 bp, Homo sapiens
  chr4:1649418-1649448
  hypo
agcgtgagcatgcagcggtgcacatgagtg

SEQ ID NO: 91826 - DNA, 611 bp, Homo sapiens
  chr4:165304413-165305024
  hyper
tctcgcccaggagggcggttgcagggaaccgaaatcggacacaacagttgcagtgaacccgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccgg

SEQ ID NO: 91827 - DNA, 131 bp, Homo sapiens; identical to SEQ ID NO: 29259
  chr4:165305059-165305190
  hyper

SEQ ID NO: 91828 - DNA, 36 bp, Homo sapiens
  chr4:165854310-165854346
  hypo
ttaagggcttgaggacgggggcgcagagatgggggt

SEQ ID NO: 91829 - DNA, 526 bp, Homo sapiens
  chr4:166299918-166300444
  hyper
aatattttttccatacgcagtgacgtgggtgggtcatgggtgtctcaatgacagtaacgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctggg

SEQ ID NO: 91830 - DNA, 136 bp, Homo sapiens
  chr4:1663439-1663575
  hypo
gctcagcgaggcacccgtgcccactcccctcccaccgcctcatgcctgtggttactggtcgtctgtgtaggtcccccatgaggacacaaccctaaaaatcacgtcatgatttgcattaggacgcagcattcctcca

SEQ ID NO: 91831 - DNA, 3 bp, Homo sapiens
  chr4:166414393-166414396
  hyper
gga

SEQ ID NO: 91832 - DNA, 25 bp, Homo sapiens
  chr4:166414896-166414921
  hyper
ataataaatccgcagggattcaagg

SEQ ID NO: 91833 - DNA, 30 bp, Homo sapiens
  chr4:166463182-166463212
  hypo
caaggcactgcataacggcaataagacccc

SEQ ID NO: 91834 - DNA, 265 bp, Homo sapiens
  chr4:166793773-166794038
  hyper
ccacgtgagccatagcgccagcccatcggcaaggtctcagcgtttcctgctgctgcaatctgtaactcgattttggattttttttttaattgcagttctgaggatcttagttcttagcaaaactttgttggttaggagaccaacagtagtctgtttattttcttaccaaaatcgtgaagactcgcacacttttcctccattcctgcgctgctctaaggttaaacagcagcaaaggaaagaaatacacactcgctgtttatttggg

SEQ ID NO: 91835 - DNA, 654 bp, Homo sapiens
  chr4:166794574-166795228
  hyper
ggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccggta

SEQ ID NO: 91836 - DNA, 32 bp, Homo sapiens; identical to SEQ ID NO: 29263
  chr4:166795606-166795638
  hyper

SEQ ID NO: 91837 - DNA, 24 bp, Homo sapiens
  chr4:166795969-166795993
  hyper
ttcccctcccttctacgcctctgg

SEQ ID NO: 91838 - DNA, 159 bp, Homo sapiens; identical to SEQ ID NO: 29264
  chr4:166796117-166796276
  hyper

SEQ ID NO: 91839 - DNA, 23 bp, Homo sapiens
  chr4:167721038-167721061
  hypo
aagtatgaaaatggccgggcacg

SEQ ID NO: 91840 - DNA, 106 bp, Homo sapiens
  chr4:16787092-16787198
  hypo
tgcaagtgcccattccgactccgtaaacaggccaaaatgtaatgtggcagcatcgcctaccgtggctgcaatggccgggcagcagccgcatcgggtgaaagcagag

SEQ ID NO: 91841 - DNA, 163 bp, Homo sapiens
  chr4:168154961-168155124
  hyper
gctgggagggggcagcggaactgtgaacttctccagcagccctgcgccgccgcgtttccctaaacccctctcctcagaaaacggagcccactccccacccacatccggcggccgcggcccccgcctcggagcagcgcgcgcgtgtgcccggggatgtgggtgc

SEQ ID NO: 91842 - DNA, 383 bp, Homo sapiens; identical to SEQ ID NO: 7607
  chr4:168155125-168155508
  hyper

SEQ ID NO: 91843 - DNA, 79 bp, Homo sapiens
  chr4:168155788-168155867
  hyper
ttccccctccctccccgacctccgtttttttcctcttccacctcctcctatcccaccttcctctcgctggatcccagct

SEQ ID NO: 91844 - DNA, 30 bp, Homo sapiens
  chr4:1684775-1684805
  hypo
actgccagtacccagcgcacaaggaggact

SEQ ID NO: 91845 - DNA, 55 bp, Homo sapiens
  chr4:1686695-1686750
  hypo
cagaggagagggtggcgggcagcggaaggaggccgtgccccgctctcggggtctc

SEQ ID NO: 91846 - DNA, 399 bp, Homo sapiens
  chr4:1687080-1687479
  hypo
gaaggggtggtctgacgggagaaagagctacctgtgtcccctggccaccgtggggctcggtggccacgtcccacagtggacactgtgggcagacagatgcatggaggccggctggttccgggaataggctatgggtgaggccatgcagcacccctggggctggatgctgggggaggcatcggggctcccaggggtcaggctggggcctcccaacaggttctgggcctggtaaggctagtccggtgcaggctgcgaagccaggccagctgacaccaggactggctggagtcagcctcacctgtctggaagagtgggagtcccagcggggctggggaggggagaagggctggagcaggcgtccaggccattctcttcgctggggtccggtaatcccccacc

SEQ ID NO: 91847 - DNA, 72 bp, Homo sapiens
  chr4:169553199-169553271
  hyper
tcctaatcccttcttcggactcctctttgggggttggcgggggcgggtcctgcttcgcgggacttttctgtt

SEQ ID NO: 91848 - DNA, 169 bp, Homo sapiens
  chr4:169753974-169754143
  hyper
ttctgggcctgggggcggcgtggagccggcggctcagtcccctcagtcccaggccttggcagccgctttgttcacgccgggcgcgggccgaacccgaacctcagctgcagcactggcagcgcgcaccggccacgcgtgggttcccggccacggccgggccaacaaggga

SEQ ID NO: 91849 - DNA, 153 bp, Homo sapiens; identical to SEQ ID NO: 40364
  chr4:170484641-170484794
  hypo

SEQ ID NO: 91850 - DNA, 35 bp, Homo sapiens
  chr4:170537901-170537936
  hypo
ggattacaggcatgagccaccgctcctggcaagat

SEQ ID NO: 91851 - DNA, 26 bp, Homo sapiens
  chr4:170865261-170865287
  hypo
ggtttcgtctgcggcttgtcctgcta

SEQ ID NO: 91852 - DNA, 30 bp, Homo sapiens
  chr4:170899334-170899364
  hypo
caaaatgcacaggctcgagattttggagtc

SEQ ID NO: 91853 - DNA, 30 bp, Homo sapiens
  chr4:170912774-170912804
  hypo
ctcttttttggactgcgggtgaactgacac

SEQ ID NO: 91854 - DNA, 93 bp, Homo sapiens
  chr4:170916682-170916775
  hypo
gaatctccatccacacggcacttgtccagacaggaacatctcgaaaacgttcttgctgctgcacattaccattcgcatcggtctataaatacc

SEQ ID NO: 91855 - DNA, 30 bp, Homo sapiens; identical to SEQ ID NO: 40365
  chr4:170919945-170919975
  hypo

SEQ ID NO: 91856 - DNA, 592 bp, Homo sapiens
  chr4:170947275-170947867
  hyper
aaacacccgaaagttcggcggccccggcgccgactcggccgccgacccggtgcggggctggctcccacccgtgcccctccgccccggcccgccgggggcccccgctaacctgacaccgccgcgccactcaggtggccgccgtgcacccctcgccatggccagcccgacagcggccgctgcgccgcactctgcgccggacgcccggtagcgcctactgcgggcgagccgcctccgccggcgcctcacagcgttgcgagctgcgccgccggctgccgggagcgcggagcttcccacctacaggagcctgggccggccggggccgagcatgcccagtgcggctcgccgggcggcgcggaggcgcgggtgtagccgccgggttttcgcggcagccgcgggcgggggcagcggggcgggcggtgcggcgcgagccagtcggtgctgcggagcggccccgcggaggagccaccggaggctgtagttgccggggagtcccgcattcagtccgctcagcctctgggccgggcctcggcggcccccagagccccacacccgcaggcccagggcctccgcggcagcgcgggactctcactcc

SEQ ID NO: 91857 - DNA, 318 bp, Homo sapiens
  chr4:170948515-170948833
  hyper
cccggtgggttgctgcgaaaacccggaaaggtggactttccacattgacgctcccggcggctccggcagccagactgggcatgttccgccgccgggtcaggcattgctgtgccaagagaggagctttagcaactctcagtctctctgctcctctctgttcctggcaaactggcaaagtagtgcctctgaccccacgccccgaggtcggacctgcagaagtgggtcaggacccgactgagcatgctccgggcagtgccaggctgccgcacgcggctgcatctggttgcccaaggttgatgtagccgcggtctctcgtca

SEQ ID NO: 91858 - DNA, 62 bp, Homo sapiens
  chr4:171544709-171544771
  hypo
gacactgacaggaggcggagctcaggcggtaatgctcacttacctgccgctcacctcctgct

SEQ ID NO: 91859 - DNA, 30 bp, Homo sapiens
  chr4:1719182-1719212
  hypo
gcccaggcagacacccgtgggcacccaccc

SEQ ID NO: 91860 - DNA, 15 bp, Homo sapiens
  chr4:171964525-171964540
  hypo
cgggcctcagctgcc

SEQ ID NO: 91861 - DNA, 24 bp, Homo sapiens
  chr4:172498649-172498673
  hypo
tttttttttttgagacggagtctc

SEQ ID NO: 91862 - DNA, 80 bp, Homo sapiens
  chr4:172596057-172596137
  hypo
tgtaacatacgcccacttgggctctgggagtcacaggttcccaaccctggatgctgccgtggggccgaagcccagcaccc

SEQ ID NO: 91863 - DNA, 32 bp, Homo sapiens
  chr4:172596627-172596659
  hypo
tactgaagctagggccgggcgcggtggctcac

SEQ ID NO: 91864 - DNA, 552 bp, Homo sapiens; identical to SEQ ID NO: 29269
  chr4:172733596-172734148
  hyper

SEQ ID NO: 91865 - DNA, 88 bp, Homo sapiens; identical to SEQ ID NO: 403
  chr4:172734188-172734276
  hyper

SEQ ID NO: 91866 - DNA, 115 bp, Homo sapiens; identical to SEQ ID NO: 404
  chr4:172734277-172734392
  hyper

SEQ ID NO: 91867 - DNA, 269 bp, Homo sapiens
  chr4:172734591-172734860
  hyper
ggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagag

SEQ ID NO: 91868 - DNA, 217 bp, Homo sapiens
  chr4:172735016-172735233
  hyper
cgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttc

SEQ ID NO: 91869 - DNA, 24 bp, Homo sapiens
  chr4:172903767-172903791
  hypo
tcttccagacgagcttgttggagg

SEQ ID NO: 91870 - DNA, 30 bp, Homo sapiens; identical to SEQ ID NO: 28831
  chr4:17326218-17326248
  hyper

SEQ ID NO: 91871 - DNA, 17 bp, Homo sapiens
  chr4:174307595-174307612
  hypo
gccgtgtttatatacac

SEQ ID NO: 91872 - DNA, 55 bp, Homo sapiens
  chr4:174429633-174429688
  hyper
aacttttccaccttccggacctctgcagtccgtcgcaggacgcccaaaccacagg

SEQ ID NO: 91873 - DNA, 321 bp, Homo sapiens; identical to SEQ ID NO: 29276
  chr4:174430233-174430554
  hyper

SEQ ID NO: 91874 - DNA, 357 bp, Homo sapiens; identical to SEQ ID NO: 29277
  chr4:174430793-174431150
  hyper

SEQ ID NO: 91875 - DNA, 610 bp, Homo sapiens
  chr4:174437937-174438547
  hyper
cgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaaccttttacaaggcatgtgggtacaagaaaaaaaatcaaaataaaccactttcatccagcatgggcagtgaaaagaaaagctgccttccagagggggcgagcgggagttttgaaat

SEQ ID NO: 91876 - DNA, 551 bp, Homo sapiens
  chr4:174439797-174440348
  hyper
gctgcatctgggacccgccttcaccgtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctattagcagccaggtagccctgcgggtcgaagatgctcagaggaggagtaaatgcagagaaaaaatagaggaaggaataaaaaaaaaaacaaaacaaaaacacgtaacatacacgcactcaaaaccaa

SEQ ID NO: 91877 - DNA, 125 bp, Homo sapiens
  chr4:174440635-174440760
  hyper
cccgccccctccccacgcacacagccacggcccctcgcgtcttcgcggcacgttaattaaatgcggaaaacagacagaggctgatgtcattgctctcacaagatcataaacgtaaaagagtcatc

SEQ ID NO: 91878 - DNA, 30 bp, Homo sapiens; identical to SEQ ID NO: 29281
  chr4:174443212-174443242
  hyper

SEQ ID NO: 91879 - DNA, 522 bp, Homo sapiens; identical to SEQ ID NO: 29282
  chr4:174443551-174444073
  hyper

SEQ ID NO: 91880 - DNA, 9 bp, Homo sapiens
  chr4:174446507-174446516
  hyper
cgccgggtc

SEQ ID NO: 91881 - DNA, 35 bp, Homo sapiens
  chr4:174448318-174448353
  hyper
aaggagtcctcagagcggagcgcggacggcttttc

SEQ ID NO: 91882 - DNA, 203 bp, Homo sapiens
  chr4:174448460-174448663
  hyper
cggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtccc

SEQ ID NO: 91883 - DNA, 38 bp, Homo sapiens; identical to SEQ ID NO: 29284
  chr4:174449624-174449662
  hyper

SEQ ID NO: 91884 - DNA, 509 bp, Homo sapiens
  chr4:174449899-174450408
  hyper
tcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccacc

SEQ ID NO: 91885 - DNA, 318 bp, Homo sapiens; identical to SEQ ID NO: 29286
  chr4:174450409-174450727
  hyper

SEQ ID NO: 91886 - DNA, 1431 bp, Homo sapiens
  chr4:174450751-174452182
  hyper
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatct

SEQ ID NO: 91887 - DNA, 312 bp, Homo sapiens
  chr4:174452460-174452772
  hyper
cggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccag

SEQ ID NO: 91888 - DNA, 253 bp, Homo sapiens
  chr4:174459122-174459375
  hyper
atgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggc

SEQ ID NO: 91889 - DNA, 124 bp, Homo sapiens; identical to SEQ ID NO: 29291
  chr4:174459527-174459651
  hyper

SEQ ID NO: 91890 - DNA, 365 bp, Homo sapiens
  chr4:174459856-174460221
  hyper
tttgctttgcaattacgggttggcttgtggctacggtgccaccggggcaaatctgcagccgctcgctttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttgaaggacatacttttcaggttcctgacagtcactgagctatacgcaataataaagtgcgtgattcgcgtgtggaaaccagtgtcgtgtccttaccagcttccttttctgtccaccttccctctctcttctacctccgtttcgcttttcttcagtg

SEQ ID NO: 91891 - DNA, 466 bp, Homo sapiens
  chr4:175132735-175133201
  hyper
gaggctgaagagtagcgttctgggtccccagctcagtaggcaccacctctcagggaagtgaccaccactacgctctcagctccgcaagtcgctggacagtcaatagcgctcacacggtgtctaccggatctggcacggtcaagacacaggaacagccgtactttcctgcgggtaagaggcttttcttttgtgcatcacgtgcagaagaagccactccgaagtgcaaacacctttctaaagttttcagtgcttcctaaaatgcagacatcgacgccttgctgagttatccgatcctttgatgatcaaataaaattaaggccagctccctgctgtttgatctgtggctcagtttctctaagggctgccgcgggttccgcaaagactcactccagaatccccagctccctcgcgtcagcgaatgtcccgctggtccaggcagccttttcctgcgcggttcttcagttcc

SEQ ID NO: 91892 - DNA, 1293 bp, Homo sapiens
  chr4:175134868-175136161
  hyper
cctctgggtccttaccgaaagggaaggtcccaaaggaccaccagcgcgctctcggaggctccaggactagacattggactcccacagcgcaacaccatagggactccggtgttcggttcccgtggccctctccttggctcccggtcaccgtcctcacaccccctggccccagttactgacggaagccatgtgcagctgccataatgtgtataaaagaatctctccctggcgttggtttcttctcttcttggaatgcttttggcagatcctccgcgttttccgggtctcttgggagtctgaacatgcattttcctttatttcagacaggattccgagtgttaactagattgtgccctccccactacctatcctgcccatcttccttctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgggtggtttcgcccccctcatcccctcggtcgctggcgcagattgatcctggagctagttacgggtgttaaactggtacgcgggtggggcaattcattaggcaagaaatggattagttgtttattatctataaacattccaaccacagcaaccaatcataaaaccgcggaagggcctgtaaagtaaagcagcagcgaagcctccatgtgggcagctcaggcttagcgattgttcccgggtgataaagggtcgattagggaagtagagctaggaaggtgggggcgggggagcgggcgataattaagcgagtcgtcaggaaattgctttctagatggggatcatgatgcctctaacttgaacggggcaggagaaatattggggtgatttggaagacggtgataagggaaagcacaaaataaggattggagggccgcagtgaggtcattagtgaagctgatgccggagataaaagctg

SEQ ID NO: 91893 - DNA, 83 bp, Homo sapiens
  chr4:175137696-175137779
  hyper
gattgcctgaccactcgtctctctccagcgtttctctaagtccgagcccccatctctcccagtcctcccggctcagcgaggaa

SEQ ID NO: 91894 - DNA, 1458 bp, Homo sapiens
  chr4:175138499-175139957
  hyper
acctagtttgctagacgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagccccagggccaggcaagcggccaagctgcgctctcgataaaggagccagaatggttccatctggttacaaacatatctttttattaaaaagcaatcagatcctgaagcgcttcccttgcggtttaccgctctccgcaggctgcttctccgaagccagcggtggtagcgcccactcggttgagcccacgcctccgccaggcagcgcctccgccaggcagacctcctgcgggacattttgtggccaggggggttcctgcccagggacctctaatagggtcggtggaagctaatttgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgccattcctctccagctcccgagccccactcccacccttgccgttgaaactgtgaaaaagccgccaaagtttgggcacccagcctggcagtcggaagacagtgagataaagaatgcgatagtaagtccttaagtgcttcctagagataaggtcccggaatcctggaaaaattcagtctggcctccctacttcagcaagtcgcctcctgcttctgtcagccccctccccacacacacctggagggagaggcggtggccacaggggtagctggggcagaccctccgctcctccactcccggtggccaggggtcctaaggccacgcggctggctttcttctctgggaatcaggagatgataatgagaaaatccctcaaccattggcgcgacgaaactcaaaaatg

SEQ ID NO: 91895 - DNA, 30 bp, Homo sapiens
  chr4:1752186-1752216
  hypo
ctgtatgggcagagccggggctgctctgag

SEQ ID NO: 91896 - DNA, 30 bp, Homo sapiens
  chr4:1752494-1752524
  hypo
ggtagaccctcaccccgacccccctgtgcc

SEQ ID NO: 91897 - DNA, 30 bp, Homo sapiens
  chr4:1753599-1753629
  hypo
ctccaggttaaggtgcgcctgccaagcagg

SEQ ID NO: 91898 - DNA, 604 bp, Homo sapiens
  chr4:175443197-175443801
  hyper
attccaatccaccagcgctacctatagacaagaggagaggaatcgcgggcctgcgcagctcacgaaatagacggacaaacaataaacacacaagaggctcccctcctggacctgaaatttggcaattaggtttgggttccctcccagccacttctgaggtgtgctcacagcctcagcttcagcaaattttggaagtggcaaagtgggcacgccgggcgcggcctccctgtctccgccagtgcacctcgggcggcggggcgagtctcggagtgtgtgggcagagaaatttccgcggctgggcgccgggcttaccttggcgcccttaagcagcagcgcctctgcaaaggctctgcctatgccctgagccgcgccggtcaccagcgccactttgccgttcacgtgcatggtgcagccactgctggggcgggcggtgggcgagctccgcgtctccgcgcggccgcggcttttatgcccccctgcgcgcgcgcgcgtgcagcccggcggggcgctcccctgccagtgggcggggaggaaactgtcaagccagcgcccgccggggaacccacgactgtgtcacctgccccctgagcgttctggagcgcca

SEQ ID NO: 91899 - DNA, 884 bp, Homo sapiens
  chr4:175749823-175750707
  hyper
aacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacactttaggtcttctcggatgtgacactgt

SEQ ID NO: 91900 - DNA, 22 bp, Homo sapiens
  chr4:175836862-175836884
  hypo
ccgcgcccggccccattgttta

SEQ ID NO: 91901 - DNA, 87 bp, Homo sapiens
  chr4:175940800-175940887
  hypo
agtacgcgtgtgcctcgcgccagtccacgctaggagagcactgggaccgagacccggcaccacctcccggtccgccctccagaactt

SEQ ID NO: 91902 - DNA, 30 bp, Homo sapiens
  chr4:17638206-17638236
  hypo
tgagctgaaggtcctcgggcctggacgctc

SEQ ID NO: 91903 - DNA, 45 bp, Homo sapiens
  chr4:176394073-176394118
  hypo
ggaacctgaaaatttcgtctttgcaggtggcggcttccctacagg

SEQ ID NO: 91904 - DNA, 15 bp, Homo sapiens
  chr4:176922653-176922668
  hyper
gttcttcctcccctc

SEQ ID NO: 91905 - DNA, 50 bp, Homo sapiens; identical to SEQ ID NO: 29302
  chr4:176922729-176922779
  hyper

SEQ ID NO: 91906 - DNA, 301 bp, Homo sapiens; identical to SEQ ID NO: 29303
  chr4:176922780-176923081
  hyper

SEQ ID NO: 91907 - DNA, 607 bp, Homo sapiens
  chr4:176923082-176923689
  hyper
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctccctctttccacctgcctcctctgcgagaagcccgttttcctcccctt

SEQ ID NO: 91908 - DNA, 319 bp, Homo sapiens
  chr4:176986855-176987174
  hyper
cgccttcaacacactttctctgttgccaggtaaccacttctccctcagcctagtctccaagggtcacgagccacttccgcctccccctctcgggcgctccaatcagcgacctgtgtagctgtcacgtgggcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgc

SEQ ID NO: 91909 - DNA, 5 bp, Homo sapiens
  chr4:176987175-176987180
  hyper
cccgc

SEQ ID NO: 91910 - DNA, 107 bp, Homo sapiens; identical to SEQ ID NO: 2497
  chr4:176987206-176987313
  hyper

SEQ ID NO: 91911 - DNA, 42 bp, Homo sapiens; identical to SEQ ID NO: 29308
  chr4:176987314-176987356
  hyper

SEQ ID NO: 91912 - DNA, 1177 bp, Homo sapiens
  chr4:177713228-177714405
  hyper
acacacactttcccccgcgcaggttctcgggtccgccgcagaccctaacgcaaactctcgggttctccgcaaaccctaacgcagacctaccgtggcctcgcccgcgtcgggctccgcgtccgagaggtcgagtccggactcgaaggcggcggcggcggcgggcgcctcgcgaggacccgggagcagcgcagcggcgagcagagaacacgccacagagaagaagcccagcaagtgcatggtggaaggaccgggggtgggggaccggtccgctggcgggggcaggggtgggggcgcgggcgcccctgcgaggccgcgggcccctcctggtccctctcccccgggctcctcccggcgaccccccctgggcgagccggaggcggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggcggccccacctcccccggcccccctctggatctctccctccccgcccctgtcccctgcggggagcgggcggccggaggggcaagttcagtcccggggctggcggttggcgggaccggctttagaggtgatgcgaccaccctggaccacgtgcagcggggagaaactgggcaccgtggggtggaggga
